United States Patent 7,365,185 (GENOMIC PLANT SEQUENCES AND USES THEREOF) - sequence listing, part 43

SEQ ID NO: 64284 - DNA, 11800 bp, Oryza sativa
  unsure (1)..(11800): unsure at all n locations
tgaataagacgagtggtcaaacgttgcaatcaaaaactcaaaatcccttatattgtgggacagagggagtacacaactacaatgatcgaacaacacgatcatattggattcaccgatccaaccgaatctaatggtgttttttctctttttgctaatatggtactaatttgtaataaatctcggcggtgacttgttttctatctttttataataataaaagtatattacatcctttgacttttataaacaataacaatagatatataatttgggtagaaattgatctataggagtaccttctaactccctttattccacaatatagctactttagtggtcaaattttgtcttgaaatataattaatgaagtattgttctcctaccaaccatctctattggtggtattcttttctcctgaagatgaatattaagttttttacgtaaaatgaggtggtattaacatatgatttattgatttttaattattactccatctgtattttaatgtatgacgtcgttgactttataatcaacgtttgaccactcgtcttattcgaaatttttatgcaaatataaaaatacttatgtcatgcttaaagaacttttgatgataaatcaagtcacaataaaataaattataattacataaattttttgaataagacgaaaggtcaaacgtttgtcaaaatgtcaacggcgtcatacattaaaatatggagggagtacaaacttgaaaaatagattaatatgatattttagagcaactttcatatagaaagttttcacacgaaacgcaccatttagtagtttaaaaagcgtaccacgaaaatcttaatgtttatccaactcatgttggagaagagtttctacccctatatatatatatatatatatatatatatatatatatatatatatatatatatatatatatatatatatatatatatatatatatatatatatctttggctgaaaaaaatggacactcgcacaacactcgtttctaaatttttctcctctatctcgtcatttcctctcttctctctcctaatcttttttagtaacggtgaaatctaaattttttttctagtaacggcaaaatctgaaaaatctcttctaagactcaaaatcagatgtatgttaggacgaatggaataggagaattcatgaataaattgtcttcttagagaaacatcaccgcgcgatccactgcaactttaacatagcacattataaccattggatcgatacagccactattgcatactattcgtgaacaatattttctaatgatctgagctgttggtttttgatccatcagctaccttgcaactgctaaagttgcagtcatagcaacaatctcaaatccccgtgcaccgtatcagccacatccagccgacggctccttggctccatgcaggctcgtcgccaggcagcccctcaaaatcgagtactagtaatagtagtcgactagtcgtagtctgtacgtagactgtaataggttgcggcaggtcatacaattcggtcacgtcaattcgcttagtggtgcacaacacacattcaggttcagacaaatgatcccttccacgaacaaaacgcaacacgtaatcagcacattttttttcatttttaatttttttttaacatttacaaaaatattatatcatctaaaatataaatttacagcacatttttttgcagcaaggtgtgcacattttacacttaggtcccttgccgccctctacaagggcttcaaaggggtaaatgtaattttcgccctaccaaaaatgtatttttctagttttttttcaacttgtccgtccctcacatcacgtcaccctaccgccctctaccggagagggcggtagggtctacttctgtaaatatttttaccggtacaatatttctgtaaatattaaaaaataaaaattttaaaatgaaaaaaattcagtaacagcgcgactcacgtttccatgggccatgtggcagaaagttcaaccaccagcccaagcccgatgcagattatgctttcgcaaaatgtacttgctactggtccatgattccatcagatgtcaaatgggttcaatgttttcagcaaatgtcctgcgaatcaccaggcaaaaaaaagggagctagtacaaagcctcaatacacactggagtaaaaccagcaacggcatctgcgctccacatctcgcgatgtgcagcggtctgagataaacagtttctatgtgatggaacttaaaagtctcttttattcaaaaacacgggagcgggcaatcgctcactatctgtccctctgggtattgcttagttttagttgaggcatgagtaagcgagcgtcttctcctccgacagctcctgggcagtcgcgtccatcttcttccttgagaactcgtcgatcgggagacctgtaagaaacgatagatcatcaggcatttgtaaactgttgcgacataatcagcgcaatactctatacattggcacattttaacagacagcccatgaacatgtagaaagaaggtaagcaagcataccctgaacaatcgtccattcgccaccactgcatgttactgggaacgagtagatcagaccagcaggcacaccatacgaaccatcagagtacacacccatggagacaaatgttccctgtggtgaaaagttgaacgtgttgatgaataattaggaccgaattgagggaaatgtctaaagtaaaattaggaggaaaagacatggaatgtcaaaaggccaaacagacctcaggagtgccaagaacccagtcacgaatgtgatcgcatgcagagctggcagcagatagggcactggattgcttcctcgccttgatgatggcggcaccacgctgctggacggtagagatgaattccgtatttaacctgtttgagagaccaccattaaatccatatgcaatggaaatatgaacaaaaacaaaaactacttttttttaatatatgcagcatttctgatttaccactcatcatcagcaacgagttccctgacaggcttctctccactgggagtcttcacagtggcgtggttaacatcagggtactgggtggatgagtggttgccccagatgatcgcattcttcacatcagtaacttggacattaagtttttcagagatctggccaagtgccctgttgtggtcaagacgggtgaggcaagtaatgttcttctcagggatggatggagcgaattcttttaagatgagagcgttggtgtttgctggattggcaactaccagaacctgaaaaataaaaggtacagccgaacattataaatctctaattagaaagttgagaaagaattaacttcacatggatttacaggcaacttcaaaataattgaatttgataagtgctttttcaagtttaaaataattgaatttggtaatgcataatcaaataggaaaataatggagtgatcaatctcataaactataaatgatgataagactgaattattatgcattatagcattacatgtgattgctactcaaggtgagagcaatgctggcaacttgacaatcattgcagtaaattgcaaactacatttgaaatatttccataccttgcagttaggggctgcatgagcctcaagagcagaagcttgggatttgtagatggagacattttttgacataacatccttcctttccattccctccttcctggggaacccaccaaccataaccgcaacattcacaccagtgcaggcctccacaacatcagttgttgcgacaattcctacaacaccaaaacagaaaagtttaaacatcagcaaggatgctgacagtttaaaaacaaattgagttcaatgaaccagcttacccttcaaaagaggaaatgcagcatcaaccagctccatcttaaggccattaagagattcagtagctggtggaatgtcaagcatgtgtagaataacaggctggtcagcacccaacatcacacccctagcaatcatggggacaagagcatatccaatttgtcctgcggaataaaagaatgaattagctcacaaaagaaagcccctgggtgcaaatttcttaagacacacaagcaacaatggtattgcattccatatgaagtgcaaaccatcagctttcaaatactgctacatttccagatgagcataaaaaaatacatttgttttcatgctgattaccatatcacctattatcatcattcgtgaaagcacccaaaagaaagctagtggcccctcctcagggcttcacctgatccaacctggctaagagtgggattcagagtgtactaaccaacaatcagttacatttccaatgcccgagctcctaagtggagaacaaagcacccctttccacgtacaagaggacctcagaccacattacaaaagtgtttgtgaagtgcacaccacatcagattgaactaactaattcaattaattgccagctaggttcccatctggcataagcatacatcagaaaaatgaagctttcataacaatgaaggcaaactagtttaagttaacaagacagtgatagttttcagctgttgaaagaaaatatttatagcaatttagcaattctaactatggatcacactagacaagagattagaatgagatggataaacaaaaaccatttatatcttggtttaagaaccccaacttgtgtagatcaatttttagcacgagcactgctacacatactaaatttttcttactaaacttttactaacaatcatctcaaccatttgattttagtagatggaagttataaaaaatttagacgcactcatagcatgacatatcagtgttagtaataagaatttagtaagaaaaagttagtatgcatagccttttccttattagtaccctacaatttggtgctaatcccacttattaagcatgtgcaatgcaatttaattatttagatttaaatgtttaaatgccaagatatcctgccaaatcccagatggagaatctacgacggaattttggatcaaagtcactatcactatatggatgcatgataatttttgcagttgaatcctgagctgggataagacatgccagaacttgacggaatacaaacccgatcccaaacagttttgtggggccaaattgaagggacacaccctccagagctaaactaaattaaatgcatgtttcaagacaaacatctcaagttatcagtgtatgtctttgagaaccaagctcacaactgtgactagctcccatcggatcatttgattaacagattaataggtaaaccctcctaaacccttttaacctataagactaacctcccacctctaactatggaatcccacactcccactcatcaaatcgacaccatgatccatttcaaaccactcaaacccctacagatcaaaagaaatacacatggatctccactaaacccccactaaaacctcatgcacagacttaacacaaactcgagtcaactatcacaaactaagcaaaatcagtcccccgaaaaccagatcaagcgaccataataaccagatctaatacaacccaccatcagatgagctcatccaatccacgaaccacaaaacttagtaccgaaatcaaatcacgccagtgaccttctcccactaaataatccgcaccccccccccaaccagatcaaccgccacacaacgagatctagctatctacaaccaccacactcgaaaccctccactggatcggcgcggatctgcagccagatccgagccaccgccccccgcacgagatcgcgtcggcaaaccaagagaacgagggggaagtgaggcgagcgcgacgccgtccgtacctgcggcgccggtgacgagcacgcgcatcggttccttcgccattggagcggaaggggggggggagcgggagcttcgagaaggttctggaagcgtaggggttagggaggaggaggagaggcgacgctgctcttttgggtgagttttgcgagagagggggaaacgggtggccgttatttaacctcgcggcgacggggagcccggagaacccccgttgctcccacgtgggggctcccctacccatctcccactgacggtgggccccacctaggtgggtccacgctgtcggcgacggagcgcgtggggtgggtgggttggagccaggtgtgcgcgggcgtgacaccgtgggcgctggcccacagatcggcgatgggatctgggaaacctgcaacggagacgctaacatcctgacaggtggggacacgactgcgcgttgtggggacaggctgtcagtgatgcaggtggggcccacctggcgtttcgggagaagatgtggccgaaattctttttttgtttttggactaattattaaagtttgcaccagaaagtgtgacgtcgatgccgtgtgggggaagaaaagatgctccgttgggaannnnnnnnnnnnnnnnnnnnnactcttttcttcttccttgggtaacgacgatcatgacatcgtgacaaccgccgtatggagtatttcagaacttatctacgaaaatgtgtgtttgtggatcgtgaggacctcaagtgttcactgaaaataacatgtcattaaaaatatctatcttccacttgatcttcgtattagtgatgtccgtagaacgagtggaattttggagtatacgaagttatatggactaaaggattgtttggatggagactagctttactataactgtagtaaaccacacaaaggctgtgttcgggagtgagggttgggtacccgacacgtaaaacgaagcagcgtctagcgtgagattaattaagttttagctactttttttaaaaaaaatagattaatataattttttaagcaactttcgtaaaaaaatattttgcaaaaaacacaccgtttaacagtttgaaaaagcgtacgcgcgaaaaacgagaaggagaagttgggaacatgtcctatcgaacgtagccaaaatgtggccaacaatttgttagccacaattatggcaaactttggctagaaaatgacaatataacgcacgggccaatgtgctaataaagtgtagcttaattcaactgtgtctaagattttggtatagcaaattgcggtcaccaaccaaacaacccctaaattaagctacagaaatatttttacactacaatgggtggcttcgttgaaaccaaggtttgaccatcggtcaccatagtttaccaccaaggctaaataacgaaaaatgtttgttacgaatttaaaaaagtttttaattaaccttttctagcattttagcttttatctgttttgctcggtaactaacctattaccgaggaggggtacaacgatgataagggaaccactagttgaagatgtcctatatatatggctacacaacaaatcattatcatgtcaatttgtttcaacttgacttttattaatactaaccaagtatgtgaaggaggtcaggaattgactatagtgatgaaatacactctataaatatttaatgtttattagtataagatttggctaacatttaaacccttgtccatcgataattttttaaatgctcttttttaaaaaaaggacaactggtatgcatgaatttttcttgaaaaagtactatcataataccgtatgcttatttcattttacaaacttatgctgatgtaaaattgatggtcaacatttcaaagcctagtcagatcctattctaaatgtcaaatatttataatcggatgaagtaataactactggccaagtgtctccaagacaagactgtaggggttcaaaatttgagacattcaatacccaaaaatatcatagttattgtattataggaaaatgaatggagagaaatatgattgatgaatagtagaggggatgaccaccaatccaccatggggaaacatttttttatgctgagagaaagaaatactagatattaagattaagaaattaggaggttcacttgttgtaaatgtacatcaattcaatactgctgtcccgtctgcaacaaactcattgtgaaggaattacaaaggattgataaaggcaagcatttcctttgtatccatacaacttaaatagggcaaacaatacacaatcttctctctctgtctttcaagaatcacaatcattttaaggttgtgttcttttcccctctttcccaaattacttccctcgtttttccacgcacacgctattcaaactactaaacggtggatttttttttgcaaaagttttctatatgaaagttgctttaaaaaattatattaatatatttttttaagtttttttgctaatatttaattaatctcactataatcgtgtgtttcgttttccgtgtcaggaggcaaggttcccaaccttgcctcccgaacacatcctaaggcactatggagattcaactcatataatagaattgatactacttcatttatcattctcaaaggtaaaaaaacaaaagattatactctcaccatttttaatatatgacaacaataactttttaagatacatttagggagtatcttaaaaactaccgcaaattttttagtcaaaaactttcatatataactataatataattgaaatataattaatacattgtaactatattgtaattatattgtaaccacgatataacttactagtaaaacgtacattcagctatggtttcattagctagcacgtgaatcttatacgtcacatgtgtgaaaatttctttctagcaaaattttccctttatgcacaaatctgaaagttttgagtgcaaaaaaaaacttgcggaagtaatttgagtgagaaaatcaagtgagagataagaaaaaaaatctttcaagtgagatatatagagatatagcaaaatcgtttaactattcacctccatcacaacaaaagcacaatctgaaagcccatgaaaaccgaacacaaacggcctaaaagtccagctaaggctcaatcaggcccatccatcccgctcggcccactaactcctccacactctcttccttcttccgatcgccgcagatagcgcacgccacctcccctcccctcccctcccatggcaacgccaccaccgccaccgccttcgcctcgtcgcctccgccgctagccgttacccccccaccaccggcgccccctcaccttctccccaatgtcgacggcggcgcccgcatccgctacggcggctgcgagcctcttcctccgccggagtctctcctcctcctcccctcgccacgtcttcctgcctcattgggttgcccccattgtcgtcgcgcgccccgctaggtaaattacgcccgcgttgttgggataattggttccgtgcctcgtgaaatcgtagcccaacgttggtagagttcgtcggtttcgcacactttattagttgtcggtgggggtttgcttttttttttttttacaagcagttgttaattcacggtaaatcacgatgaggaaaaaaaaacaggttatctgcggtgccggcgaagcgcggtggaggtggtgttgttgcggctgcatcggcggcggcggggagcgcgcagtttggcgccggggacagtgagaatccatacgaggtagaatgattgggttattgggagtggctatgttcatgtttaggatcagccttcgttggtgatcaggtgattcagtgattggatgtggctcctggtcttgttgtgatggttggtccctgtttgttagattttggggatcagtccacttgatgggttcgaccaggtgaagatggcctataagcggaggcgaaaggatgccgagagcaacaaagatgccgagcacctgttcaaggtggttttgggtcatgggggttcagaatttggttactgttgtgttgttaatgtattgatgagtgatggagttttgtcgaatttcagttagagagggcatacgatatggtcatgatggagcagcttcagaaccggaagaatggggtggcatatggatcaatccaggttactctctactattatttccttgtcacattgatgatgcatggtctacagcaacaaagtttgcacttgcgcgttactgccctttttttgtatgtgctccaccgtttacggtagcactgttcaatcccatgcagtcggcaatttggcatatgtatccaattagagttagatatgaggattcatattcacaaaattgatttgtaattgcaaaactgatttgttctgtatatggtaacagactgttaccattcgtttggtactccttggttaaattccttcatgctaaaataaacacatactgatatttactgttgagcgacgtagtttgagatgcagagatatctaaccaagcaacgcattgcctgctattaagcttgatggttactttagcatggtgaatttgacggagatcttagatgacttatcttgcatcgactcttctagtctccttactggagtgaacttcatgagacctctgtcggttgccatgtttaagaggatccttccaacatatggctaataatgaaatgagtctcatgataattctctattctgatgttttctttcactgattattcagttctctttctgaacattaggtgtcaaaggacattaaatatgctgataatcaaccagtggttccttgggggcctaggtaccttacagttcacattttgtaaccaatctcttcatgtgcttcttcaatatatactgtgtacattttgttttccaatgcatctatacactatgaatcttaggagacttaacagacttaattcttgactgcaatcctgcatccatgaattgggcatccttgttacttaatgcagttctctagcaaaacttgatgatccaatgcccatgcccttattgtttttaaattttaacttttctctagcataactgttgattattcacatgttagttccaaatattaaaactctgggccactggaaatatcatcacacattaacacctatccacttctttgttagctttagtgctatgctattgccatttcatgatcatcatcatgatcatcttgcagatactcaagatccactgggaaggacctgcgcattaatatggcaatatcagcaacatttgtaagaaaattattttctgtatcatcccaagtaccacattgaaatattaataattactgtttttaatcaaacacaatgttttatgaatcccagtggattgttcctctgtactcaactttgttatatgcattggtgttaaacttgaaattacacaatagaaaataatttgaatttcagcattatttcacataggatttttttaatcatcagcttgccaaacttcctatcttgggcaagtcattttgtgtatggagaaaaggtactttattaatggacatttttttatccttttttttttgcagatcatgtatatatctaccatgggccatgcagactggaagcccatgcagtttttgtgttttgcctatttctatcgaatacttgacaaactgaaggctaccgagtcagctagcactcctatatacaatgtgaggcggtttactaaataattttatttgctgttcccttttcattttctatggaatccctgcacttacaggaatgacatatcaaataatcaaattggttcagtttgctttactctattgtagttcagatatgataagagcaaaaggtacactagggaaatggagctattagatgggatggaattcttacttttcatgagttgggaatgcatatatttgatatatgtggctccttttttagttacaaagttacataagtgcatgcttgtcttgtattaaggatcttagattacttggtcactagtttttagctttgcagtt

SEQ ID NO: 64285 - DNA, 3072 bp, Oryza sativa
tgttaaatataatattgaaataaaatgtttgtggcaggagtatggtgaggttgaaggtcgtggcatacacatggcaaaacgagtactccgtagtttgggtttggtacttggatcaatacttgctgtatccctggttagtgggttgttcggatacagtgctatctagatgctaaactattggtttatctgccagttttctctactgtttctcagtattcgtatcctcaccctaatgttttatccttttcagggctacactgggctagccaatttttctcagtttcttgggcagtatattccatctgttgtttataacttccaggtatgttatgcttgagcatatctgatgttgtttgggattattttattggatcagagtgccacatttttatattcattcttgttaccaagatcacatttacagccccattgtttcgcttattcggggaataagcgaaacggcatatttgcaaacgaaaaataatgtgtgaatagaacttttatatacgtgttcttagcgatctaaaagcaaaggctgaaaaataaacttcgttaaaaaaaccccaaaatcaaatccaaatttaagtttgaaaattcaaattttgactgataagcataagcataagcgaaaagatgaggccattaagctgataagttccacacttaaattttctcccatttgctaagttacacacttaaaaaatttcacttctgtcataaagtagaaactggaaagttgttagtgtttttaaaaagacagacaagcctcctgaaaataatattttttcgctggaggctaaaagttaaaaactctaataagaatactggagtaagcaataagtgcaatctctttttctggtggagaacatgtaatggaagaatgctagtgaatattgttgctgttgttttcaggtgaagtaaaactaattggtggctatcttatgccaggaattgattgtgactacagcttcatctgttttgctttgcatattggcgtcgtactatcgatagcaacttgtgtaattgtgttggatcaccccttggcattgcaatcttgataaacctgtcttcatgagggccatggtcgataacttgagcctattctgctatggaatatgagagcccatcaactatataagtgcactgttcttgcatgttttacatcgttcttacatctggaaaattttgcagctactgataagatgttctatccaatgttttgaaactgaaatttagcatgcaagagacagacagctaacaaagcaatgtgtcacatgaaacctgacgatgctgaaaatctagttctagtgagttgttccagcaaaaagttaactgcaattttcctagaagtttccttgagtttgcaatctgcttgcaagttccttgtatatttactgaacaattactctgtgttggtgagttatgaattacaacgtccttatggaatctgcctacttgatcatggaacctcttttgctttagttaatcaaaactaaggtacaatgcctcctctctcactctccacatccaagggaggatgccattttttaatggccaaataaatctggaattggcatgagaaatcggcatctaatccagtcctgaaaatgaacaggatatttaggaaggttaaacagtctacctaccaatctgatctcatacatatacgtagtgatgtagcagatactagtcagcacacatatttgttttgctctgtatgcttccactatacctccttttttcttatgttgactttttagacacattgacaattgatttagtgctgacacacgtttgagttttttccctgtacgagcaaagtaacaatatggaagtatggaagtcaatcactaatatcctatcatttgcataatgctttatagatatatatatatatgtttttccaacagagcattcaaagttttagaaatttgaccactgttttccagcgtctgtcgaataactggcaatgttccatacattcagtactttttagataagacaagtgtggcctcttggcttttaagatgtacagcttgcctcccaaattttagttcgtactattagtgtcatctaataatgcatgggacctattaacatttacagctttcatgtcaggctgtagaacggccacaacttcatctgagaatatcacccagcatacacatgttctccccagtggtgtttttcaatccagctgcttcgtacatgcgccacacaccatctacgattgttctgttccatgccaatttttgaaaccccaaattcaagattcttgaccggtgcatgtccgtcccgttatgtttgttggcttcagcatctcacacgattcacaggtactcatctcagcatttaacaacaccctgattagtccttttctcttaagctgcaataaccgaggagcttacactaaaaccgagcaaattccatgctcacacagcacacacacgcacgtacgttaacatgcttaatcaaacgctttttcatcttgtctcatgcgttttgaagctaccgttgtagtggtatccttgtcctcttcgaacgatcagaacatgggcgtagtgctgggacacacgagagcacaagcacatggaacaaagaactaattgcgatgttaattaatttaagaaatgctgttgtgttgtcattgtcctgatgatatgggtcttggttggtgctattttcatattttatggagtacctgttgagcccttattttgcagaaataaacaggatgaacacgtgtccaaccatctcgaaagaaacaaaatgaaatcaaagtaaattgttttgtaccggaatagaagttgtggattcctgctgcggcatcgtaaattggaaggaaatgcttgtaaatgtctttgtcagaatctatgagagcaaaggtctgctatactatttgttgccccagatccggtgcagttcctacttccaacaaatactccaagttaaacaaagagaagctaggtatgtaagcaaactataccacctgcacaaatacagttttgcatgaattaatttatcctatttcacagtatcgtacaagcacatgcattttttaacgaactaaca

SEQ ID NO: 64286 - DNA, 1425 bp, Oryza sativa
ccgaactagtcccgactgaaactagcccgtgacgctccaaattaacctgttatcgataccagtcccaggaaatagtgctggtatcacaggaagacagaatatccagcaacagaggtctctttattatagagtaggagtacagtcatgttgggctgtggacagatcccgagctcacaactgcattacaaaaggaaagcggaagccaggactagaccaaacaacacaggcgcgacttgggaactaggccgagaccctaaaactcatcgtagccggcttgctcctggaagaactcctcatcagcaggatccgcttcatcttcttcagcaactgggggggattatttatatagagcatgggtgagtacgggagtactcagcaagccatgggaaataagtgtttaatgcaggcttcaaggaaaggctgttgtttttgcaattgattttagttgaactcttttctaaaaacaactgagtgcttctcaaacgacatggatgagacagtgcgtctcgtccggtcggagtatgtgcaatgtatcagtctttaaaatttaaaacaaggttggcacccggccaacagcttttcaaacggccacccgggcctacaactttcaaacggccacccgggcctagctgatcccatcagctgcagatttttcaaacatcgaaccctttccataacagcaatttcacaagcaatagtcaaacaaactacgctaggaataacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacgggg

SEQ ID NO: 64287 - DNA, 4100 bp, Oryza sativa
tttgcatacgtacacatggcagcagattcttcctcttatctgtattttttttctccatgaaaacatgtccagaatgcaagcattgccaactcagtactcactctaaatatgatagtatctcattgtctatacataacacatactcctaatgttataactgagtaatattaataattgtgcagcacatctcaaccacgaataatgaaataattctctcactgcatgccgatgatttcgctcgagatcaactacatctatatttcactagagatatgatatacggatggtaaatatataataatatcccatgtccaacaatcacttaagccaagatttggttaagtgacttgttgacatacatgtcacttatgtgatcaacaaaatagtctggttatcagcagcatcaatcacatacaaagtaatgcaatagagcgaacaagagttatgacagtggaaataaataagcatatacatcatttagagagatggtgtatcacatcataagaagcaaaatttattgaagaagggaaagagggaggaggggagggggggggatggggattaacaacatttatctttaccagaaagatagctacatacctccctttcacttctagttttcatctagggcgaatatgtttcatctcaaaacacatatgcacacttaataacttttctgaaactaattaagcagtatatatgtagactccaacttcaacaaaacatcagctgaacagcattgagtaccaacttaaacagactgcatagtctcaagcatgaacttaaaaagtaaaaacacataaatagctctcaagccttacttgcaatggccaagggggcacccacataccaacactttattcttgtctcacctgagtcgcttcctttgattagatactgcaatggccaccaccatccttgacattgtccgttacattgacagactctctgctaccctcctcgaaagaaggggaaattgtctagctattaggcaagcatgcattgccaatggcaggaacaatgaggaccacttcccttccattaccaatggatgaggcatgatggaatgcagcaaacactgcctcttcttgtagatcggacagatcacccaataattattagtttcaaccatcatttttctgcaaaacagtctgttagttgatgctgcttaaggtgcaaccatggtatatataacatatacaacacagggagagatagatgaagtgcaatagtagtcaagaaatagttccaggccagtttaatgcttatgacctagtgactgagttagatggatttggtatggtctgtatgtccaattatcttcctgatatgggcaagggagtatcgtcccctagtcggtttgaccaataaattatagagataacctttcatgaaaaaggtagtgaccaggatcaaactatgattcaaacatcccttcccgagactaaggggagtttcactaataaaatcgcatgccgacaacatacccctgtttgcatctcgacaaatatcttatacatcacataaatgttagatcaccaagcatcccggttataaggggataaccacacatggtgcttaacaatgagtttcacggatataaatgcacaccaacaacatacccctttccatattgacattctcgaatatattataggtcccataactattagatctccaaacatcttgggaataaggggataatcacatgtggtgttcaataaagagtttccatgataaaaacgcaagccgaccacccaccctttctgcatttcgacaaatgcaaatctcttatagatgtcacaacagttagatcacttcgcgacaatactaatgagatccttcattgtaattagatctcagtaaaacacatggaatcactatcagaataagccaaatcacctcaagattctaccacctctagatccaacgtctaagattctatccgaattgcatgccatcaatcaatcatgcaagccatactagtggaacatgacaatggaagcatatactaatactcttcttataattataagataataattcatcatatttcttatcctcaagttgaacctacaaacctatgattgcttaaataatatgaacatattcaatatgcaaatcaaatcaatattatccaataaaacaacaatatggtgttaggatgcagtgtctcatgttggcaatggtcactctagtgcagccaaaaggttgttctgtgccatcactggtggcaaaccgcatcacaaagcaaggcaagaggtaggaaccagctagttggaactcttgcattgcccattccatgctctcggcaaatgaagacttcctgtagtggaacaccagggtgtgcttcatacccactatcactttatcagagccatcaccgaattcttgtataccagtgcctctgtgcttgctaacctccaaaacccaacgccggcggcatggttcctacagttgtcgccatggtgctttttctccttacgggtgaagaagtgcttcccgttcttcttctcctgccgtgctccatcaccaaacccaacataaggaaaatatgacacacacagaattagacaagaaattaaccgtcaaaacacctaatatatcataggtgaggctatagattgatgaaattaaaccaaagattgcaaagatttggcttaataatttcaatgggacaacaaaggcaacacaagtcaaaatatattcacttgggacaatgtccaagggattatggtgaaggatgtcgatgtcagtgatgaagtcatagggcagagacatctgaatggcgcattggtaaaggtagttgatgacaagctcaccgtagtgggttggaacacacacctagtgggatggtgaatactcgtactgctcacttagttgatgcatacctgaggaccggccattgtcctagctcgcaagctacaaacagatttcactcgctcgctcactctagtgagcggaagccctgtggtgatggagatggaggatgagaggagctgcatttataaaaccaagctatagagggggtgtcgccaactcactagttaattgcatctgtatgggccgctatgagtaccgtgaaggagatatattcaatttcattccctttctctgcatgctaaacaccctccgagctgcagatggcgagctagaattcagggatttgcatctcttggatggatgtagtaatacagaaaatccaaaagaggaataactagaaagatgtggtttgtgatgaagggatggggattccagtgtctgttttgttccgattttttcttcttttccattccttgggagaacatacaattggtgagagttccaatctctctcgcttctggtttggtgtgctgttggggagatgataacaaagtggagttctgcacaatactgctgactaggaaaactgtgggtgcctattaaggctggaattaaaggcgctggctggtaaaccttgtttgcaagcatattaatttttgtccttatttggatggttagtagagctttttggggcttgttaattttctggtttaaagatatggagcttatgttggaaaatgttagtttacataccataggagccgggccacacaaagtctaagttgatgttacgcatgtttttgtttgcatcgttttaatctttgaatacattttatttccaaatgactagttatacatgtatgttgagctccaattccatcacaaggtgatagcaagtaacaaatttaatttttgcgaacatgggatccatgagaacttcccctttgatatgtggttaactattttatactcaatagatattaattaaatatcgcttctactatttagtgctctcctcccttgtacagttatgctactcgtgcagctataaatagagatgtataaaaagttagaaaactgctcaagtatgtcactctcttctgttcctcttgaacccatattgaccactgactccctcttattccttgttccttgtgttggccatgttgatgagctactaggccatactactgttgtctcctcgacggcacacctatgtctctccatgagtctcacttctacagatttgggcatcaatgacgtgccatctgtcaaca

SEQ ID NO: 64288 - DNA, 2006 bp, Oryza sativa
atcctttataggtttaaccgcggtttctttgtcttcgtttgttgttgattgcaggatcaaatcaagtggcacgcttgcatacccgaaggcgagttttggacctgcactggagtttttcatcaacacgcttttggcacgcttggtgggacccattagaagtcagaatcacaacagcagtttttctccatggccgagaaaccaccagcatcgccgtcctcggctggtcctggctatgttaaagaaaagatctagaagctgggcttatccgaggttgatgaagccaacattgtgcccgtcactctagacaagttgacacctgagcagcaaaaagaccttgatacaatgatgcagtaagcacggaatcagttcttgagctcattcacggagacccgcaaggtgacattggttcagaagtacaaagtgaaggtagttgctgattcaggagcttgatggaaaagaaagagttgtattctacttaagtcgttgactcatggatgcaaaaactagatattctcctgtggagaagttgtgcttgtgcttgtatttttcatgtacaaggttaaggcattatctattgtccaacgaatgtattgtcatatgcaaagccgatgttgttaagtacatgttatcggctccaattttgaaaggaaggattggaaagtggatattttccttaactgagtttgatcttcggtatgagtcaccgaaggctgtcaaagggcaggctatagccgattttattgttgaacatcgtgatgattcaatcggctcggttgagattgtgtcatggactttattctttgatgggtcagtgtacactcatggttgtggcatcggcttggttattatttcccctcggggggcaagttttgagtttgcttatactatcaaaccttatgcaaccaataatcaagctgagtatgaggtagttctcaaagggttgcagttgctcatggaagtagaagccgatgctattgaaattgtgggggattctttgctagtaatcagtcaattggcaggagaatatgagtacaagaatgatacattgatggtttataatgagaagtgccaagaactaatgaagaatctttggctagttactttgaagcatgtatctcgagaacaaaacattgaagctaatgatttggcccaaggggcatcggggtataagctgatgatcaaagatgttaaggttgaagtcgctgcaataacaaccgatgattggagatatgatgtgcatcaatatttacagaatccatctcaaccggcttctcggaaattacgatataaagcgttgaagtatactttattggatgatgaactctattatcggacgattgatgcggtgttgcttaagtgtttcagtgccaattaggctaaggttgcaatcggcgaagttcatgaaggaatttgtggtactcgtcaatcagctcataaaatgaagtggttgctgcggcgtgtaggatatttttggccgacaatgctagaggattgtttcaagtattacaaagggtgtcaaggttgtcagaaatttggagcaattcagagggcaccggcgtcggctatgaatcctatcattaaaccatggccatttagaggttggggaattgatatgatcggcatgattaatccaccctcaagtaaaggacataagtttatattggtggcaaccgattattttaccaagtgggtagaggcgactcctttgaagaaagtcgattctggggatgctatacagtttgttcaagagcatataatttatcgatttggtattcctcaaaccattacaaccgatcaaggttcaattttcgtgtccgatgagtttgttcagtttgccgatagcatgggtattaaattgttgaactcttcaccatattatgcacaagctaatgggcaggccgaagcatctaacaagagcttgatcaaattgattaagagaaagatttttgattatcctcggcaatggcatactagattagccgaagcattgtggtcttatcggatgg

SEQ ID NO: 64289 - DNA, 1850 bp, Oryza sativa
agagagtagagagagagagaaggcgtgatgaagaagatgagatgggggaattacgtgtgtatcacatttttgttttatttatttatgagtgaactgcactttgtactagctgacttacgtttgttgcactttgaaccaccgactcatttctctagccatgcctatcctttactccagaaaatgtatggcctgctcataggtggacgatttcgctagcgtgctggagccaacatccttgagatcgttgatgcactaaagaagtggttacgtcggccgagggcatggctcatcacggtggagggacttgggggagagcggaagaggcgaggtggtgtgaggaagagggttttctccatgagaggggatgtgagggaggggagcaacttcgtttccagcctagagttggcttcgggcagcggaaccgtggaagattccggccgctgttcggccacaagccgccattcggccacaagctgagagaggctggcggtagagcaaggagagatggcctcaccagtagaactgggcgctacttcggcgctcctgttccccgcggtagcaaccagcaagtgggtgggaacatgttcaagcgtcgctgggatgagccggcactgatgaaggagggtggcagcagcagggggatcggtgagatgacgcagacgaaggaggaggcaaaaggtggaggagaaagcaagaaaccgggtcagatcaaggtaggagatgtggttttcccggtaaattcagaagtgaagaaaggaaagaattgtgtctctgagtttgatgatgacgacgatgatttgttggagtttgatgaggagccgcgagtgattagggacaagaaaggggatgatcaaaagggtggtgcacgggtgaaagtttgctctaggtgcactcaaaagggacatggtgttgctgattgtaaggtggatgtatattgtgatatctgcgactgtagcgtgcatgtctaccacaaatgtccagtcctaaagcttccaaagccggtggtgcagggcggttggctatgcggttgaaggcctaggttttcagcacatcccacatcaaccgcttcaaaggaacaagaagactacgaagaaggctcttgtgcatgtggttggtggtgctctttcggtggaaaggttggtcactcttctccacaagttgtgtccaactaaatggaagtgggagccagtgccacacgggaaggacacttttgttgttcttttcccttcaaagggcgaattgcaatgggccatcaactttgggggtgcagatgtgaaggaaggaggggtagccacgggagtgagggcggagtttgaagagtggtttgaggaagaagagggttttcttctacctaaggtatgcgttaagttttttgggctgaggaagaaactaagggaatatttaactttatgggcagtaggctctcttttaggggcaacacaattggttgatataaaaactactagaaagaatgtttttggagattgtttgtggctgtccttatcccaaaattgatacttaaggtgcttgatgtggtaattgaggatcgttgttttgagttaaaatttgaggtggagaaaaaaggagtcgatgagaatggggaagaagtagagtttaatttggaggattgggatggagatgaggaggatggtaatgtagagtgagagaaaagtggagaagacaatgagggaagggagaagggaccaaaaatgtcaaaggttgatgatatggtatttgatgacaattatgataggagtgaagggagtaaagaggcacaggaggttctgatttagagaaagaaatggatttttctataatggctgaaaatatcttggatgtggctgtctaag

SEQ ID NO: 64290 - DNA, 6035 bp, Oryza sativa
gggtatagaatagttattttataccccgggtgtagagctctaactcctaaatataactccaggagttgagtctggagtggagttgtggatctgcataaacctagctccacaactccagtacattttgtgagagagctccacccaactccactcccagttttggtggagctgaaactgtttggctgagctccagctccagaagggatggagctggagctagagctgtgccaaacaggccctatgttgaaaaaaaagtccataaaaattaagtgaaattctagactgatccgactatatatatatatagtcgactatatatatatatatagtaggtctaacgtctccgtactatttggtatttggttttggagtggccatagttaggacgttgggattggctcattttggtcatgagaccaccacggacgggagcacgcagtcgacagacatatgctgaatcggaaatgcctggacgaataattggagttgcatgtaatgttgtggcgtagttgtacaaatctcgagaccgtgttttcgttagtcattttgattgaattgatctctagtttgatgagcaatgacaacagaaatttaaatgatgcatggttcttgtgggggacatggacatacgtatgtatcattataatccaaatcgagaacgggatgaactatgacaccctgatttttgttttagtgatttataaattatttatagaatttatactaaagtttaactaatttattagtgaagtaattgtgggaaataaaatttcccaaataaaatatgtgggaaaaaaaacatgcgggatggggcatgcgggagggggtatagaatagtcttaccctatataatagaatagggcaagagctcacgaaagggtttactgtagtttcaccacgatattactggcaaatgtgcaggacacctaaaaaacataactttgcctaaggacactctaaaaatgtggtaatttattgtagggcactggacacactaaaatataatatccatctaaggatgagagagaaaccatataaaataacatttttacccatatcttcttctcctttttccggtcttcttccgacgctcctctcacttgtgccccctgctgtgattgtaaaggaaaccatgggacgtgtgcatcaacaccgcatcgcgtgtgagcgcgagcgcgtaggcgtgggtgatatgcacgtcccatgggttcttgtaccgtcgcagtagggggatgcgtgagaggagcattgagagaaaccagagagaagagagaagaagataagggtaaaactgtcattttatgttatctctctcatcaatggggtggatattatattttaatgtgtttaatgttctgcagtaaattaccacactttcagagtgtctccggaaaattcacctctttccgatgtcccataatttttcggagcatcctttaacaaaatttgccatttagattggatatttgaggaacgtagattgaacttggtttccatcagggaactgctcgttcggctcggtggcccataagcccattggcccaaatacctccccctctccccgtgagagggatccctcttctttccccttcccgtcttcgtctccgtcgacggcgacgtgcgtaagacgccgcgccaccgcactccggttcgtgccgcggccgcgcccacgcttcccatcggagccccggccccctccgctcctccggctcctttcccccgatcgaccgccgacccacaagaggagtccgtgccgtgggtgttctggcgcggtgtatctcggtgccggaggaggccttgaagctccggcgtgagagagagagagagagagagagagagagagagagagagagagagagagagagagagggagggaagggaaacccggacgcggcccggcctcgccgccagtcgtggcgggagcggtatcctatcctatccccccttcccctcctctccgtaaaaagcttttaaaaccccaggcggcggtcatcatgcctcgccgcaagaagcatccccggtttcgtggcacccttggaacctacaagtttcgacaggctcttcttggcgaccccgcgaggcacaatcggttcagcgtactcgaagcagaagccaccgacgacgattcgtcgacggagccaagctccaggatgcaagacattgaggacagctgcggcaaccgatcaactcaggacaattcacggagagagctggtgacggtttgtcattacttctctctcttctctgcatcctcatcttgtacttataagattataatttgtctgaatttttcccagctaaccacacgcaaccctctagttctaattgtgaccacgtaattgctggatttctctttcaaatcaagaagctcacgtgtgtgtgcagccgcgtttcactggacttgatgtccaataatgggcggctgatcattacgacaaatcacttgctcatacctacttgattaggcctaattgactgtttgatgtcgaaaaagaaaaagctattaccatttgcaattggttagatcaaccattacaagacaggccaccctgccatcatgccatcagtctttagcattctgtcttttctctgccctaatctagcaaaaagtatattggttgacttagatgttgttttcgtttcggaaattggaactgcagtggtaagtttaaatccaaatacatttgcttgatcgccaagatcataatctatgtaactttatttgttttacatagaagccacatcagcaaagaagggttaaagtaacagggtattgtgattgtaatactagtgatacatatgctaatggatcatttgctttgtgcctgctaatttgattggagacataattccggacaatatgtgcttacatttggaattggattgttttgtgtctgtgtgtgtgtgttgggggggggggggggggcatgtgcttagatgagaaaaaacggtggtaaaaattatggatggggtcatattgtgtgattttagtgaattgctggcttgtgataatgtttttttttcttttccttaatgacaaagttctctacttcttttggtggtatatcatcaaatttagtataatgaaataatgaatattaaataacataaatgctttcaattgccacagatggaggatgtagggaatatgaaccctttgttgaggacattgctcgagatggtcagcgaggaacaaatttctgagattccgcgtcatggcctagaaaaccttcttttggtagctatctataccacagtgaaatttaacatattgatgatgcttatgctttctttattaccacatgtatgctctttcttgagatggaaacgtatgtccaatctttagaacatgtgatgctatttactccttttttagtctttaatctggcaaatatattttaactttcacattgacaatattatccatatatgacttccatctgtataattcttgtttagggtattggtgaaggaatgggtcttcatctcgttgaagagaataactttctctatggagctttcacttttgtcgtgacttgtccatggtacttgacattgatattattttttttcctttcaataaatggttttaagtttgctgaactttatgttgttgtgtcacaggattaaaaaagatacaaaattgctttcacgtatacttctccgtttgtcagaaatctggagccaacctgaatgggagacaaatctattggatttttttaacaatgctcagttcaggacgtctgtgtacaatgttgttgctttttttgagaatgagctcaccatgtgcacagcagaaaattatgatggaatcaatcatgagagaaaattaaactattcaactttgactactcttattccactgttatttcccctactcttggaggtaaaaaaaataacctaaatatcttttcacaaattgagatcctaaagatatactagaagaaataatcatttacaaaattgtttctttcagcttcttcagtatgtgcattcactctggacggatgaagttgcttctaacatatcagaagaacttgaaggagctaaatgtattatatgttctgagaagctatgtggtattgttgaagaaactactgaaattcaggacatgaatgaggaagagttgctggtagatgagataagggagtggctagaaaaaatccgccaaactgggtatgtttttctttcttggacaacatgcgggagaactgcatgccatttcattataagtaggagcaaagaaaacaaagcagcagacagggacaatgctatgcaaaacacacacacccaccacacacaacacccctacacttcttttctattacaagacaagaaaagctgcaatcacgaccatagtcatcatcattctcaggattcctatcatccgatgcaaacgaccattggagcaggttatgagtcctttagctgcagccatacaccactaagctcctttcctgaaccaccgagtttactgagggagcaacatcattgaaaacagtcacatctgtgcttccacaattcccatgcaacaagcgtgattggagaattcttgcccttcttgagatccctaggtaccttcttaactgtggcagaccaccaaccaggaaaacggtgtagccgcggagcccaaaaatccaagccgaggccattgagaatggtgtgccaaccctgccccgggcaaacacacaagagattaggatgagcttaattttctcgtcagtctgaccacataggaggcacgaggccgggttaggaagtccttgcttggcacctattaggaatagccaatcaaagaaaaaaattgccccgtagtggcaaccatgtcttccaaatacaacgccatggtgcaaaccttatagattccataaaaaaatgcctcgtaagcagacttgtatatgtgcttgttccaataagtttccaggtgtgctaatcttgctcttcttcttgtaactcaatatcacccatcaagtcccatagatgcaatactgaagtggacgacaaaccttctgccaagtgaccaaacaataatcctcacttgttttctcctatctcttccataagaagaccctcctcttatcaatatatttgatggcccatttaaggaggtcctgtgagcactacacgaaccatgatgtggcggccaacttgatgagagaagcttcccatcctagaagatgatcaaccatcttatcaatcaaggggaggagctcggccttggtaggcttttggatagagatattcagggatgagatgggaagctaaatcctcctcctaacattggataggtcataggtgtaattgagctcttagagatatttgtttgactccaaaagcatctccaaagacctctagaacaaccctaattaaagaaactatcttgcgctttgttttgggatatgtggatgaatgcatgttatacattatagaaatgatagatgtatatgtttaaagaatgtgaaaatgatatggagataatgatttgacattgcttgcatattgagttctaaaaatacaacaaaattgtaaatggcgtcatgtttgcatgattttaaaatactctagataataattgttagtgggtgatgatgtggcacacttgcatgttaagctttaggagttagtgagcataagtatatagatagtatagatatcataagactgttgcacccttcctgctttagttagcaccattcctccacttaaaactctagtccgatccatagtaccttagcaatgtattcacgaaatataatgtgaagcttcatctcatattctaacacacaataatttaaggatatcaagatgtggtggtaaggcgtaatatccctttccaatgcattttgtaagttatagcttcatttgaacattgtgttataatgttggttcgaggaaaactttgaaagttcaaagtaaagaaatactttgattgtctacgttatgttttttttgtaattttgtgttcacataaatgtttattttactttgtaggtacaatgttataggtatgtgtgcgagtcttgagggagcatttt

SEQ ID NO: 64291 - DNA, 4204 bp, Oryza sativa
caaaattgtacagtactaacggaggctaactggacggcgatagtaaatcgtagaagttaagcaaaagtcaacggcatattatagaacatgacaaagttgatggtaaattatagacgtgtaacaaagtcagtgatatataatatattttctcatgttatttatgtataaactttaagcgcccgtcattttgcagggtttctataaatattgtaaaatattttacatgttaaatataactatatcatttgcatccacaatttgaaaagttgttactggccaacagttatcaatgaaaaggaggaatggagggggaaattggtaagttaagcatttattaactctcttagttagtagtatttacttatttgttgatacttatcatctggccaccagtcactgcatccagcaatccagattccagcggatagctacgctcttctgagtccattttactttcccctttttctgtcgtcacgggcggccgacacaggcggacagaaagaacaagctggcgtacttcttccttccttggctctgtttcttttctcgccatagtcatgcatgcaggcagatgttgagctgctcatttatcatgatgtgtcacctcgagcggctgtgcagcgaacctcagcgtaggtgtgttgtggccgacggaggtgcttgttgcttgtgttccagaggcgacttcttcggatttgtccagttcaagaggtcagtcccgtctcatggtgagcgatgggctaatccggaggaggtaggggaagaaagggaggggatggcgtcgtggtggctgtctgcccaccagatctggtacatgtggaggttatcagctaccatcgtccttcccttccctaccatttcccatagtgagaagttggaccctgaatcggagaggcggtcggctcaagcaaacgagcacatggaagagcgcacaagagggtttccatctgaaccatctgctttggccggcgccgcgcgcctctcgcctcctccttaggcggcgcatgtctagtcggagcaggccgcgtagagcaagcctccatcacccctcatcacccaaagcagatgccggcagcatagatcaggacaaggcggcggcacggtgagtaagagatagaaattcatttttcttgcgatttgtttctctgggatttttcttcgataatctggactcctctagatggaagatagcatcacacgttttgtaaaaaacccctctaggaacttgcaatttacctttaggtccgccagattgtttttcaccgttgatatttcatctaacggctgtgaaaggtgttctccggccgagaatacgtggcgcgttctccggccgagaattccgacggagtgcaatgagtggtgacacgtggcccaattagaggcccgagattagaccttgaaatcggtttataagattggtgaaaggggatcaccttgatgcaatcctttttttttttgtctgaatatagtgcccagtttcatcattcatctttatcgccacgcttcctcccgacactatttgctctatccatttacaccatcgattcgcaaatcctttcgtcctcaaggtttgctgaaggaacctccagcctatcttatcatatgccttttcgaaacaagcttcagaatcaccccatccaactttttcctatgcatctcgtgcaaagtttcaagaagaataatagcaccttccattatattccttcctttcaaaaaggcggtctgtgaaggttttatgacattttgtgctactagactgaccctgtttgtcataacctttgtaaagactttaaaactcacattaagtaaacatattggtatgtactgttgaattttccttgcctccttatttttaggaagaagagtaataattccaaaattcaaactctcgagagaaagattgcccccatggaagtccctaaagactgccgttaagtcatctttaattacatcccagaatacttgataaaactttcccggaaaaccgtcaggtcctggagctttattgtgttccatttgaaaaatggcaattttgacttcttcagaaaattctcttgttaacatttcattttctgtcaccgtcacctgtggtatatcgtctttttggtcctcgaacatagaaaaattatttctttcgggggccccaaaaaggttcttatagaacttagttatatacttcctaagctcctcatctcctttgattacaccctcttctaggtcaagctgaaaaatcttagtttttctatgctttccatttgcaatcatatgataatatttagtattattgtctccttccataattttctttgttttagctctttggtaccatttaaattcttcttctctcaacaactttgctaaggcctgctttactgaattttttagctcatgttcctgactagtcaaaattctcatctcggctaatttatccagctcatttgcctttgctattagtttagctttttccttttttatatgcaccactaacattcttcgcccatcctcaaagtaattgaagcagtgttaacgaccaaatttggtaatattggtatcggagaagaagattagatcgaagcggaatcaaaaatgaggatcgtcgcggaaacagagtaagaatcggctggagttcggatcagctacgatcgggatcggctaagttcgagtcagactgggttaggtgatacagccgattcggacaatacgatttggtgtacgacatcgggttgagttgatatgcttcaagatggttgccacacatggctagagtcctgagaaggcaattgtatctattaattaggatattttatgtaatttccttagagatatgtttgggcaaaagtctgccgtaaagacttatggtttcttagtgtttgttagagataagagtcgtgtccgatatggacatagtttgtaattctcgggtataaatagacctcgaaccccatgtaattaaataaacacacgttcaatacaatctcggtgcatcgccactctttttactttcgttttatttcgacgagttcttgctttcgggttgagctgcatcggtttcgatcttcacaagaggtaaaacttgttatgacggcttgcgttctcgggattagtgcttccatctttatgatactcttatcttgtttacgtaattcgtcgagttatcatatatcttgcataatctctggcaatattgctatctaatctacaatcggctaacatctattggtagagggcagccgattaggttagatatcgatgttgacttagattatataaggtatccaccactctatgaaacttccaacggcttgattgtctagatattgtccttcttttcatacttatagctacattagttgagtttgatcttatgagtcgtgattagaatctcaatctctagcctgcttcttggttgccgattagggtagtatcggagtttcagccgatcttacctgatttaactatatttgttccatatgctttagtgatatgttaaatatgccctttatatcaagatctttttgcattcaagtatatttggcttttgtttgatatattttacttgctttaatatcttagtatagagtagtatcggagtattagccgatacatgctagatctatctgatctgctatgctatgaacttatatagtttcattgttagtatatacttcgatctaattgatttatactgtctcggcatggcgaccgatctatcccaatcacttgacttaagtatatatcgacatagaaattatatattgttaatatctacagccgatcgagtagatttagtcctttattatctatttataactgccgatcgatacgtacatgacatcggctcaaagataaatgatatgtcatcggcacctagccgattggctatcctttataggtttaaccgcggtttctttgtcttcgtttgttgttgattgcaggatcaaatcaagtggcacgcttgcatacccgaaggcgagttttggacctgcactggagtttttcatcaacacgcttttggcacgcttggtgggacccattagaagtcagaatcacaacagcagtttttctccatggccgagaaaccaccagcatcgccgtcctcggctggtcctggctatgttaaagacaagatctaggagctgggcttatccgaggttgatgaagccaacattgtgcccgtcactctagacaagttgacacctgagca

SEQ ID NO: 64292 - DNA, 17174 bp, Oryza sativa
ttaacatcaatatgaatgtgggaaatgctagaatgacttacattgtgaaacggaggaagtaccacaaaatctactctcttgtcatcaattatttctttttatacacctccttctatatcaacatatatatcattgtctatattctccaagtgttataaatagtaatattaataatcatgccgcaggtcaaacaaaaaaggcataatcaccatgaatgatttatcttgagattaactagatgaattgtttcactagataaatatgacacggatggtatctctataataatatcctatgtcgagcaatcaattcaatcatagatatgtggcaagtgccttgttgcatttgtgatcaccagatcaatagtgtggatatcaacagcatcaatcacatatagagcgctgctgcagagtgaacaagctatggaaattggaacataaaaagcatatagaatatagaggcttagtatatgacatgataaaaagcacagtatattgaagagcggcaattacctctaccataaaggtagttacctccctttcactttatcttgcatcttgggcgaatgtgtcttgtcctagaagctagaacactggtgcacttgactttcccaaaactaattcaacactctatagattccaacataaacagaaaaacatagactccagcttcaacatcatagagtaccaactcaattaaacataatgcatagtctcaagcacaaacataaaattaaattgcataaatagcttgcaggtctttcttgcgatgaggaagcatcccacctgcaatttttattctaaactaagccgagtttcttccttctattagttcttcccataaccatcactgcccttgtcctttgtgatgacattggcagactcatcactcccctcctcgaaacatctatgccctgggaagtcaatgaagtgacttgacgatcgcctgcattgccaatggcaggaacggcgaggacagcttcccttgcattgccaatggacggagggatgatgacctgcggtgcacgctgcctcttcttgtaaatgcgacatatcatccaagaattatcaggttcgaccatggtttccaccagaggggcatgagtatgggcagcagacggactgccattgtttttctgcaaaacagttcgcatatagtctattaaggtgcaaccgtggtatagatggcatctacaataaagagagacggatgaagtgtactagtagtaaaaaatagttgcatgccagttttgtgctactcatgtactgactgaattagaagaatttggtaacttctctatgtccaattttctactccctccgtttcaggtcataagatgttttgactttggtcaaaattaacttgctttaagtttgactaagtttgaaaaaaaaacattttcaacccaagacaaatttattatgaaaatatattcaattattgatttaatgaaactaatttggtattataaatattactatattttttaaaaacttagtcaaacttgtaatagtttgactttgaccaaagtcaaaacatcttataacttgaaatggagggagtacctaatatgggcaaaggagtgtcacccccattcgattcaccaataactgtagtgatgccacttttttaaggaaaagtagcgaccaggagtacaagatcaaatcatgatctaaacatcccttaccgagactaaggggacaagcatgcatagtgttcagcaaagaatttcattaataaaaacacaaactgacaacatagccctttttgcatcccgacaaatttgaacattcaatagaatccgtacttgttagatctccaaacgtctcaggactaaggggataaaaacacatggtgttcaataatgagtttcactaataaaaatgcaagccgacaacatacccttttttgcatctcgacaaattagaatctcttatggattctgtaagtgaaaccattagaccttgctgggtgacacatcctactagattgaattatatagaatcactatgcgaaaaattgaaatcaaccctagattccaccatctcatagatcactatataacaaaatttgaatcaccactagatcccacgcaccttgcatggcatcaatcaatcaacccaaacctattggcacccctcaatggcgacatgcacaaatactctatataattataagatagtaattcctcatgtttccctattccccaacttgaacctcacagtcctacggttttatacaaataatttaccaatcatattaaaaatacagaaacaaatctatatcatatccttttttttttgagggggaatctatatcatatccaatacaatgacatagtgatgtttggatgcagcgtctcaccttggtggtggttgtttcggtgcaaccacagggaggcatggagacatcaccggtggccggcctcatcacaaggcaaggcacaaggctggcaccggcaagtcggcatcacccatccggtgcgctctgtggatgaagacttcctaaagtggaacaccagggtgcgtttcatccccactagtttttcatcggcaccaccgctgggtttgttgtatattgggacctctgtgcctgccaatctccagaacccatcaccagcggcatggttgctttcatagtccctagggtggctgttctccttgcgggtgaagaagtgcttcccattcttcttctcccctgctgctccagcatcaccaacataacaatagaaaagttgacactcaaacataatcatacaagaaattaactgtcaaaatccctacaaacgatctagctgaggagatactactgattgatgaaactaatcaaagatgctgccaaagatttgggagtgacacagtgcgagtcaaaatatatttaccgggaacgatttcccaagggttgtggcactggatgtccacatcggtgatgaagtcgcaaggcagcggctcctgcatggcacggcggtacaggtagttgacaacaagctcaccctcggtggggcggaacacacacccaacggagaggtgcatcgtggtaccgttcagcaagttgatgcaaactccaggaccagccatcgtcctagcttgcaacctacaaacagatttcgctcgcacgctcgcttgctctcgctagactcactaaaacgaatgtaagattgaatggtcccgtggggatggagatggaggctgggaggagctgtatttatagaaccaagagggttgtttgccaactcaccatattgccacctgtatgggcaactgagagtgccgtgagggggactccacttcactgttttttgtctctctatcgccaggctgcagatgggtcagatagcatccagggtgttgcaaggcatgcatccatgcagtaacacacaaaatccaagaggaagaaggtaaagatggctggggttgatggaggaatgaggatcccaacgtcagttatatcttctgatttgttttttgtgtttttcaactggtgaggtggactactctatctccttcttggagtgttattatggacaatataacagtgatgagaagaacacaatagtgctgatctaggagaactgtgtgtgcctataaggatgatattaaatgtgtgtgaaccttgttggcaagccttttaatttgtggccttattgggatagttgatacagtttttttaggcttgttaatttgcagcattaaagattgggggtggggggggtggctgctggaaaatgtgagtttaaaatccagtccttgcctcactgaattcctaaatttttttttggtgctacatgagcgcaccatctatacgtaacataggtgtagtggcagctaaagtctatgtttatgttatacatgttttctttcaatcatcttattttcaaatacatcttattttccaaaaacagttagaaattttatgaagagctccaatttcatcataaagatagcaagaggtaatgaatttaattgtagtgaacaaaatatcttcctattgaattaaaaataaaattaattatttgccacccaaacatatgtgattaactgttttgaactcaacatatgttaattaattatttcttctactatttattgtcagaggtgatcagggtataccctccctcgtgcgagctattttatcaactttttgatccccaccgagaatgaaaataactaaccacaatcttaaatgttaaagcctatctctactccttaaatgtaactaattaacccccttctcccatgtaaaagatatcaagcgattggttcaaaaaattgttactttgatcccattccaaccattccgaattacaggacccataaaatagtgaataacccatactaatccattgcgaaccacaggaacctgactagtacctataaatagaggaatataataaaaagttagaagcccaaactgccaaaatctgccactctcttccattcctccctccgagcaccgctcctccttctcactagagcaaaatcattacgtagaggcacttttgtggagacagtttttattttgccacttaaaccaagagttctatagtataaagatactttttagaggcacttttagcatattttgttaaattaatgttgtagaggcatcttttctgcactttaatatttgcctcatatgtaaaggaattttgttatggcgttttaacctctgtagaggcactttttcaaattttgatttaatgcaagaatcgtcttgcacaatatgtactgaaattgttcgggagacatggtcaaagcccgggttgaagtaatgctaaaggagatttcttgaagccaacgtccagcataagtggcccctctctggtaaggtttgaaagttttcaaaacgtaaatcaaatgatctgaatcaaaatgcctcatcttgataaattgacttatttctcaaatgacatgaggtggagatggtaagtgtgttgaagatattctcaaaattcctctacaggattctagaggcattttaaaactgcctctagtgttagaaaaatgtctctacgaagtattttttgttgtggtgctccttattagtgcttcctctacaccatgctatgccaatggtgatgattgatggtgccagagatgtagtatcgtcgatgccatgccgatttccatatgttaagtaggtccttgttttccatggtggttgatcatcttggatagcaactgagaccaaggtatacagggggcatgatccaccttgttccactcacgaatgttaactagttgtgatcagaggcatcctaacgtcctgattgggattacccctgagttcgtcagcgatataaaaacaacaggagcccgccttgtggtcaagtgaagacctctccacttcccctaattccttgataaagcctaatatcatcgttccttagctaatgctggatgaggcttgtagtgcagttctagggcactgaaagtggcactcagagtgaaaccatcacccacttgtcgatcgctagcattgcctaggggatcaagcaagaaatctcatactcatgactcatatatctacatcgacaccaaaagaagcagagaaggagaaggaggtcgcatccatagatttaaacaatgttagtcagtttaatcttctctttcacattatattaaggtgatgatgttaggctaagcacatctttataacatgtaaaaccaatgagttgatttagattttgcggtgaaaattttggtggtttgctgatgttattttggagattttgtagacggttgattttgtgaagtgaaggtttttggttgaccctggcggtcagaccagccgggtgccgccggccagactgcaggtgttgcagcggtcagaccagccgacctgatggtctgaccggcaggattcttatcgtgttcggtttcgggttgtcttgttgtatttagatgtttcctttggggatttggcttctagatggtttctatgcgtatggatactgttgttatactaatgtgagtcaagtagggacgaacttgtgcttggaatatggtttcttcgttgttgcatgtgcaggtgttgcttgaggcctcgggagagtattgccggtgatagatcggagtcgacttaggagaagttgatgtccatggatcaagagatcatgcgggacactaaaaggctagagagcaatgcacgtggcgatgaagaatccatatggtatacaagagggattgtaatcgtatggaaagaggagtcgaatttggaagggagtccgaatttcggaaagattgattgagataaggaaagggataagttggatacttgcaagagaaggtttcctacatgggttaggcatcttaagttatgttagattcgtgggctttgcacagtctaactcatgtataaatagagagggagggtgaggcctcccggtattggttttagagagactcgagttgagagaaagttaaggtttcgagtttagttcgagattttggtgaggggtgctgttggtgcactttgtaaacactagttgatgcaataaagtcgaaagtttcaatgtacatcttcgagtatgtcatctaccggtgtttctaggtcttgatggtctaaccacagatgtacgcgttctaaccgatagcggtgttctaaccgcaggtgattgggtggtctgaccggcgaggcttcggtggtctgattgatggcaggagggcggttcgactagcggcgacaggtctttgtcatctactccatttgaggtaaatcttttatcccgcaaaagattttgggtttttggttttctctaccattcacccccctccagtaggtttgtttggtcttgtgcaatcctacataacattgattataaactcacattcctcccctgtagccaccatagtatgagggaagtcagcaaaggtggctgatttgagtgcatgagatgtagaatgagagggcttgggaacagtggctgacatgagttcatctgtgtgcgggacagcgcacaaacatggtcctcctcccttcccattgagggccacactggtagtttcgtccatccacttttatcctttttctccatgtaaaagatcgacgccattcaagaagtagttcaaaactgtggcctacgcatacacaaaaaatatgctaggcctaggcatacaaaaaattaacttttgttatcaattattttttgtatccatctccatatatatcgtcatctcattctctacatgtaacccatactccgagtgtaatcagtaatattaataatacagcagcagctcagacacaaaagatgtaataatcctctcaccgcgaatgatttgcccaagattaactatatctattatatcactacatgtgattcagacggtaactctgtaataacatcccatgtccaacaatcaattcgagcccaaacatgtgctatgtgacttgtcgacacacgtataccacacgcatatgtgaatcgatcacatgcagcagagtgaacaagctatgcccatggaagaaaaaaacacaaaagcacaatatattgaagaagggcagttacaacagttacctctaccaggtaactacctcccattgatcttgaatctggggcgaatgcgtctcatcctagaagctagaacataggcacactttactttccccaaactaattaaatgatatattgtctacaacttaaacagaaaaacatagactccagtttgaacagcatagagtactccgacttaattaaatagaatacatagtatcaagcatgaacttcaaattaaaacacataaacaggtcataggtctttctcgcaccgaggaaacactccgcttgcaatttttactggacacagctgagtggcttcctttatttagttcatgccatggccataaccatccttgtcatccgtgatgacatcggcagacacatcactcccttcctcgaaagatggctgccccaggaagtcaatggcaggaagggcgagggcgacttcccttgtattgccaattgtaggaagggcgaggatgagttcccttgcatcgccaatggatggagggatgatgaactgtggtgttcgttgcctcttcttgtagatgcgacatatccgcaaagaactatcaggttcgaccatggttttctcaagtgggccatgagtttgtccagctgatggacttccattgttttcctgcaaaacggtcgacatataatatgttactagatgctgcttaaggaggaaccatggtatatatagcatgtacaacaaagagagatagatgaaatctattaatagcaaagacatagttgtattccagatttgtgctaatcatctagtgactgaattagaaggaattggtatcttctatgtccaattttcttccatatatgggcaaaggagtgtcatcaatctaccatccggtttcaccaataaactgtagagatgtcactttccatgaaaaggtacagaccaggatcaaaacatgatctgaacatcccttcccgacactaaggggataatgatcatgcatggagctcaacaaagagtttcacttataaaagcgcaagccggctgcatacctctttttgcatctcgataaagtcaagtatcttattgatcccataactgttatgtctctaaacaacccgggacaaaggggatagccacttgtggtgttaaaaaaagagtttcactaatgaaaacacacggcgacgacataacacttctcgcgtcttgacaaaattgaatatcttatagatcccatgacagttagatctctacacatcctgggactactaggataaccacgtaatgtttaataaagagtttcactgataaaagtgcaagccgacaacgtacccctttctgcacatcggcaaaattgaatctcttattggtcctttaattattagatcttgattcatggaaaaatcttatttattgtaattagatcttactgaaatatatagaatcgctatccaaaaagtcaaatcaccttttggttccagcacctgtaggtctgacatcataacaaaatttgaatcaccactagctaggtccatcctagaccttgttgcaccatcaacgtcaacatagaaaaatattgttcttataattataagtttgtaattcatcatgtccatattccccaagttgaatgacacagttctatgcttgcatgtaaatacttaaccaattagattataaaagtagatcgattctatgttatatccaatatataggcacggtgatgttcggatgtgtagtgtcttaccgtggcgatggtcgttcctgtgcggtggcagggaagcatggagccatcaccggtggctggcctcgtcacagggcaaggtataagggtagcaccagcaagtcggaactcctgcatcacccattcggtgcgctttgccggtacgtaagaaatgtccgcgtaggtgggacatacccataggctgacggctttcattccgccacgcaggtgtcttcaatcgagcgtccactcactagcgtttgctgatattatcggctacctctggagcctactggacctccagaaacccatcaccagcagcacggttgctgtggtggttgccaaggcgttcgttctcctcatggatgaagaagtacttcccatttgtcttctcctccgctgctccatcatcatcaacccagcagacaataaattaactatcaaaacaactgcaaactatctattgaggttatactacagattgatcaaattaactgaagaagctggcaaagttttggattaatatatctaatgggagtaagcctgtgtgggtcaaaaaaatatttaccagggacgatgtcccaggggttgtgctggagaatgtcgacgttggtgatgaagtcacagggcaccggttcctgaatggcgcgacggtgcaggtagtggactactagatcagcattggtggggaggcgcgtcgatgtaccattcaccaagttgatgcaaactccagggctggccattctcctcaatcgtagaatacaaatatattccgctcactctcaactctcaaatgaattaaagattgaatgatgctattgtgatgaaggtggagggagggaggagctcttatttatttacccaagaggggtgtttccaactcatgattattgccacctgtatgtgcaactgtgaatgttgtgacagagactcaactctacgatcacttcctctttctctatctccaggctgcagatggtgagatagcatccagggtgttgcaacacatgaatccatgcagtaacacacaaagtccaaaaagaggaagaaataaagatggccagggttgatgagggggtgagaatcccaatgtcagttatatattctgttgttttgtgcttttcaattccttttgagaagctctctctctctcgctttcttttttgtgtttatttgggagaagataacagcaatgagatgagcacaatagtgctgactaggaaaactatgggcgcctactaaggctgggattaaaagtgtgtgaaccttgttggcaactggcaagcttttttttattttggccttattaagtttctagaataaagatagggggtgcaggaaaatgtgagttcaaaagctagactatgcctttctgtattcccaattttattttgagctatatgagagcaccatctacgtaaagttggagccggccgctgcaaggctaaggctaagtttatgcatatattctttgaaccatcaaaattttcaaatagatctttccaaattaccagtaatgcatgtatgatgagttctaaatccatcacaaagatgacagaaagtaacaaaattaattgttgtgaataatgagtggaccatatctctgcgtggattaactataaaattaattatttgccacccaaagatatgcagttaactatttgatacttacttaattgttgcttctacaatttatttattgccatcggcgctcagggcagtgatccgtatactagtgacaccgttttagcacttgtccccccatgtgattgaaaataaccatccacaattttaaataatcaagcctataactgtaattatctttttagaaaacgcatgagagttgcacttcatttcactaagaaggaaaaatacatatacatatatatacctataaactgaggagtataaaaacttatagaagccctaactgactagatctgtcactctcctccatcctttttaacctttaatcgagcaccacctccttgctctccctccttcccggtgcttcctccacagcatgctgtggccatcgcgaagatcgatggggccagggttgctgtctccttgatgccatgcctatgttatgtaggatattgtttttcttgttggttgatcctcttgattaacaaccaagaccaagtcacaaggggcgcattgtccatccttttctgtcatgcttgttggttcaccatgatcgggagcagcataatgtcctgattgggatcacccccaagtctatgagtgcaataaaataaggagagctcagcctgtggacaggcgaagaactctccacttcctcaaactccttcataaaccataccaccactgatcctaagcaaatgctagagaggacccatagtgtggttctagggcagtgcgagtggcacctatggcatcatccgctcgtttatcgccagtttcacctatggtatcaagtaggtatactcacattcaggacatgcacatctacaacggcaccaaaagaagcagagaaggagacggcggcatccatgtcctcaaacaatgtatgttagtttattcatcttttccattgttccacattatattaaggagatgcgtggtggtgagcctagtagggcgttgactgtaaagtatgcctaggtggcagagggaagcggatgtgagtgcatgcactggatagtgtgaccttgggtttcaagcagtagccgccaggtaccaacaattgcagtgctccagaccatgtgtgtggtggcagggtgctaggcaacatggtttgtgcaccgtgaagcggctagtggaagccggtggtctagtgacgtcaagatccaactgcgcatgtaggcacccctaaggccctacctctccttcaaaagtgcatgtgtgcagcttcatcaaattgatcaaccagctttgccggcacctctcctcctagtggggctgtcataaatgtgtcgcatccttactcagcctggctggtgccgctatcaccgcctctccaaacctcacctagtgcccgacgaacatccatctttccctcgtctagggttggtcactgctgtgctgttcacctagatcagcggccaactccatcttcaaccaagccatcatcaacctttccaagcatttaacctctgctaccaccactagctgcaccaagccaccaaccattgggttcagagcagttttaccgtactccaacttacaattggtctagcacttggttattgtatacattttccaataaaaaaatatttgctcctttcaattgatatatcacaacagaataaggaaatattagcacctattatttacccttcccaaccttaatcatgcacgcaggaaattaaggactataactttggtagcctatctatattgatatgaagatctggatgcccattaatgcttaaatttaatgtgtgaaatcacacgtaaatatatttcaaacagcagcacatcgcaaacttttcactctatatttaaattaagagttgcacattagtttttcgcaatgtctatatatttttgtattctcatatcagatttgaaattttgcattttccatttgatcgtgattgaaatgccattaaaaatttgcattcagggtaaacatataattaccatggtgtatttgtaaattagtacagcataaatatttaatatcattttataaattactccacttaccttattaattgtgttcctaataatgaatattatccctgtccttattacttttggaatgtaagagactgtgtccacagttggaccttagtctaatgtacggtcagagaaaaacttggagcaccttaagaagtgacggtactagtacactaacttacctctaaatttagggacttaacgctgaagctatgccacaaaattcacacttgtcattaatttttattattattcgttcatctatattgatatatcattcaaattcggtataacacataggtgttccaacttaatatatattactcctaattcacataggccacaaaatatatagaaaatgctctcactgcgactaatttgcacagcatgaatcaatgcttgcttcactataaataaatacatgatatggatgacaactctgttacctcccatgtccaactatcacctcaagcccagatacgtggtaagtgaatttgtttccgaacacttggtaagtgaattctggacatgcatttcacaatgagcaattttacggtccttaaggaggtaccatgaggtaccactttttctattgtaaatttggtacctcttggtacatagatactatgaggtaccatgagataccaaattttacactaaatttttggtatctcatggtacctcctcaaggaccgtagaattgatttttcacaatctgatcattattaatgtgtgtgtttatgaacaacacatatcaagtaacatgtagtacagagcaatgcagctcactcgatgcaacatagtgaataaagtatggcaacggaaatggatatatagaatatagatagctggctagaatgacattatgaaataggacaatatatatatattgaagaaaggaagatgcaacaatttccagaaatgtagctacctctctagaacttcttgcatcttggacgactttgttcatcctagaacccaaacacgcttggctttcttgaaactaattaaacaggacagatacacttcaaacttttattaaaaacagcataatctccagatcgaatagcttagagtactccaacttaaagacaacacacatagttctccaacttgaacataaaagcacatatataggatgcatgcaggtcttccatggaatggagcgccatacttgcagtttttattcttgagactcagttcacttccttcacactcgatcaatttgcttcattcatgccatcaccatccttatcttcaccatcaccggcagactcatcactcccttcctccaaagaggaggggtcaatggtgcagctatggggcgaggatggatcattgcgagctggctgccccaggaagtcaatgaagtgaagttggccttcccttgcatcgccaatagcatgagggatgatagcttcccctacatcgccaatgacaggagggataacaacaggcggggcacgctgcctcttcttgtagatgcagcagatcacccatgagctatcgggttctaccatgattctcataagaggggcagaatcacgcttggcacgaagagttgcagagagaccatcacttttctgtaaaatagacaccattttgtctgttagtggatctacttaaggtgcaaccatggtatatacaacatatacaacaaagagaatagatgaattgaccattatagtaaactagtttataagcctcttactgtgacaaatcatatggggactgaattagaaagatgtgtgataacttcatgtccagtttgaatgttgcaactaatttgagaagtaaactgttgacatgtcacttatataaatcttgtggcaatgatcaaattaaaaccagatgtacaaatccaaatatcccagtatcaagtgtatcatgacacgtggtgttcaataaagaggttccctactgaaaatgcaagtagacagcaaacccctttttttctcaatatatttgaatcactagtagatcttgtaaccgctagatctcgcttcacggcaaaatcaattaatcatcattacatcctagtaatacataaggaaaaccatgtgaggctatgacaaattcaaatcagcaggcccaccacctctagattccttgtcacgacaaaatttgaatcacttctagatcccgcgcatcttgcatggcaacaataaatgaaccctatatcaagcgtcacgtacccttagtcctaagatcgaaaacaactacccttcccttatttaataaatcaacacaagagttatagtatatcatcacgtatactaagtcatcatattttccccattccctaaagctaaaactcataatccaacctatccaaataattgagcaatttaattcaacaggcatttagatggaatcatgataaatggaacagtaaaatttttggacgtagcatctcaccttagcgattgtcgcttcaaggcagccacagggtggctctgaaccattgctggttgcatgcctcatcatagggtgaggaaggagaccagcaccagcaagctgaaactcatgcatggcccattcagtgcgctctgcagatcgtgactttccgtagtggaacactagagtccgcctcatcccaactagcatgtcgttagcagcaccttctggtttgtaatagatgggcacctccgagcctgctgctctccagaagccattaccagcaacacggttgctacggcggctaccagggtacttgacctcctttcttgtgaagaagtgcttccctttctccctctccgccacttcatcatcagatcgttgccaacgaacaaacgaaaaaaatgataaacaaaacaagagaataaatatcgtcaggacacacatgcaattaatcagtcaaatcagagatatatgcagacggatgtggtaataattttcatagaagcaaagaagtgcatatcaaaattaacctgggacgatgtcccaggggttgtgatgatggatgtcaacatcggtgatgatcgcacagggcagtggcacatgaaaagcacgggggtagaggtatttgatgactagctcatcgtcagttggacggaaccggaaaccagggaggaggtggattgtggcaccattcaccatggggatgctaagtccggtgttagccatcaccctagctcacaaactacacaacacagagatcgctcgctcactcgctcaagattcaccctagacactctagagaacgaaagctcaaaggcactgcagtgatgttgatggaggcaaagagggacaatatttatagagcccaggggacacccctttatcagatggatgggcaactgtgagtgacgtgacggagattcaacctcactttctccctttgcaagtttctggccctcacacactccctctatctccaagatatggctggtgagatagcattgaggtttgtgttgatgggatgagaatcccaatgccatgttttgttcagttctgtgcttttccattcttggaagctcatacaaccggttaatttcactctacctcacttcctatttggtcttttatgggggctagagataactatgaccagatgtgaacaaccatgctgactaggaaaactgtggatgcttattgaggctgaaattaaaggtgtgtgaatgttgcttgcaagcatgtttatttgtgtccttatttggattgttagatagctttttggggtttgtttcctagtaaaaagatagggggcttgtgttggagaatatgagtttaattggggtgggaccacaaggtttgtgttgtgaagaatcctaacatggaggggtagacatgaaaaaaaaaggaattttccttctaatttttgcattgttgtccctaaattaaagtttatctatttaatgttttttgggtattaagataataatatttcgtaatattgatagaaaatttgcaacagtttgtcctagtctctttttttattcttaccattttcattagtaatattttattttgttattattcttaccttgcactaattgtcatatatagttattgttgaaaatttgtattgggtaaaaaaggctacagacatattatacatattgtgtaccaatctaatcttttcaccctatagtaagcattcatttggttaaggttaggtactatagagatcacaccataaaaaatggtccagtagtatagatctttttgacagaactgtaaaacttgggctgcatctttatatatacagatggaaaggtctactagaatccatacatattaatctaaaacataaacaagatataaattctctcattaatcagaaaaactagaaattcccacattacatctaaaggcaaattttgc

SEQ ID NO: 64293 - DNA, 7158 bp, Oryza sativa
ataattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccatcttaataaatcgacccaatgcactgtagtataggtgggttggttgggcctgttcaacgtggtgtagcgttgatcagtggagatctaatttactttaattacccaaccgttttactgtttgctaaataaaatgttttccaaccgcctttatgcaaatagccacaaacccctccttgtattcctttgcacgtctgcatcattggtgtggcttgctgagtacggtggttgtactcagtcttgctattattcccccttttcagaagtgtagtgcttctgagctgaagatgaagttagaagaccaaggctcagaccccagttgagttttgcctgtggagtggagctgaagccccgctaggatcgcctttttccgctgctgctgcttttgtttcgatgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatcccccctcccccctccggccagatctggaggggaaggagggagggaggggagccgccgccggccgccccgcgccgtccgccccttccgccggcggggagagtgaggggagaggagaggtgaaggggaggggaggggaggggaggggagagaagaggaatttgccacaaaatgtgtcatgccacacctcactttgccacaaaatgtgtcatgcctcacaaagtgaggctagcaatttgttagccacaagtgtgctaagtttggcaagaatttgagtctatgatgcataggttcaatgactagcaaagtgaggcatcatacaattgtggcaaccaaccaaacaatatactaaaaaattgtgacatgcctaaggtttgacatggcaacctttgagagccaaccaaacagccccttagaaaaatttcagccgcatgtgccacatatatataccatgctaattttcgcaggcgcacctcatgtggtccgcctgtgaaatttgatgtccgcctgttttcgcaggcgaaccacttaagcggtcatttagctctaagcgtcatgtccgcctgcgaaaataagacccccacgtcggaaaaaaaatgcgttttctagtagtgaaaaaaaacaatgtcattgtaattacatataagttacgttacaattataatatatttacgctatgattgtatattatatttacatctgataatattttagaagaaaatttgacgataaatgcataattgctttacagttgatgaatctagaactgtttacgctcacaattttctcagtgtttggatccaaactatacgatgaaaaggtagtttcattggaacgtaatttcataatgcatcgagaataccttgtggatatgcaggttattactggtcacgtgggcgaacgaactcatcacaagaattggcactaatcaagctcatgttccctctgaaactactaaggaaaaacttgtgacaacaagtttatacctgacaattactgcttagtggatgaggtgagaagcaccaaagattttgatttctcctttaatataacttattttgtttggttaaaaaaattgtatattccccaaaatttctccccactattattcaagcttgaagccttgaatgttgttcactaaagaaaagacatgcctacagcatgtgcttgtatgtactgttgtataatctattgcgtgctttggttttgaaggtaactgctacattgagagaggctggtcttccatcatcaaatctgaagggcctctttagatcccatcctggggggcagagcagcagaaagctttggataatattaaggcatatatgagttcccctccggttttaattcctccacagaagggagtgtctttcaagttgtatttatcagccgatgagaagtcaattagctcagttttgattcaggagttagaaggcaaggagagggctattttctatttaagccgtaggctcttggatgcagaaacaaggtattctccagtggaaaaattatgcttgtgtttgtatttctcttgcacaaagttgaggcattacttactatccaatgaatgcactgttgtatgcaaagccgatgtgatcaaatacatgctatcggctccggttttaaaagagagagttggaaagtggatatatgctttgacagaatttgatctcaggtaatccaaggcagtcaaggggcaagctatagccgattttattatggagcatcgtgataattcaatcggctcgattgaaattgtgccctggactttattctttgttgggtcagtttgcgagccaaaaaaaatggttaatcaacggagtgacaatggtttgatccataacactcggcgtgatgagatctctctcaaggcagtatcagagggatttaaacgaaaagagtggtgaaatatttgagagtgacaccatataaggtatcttgggaactctcttactttgggaactgttagagaatcgtaagtggcaattacaccctagtggtgtgattatgaatcatggatggttttccattgctcatggcagccactataaattccagaaatcatcatgatgttcctcggaacttgacagaaattgttctgtacgtgggtcagaagcatacggagtcaagtacagaaaggtgtagtcagtaaggtatatgacagagaacctctttttaacggatcatctttaccgaagttatgaaagcgaagttgttatgatcaaagggctgaaactctcgacagcatcaaagtcagtttccatcagacgctcagattccagtacttttgggaaagtagctgcggggcctatagtccgtcaacccagaaagagtcagcaaaggatgatcgaagaagtgagaagccatatcaggagaaggaccttttaagtttgatctgttaagtgatcactgtatgtttcagagaatgtcaaccatgccatccgttcaggcatacaacaccgaagccaggcctgaagcaggacagttatgctagcagtagaactaatggggaatgtcagtcaatagtcagtatgctcatgagctaaatgagaatttctttgtgtggaatcgcctatcatcagctaagggttaagctccatgtctcgccgggacgaaagtgcatcgtcattgcttcattttgattgatcgatgaagttttcagttttcaaagtcagggctctttgcaaatcagaggagtgttgttatttttcaaggacagcagtttaattgttcccagtcaggcggaagtatgactactctctgtaagggggttaggtcgcagagatgagttttggcttacctcgtcgctgtttcccttaaagattcaacccagtgcagccatccgggtagtattcaacatatttttttttctaaaaaattgatgcatggaaatgaagtgctaattaagttaccaaaaagtaggattgcagtcatcactttaaatccaaaattcgtaatgacttgcataaacatagttaaaaattaaatgtcaatatataattaattttgctggaagcctttcatgtttccaggaataacccgtaaacatttaatagagcttgaaaatcatcattaagctctaacctgattcttgggagtagcatgcgcctgagccaaaatttctaaggccgtgtttagtttcaaaatatttcttcaaacttccaacttttccatcacatcaaaactttcctacacataaacttccaacttttccgtcacatcgttttaatttcaaccaaacttctaattttagcgtgaactaaacacaacgtcatgttcacttgtatacatatccgcagacaatactacaatcacaccagaaattgcatatctacataattgccctcagattcaaactgtatctaccatcgctagctggtgagctcacatttctaacatgtcaatctacgttcagtcatgcaaataatctactccctccatccccaaaatgtttgacaccgttgacttttttaaaaacgtttgaccgttcgtcttattcaaaaaatttaagtaattattaattttttcctatcatttgatttattgttaaatatacttttatgtatacatatagttttacacatttcaaaaaaaatttgaataagacgaacggtcaaacatgttttaaaaaatcaacggcgtcaaatatttaggaaaggagggaatacgtcactattaagaaacaggaataaatttatgagtgacataaatgagtgcagtttggaaggaggacatgccatagaactggacgcacaatatttcatcaaataggtattgggcgtttagattttgtttaaagtccaaagctgaattcaccacagaaaaaatataaagatcccaatgttagttctgtcaagggtgttcaattcttcggttccacattgcagaagcttagagataataaaaggtatatggttgttaagctgacctagggaagattttacctgaaagttccatacaatgcacgggtcgtttatctcaaaatgcttgcccattgccatatgtctgaatatgaaaaaaaaaaaaagaagcattgtgacagttgttacctcgtcagcgtccagtcaccttagccataaaccaaaaaatcagacaactccattacattaggcatggtcagagagtgagaataggctgcggtggaagcttgatagcaagataaaaatgttagttctactaatataatatggatagagatcaattgcatttaagacattgtcagttccagcatcactttgaaattttgtgaaaatccatgtcgctgaacaatgacaatatagacacatatccaccgttcaggatatagtaggaggcgttccggccacacttctctagctccttcactacggccgtcagcatgaattcttggttgcatcatgtgcatgccaatctggtggagcccggtgccaccgaagcagcatcatgtgtatgtcaggttcgcccatggtcgtcatacatgagtaacttagcaaagttcagatctacattttgaaattcagaaaagcaattcacactaactgctctacatcattctcacacaagtaaccccacaactcccaaggaaaacaagaaagtacctgaccttttagctttaaggctatgtgaactcaagaactctgctgcatctgctacgccatgcctcttactgagcctagcattgcttctggacatcctgcatatggattaacgatttactatacttgaaatcagcaatacaatgttcagaagcatatggacgggatgacctggttggctggtttcacatttggacatcaggataccatcaccatccgtgtttgctcacacatttgcaccaacgaaagaaaataccaagcatacatccattgaaaaaaatacaaagaccatgaattactgcagaggagtgctgactggaaaaaaaatcaagcaaaaaattaaagatatatttgagaaatacgcatatgatatattccaatgaagcagcacaccttcaaacttccagatctcctccacttcaaacttccaggtacacagaggtagtacctgcactggaacctctagaggtagtaccactctcctttctcaatgaacaaagtttgataaacaaataaaatttctgttaaaattatgtccggtgaatttaacattggccaaataaatttgtccgtgttgcacatgctgacagctgctgaccttatgttccaagaggaatttgaataaaatccaacgcaatttggtaaacatataatagagttaaacaattatatataactaaactttaaaatacagctagacaattcgatggcggcagaggggaggtgccaagcagcgaggtcttccccgatgatcggctgtgtgtggcggggcgactgatgagcagagaggaggagatattagggatgggggagagattaaaggggaaaggggtgggggaggagggatctgtacctttggaggggtagcacagttggtgtgctagcgacgacgaccgagctcattttaggcgtagggggcggcgacttccctggtgatagggcaccgcggttgaggcgtggcggcggaaggcgaaggaggaggtgtggcagcagaaggaggaggaggcgcggcggcggaaggaggaggaggtggtggggcggcggaaggcggaggaggagacgcggtggcggaaggaggaggaggaggcgcggcgacagaaggcggaggaggaggcacgacggcagaaggcaaaggaggaggcgcgggcggtctgggcgacggttttttttttttggcgatttggtgaagagaaggattgagaagcgctaatcgcagtgttaatcccaccaaacaactcgtgccttttatattagtctagatataacaccattttaagtgtttatgatttattctttttttggaaaaaaaaacaaggagttcaagtttaaatatgagtactgtctggtgccatttataattgaatagagggaatatttttctgtgatggcaaagtccaagcaaaccctaaaaatgaaagaagtaagagaaaacatcattgcaatgtctgttgcttgcacttttttgcaagttgtgggtgtgtctgtttctgtcaaaatgtagcctggtaccatgatgaaaat

SEQ ID NO: 64294 - DNA, 1471 bp, Oryza sativa
tttccttcttccttcatttttgcatatatctaccaagtactcccaatcaaggatcgtaatagagttgccccgtttgtttgagcttaaaagccattgctaattttgaactttagaattaattatggtttcctttgtcgaatttgaaactcagccttgattttttaaccgccacgagtacaagtgtaaaaaagtcttatcctaaaattacttttcactatatcggtggtgtatcttccttgtcttgtcttatgcagccaaaaaagaaaaaagaaaagccctccaagcagaattgccataaaatctgctgagtttaatttcttttcagtcttccacacgacaaattgagaagcttaacatgcatccacgcacatgtctgatgaatgcgtgagaatgagacatctatatactagattgacgattttgcatggcaccgtggtcaccattttctggcaacgcaaatagtacgcttcaccgacaaaatggcacgcgggtggcactctgaagcctctccatcaacctaagcgcctagcctttggtccttctcaacccctatatgcacttggcttaagtacttcggtcctcccttgtctagtggaggttgtacactcgtactcctattctggttcccattaaaatgaaaaatacgtacaatattttctttaaaaaaaaacacaatgcaagcacacatgcatactctatcctatcctatgagcacatctgaaagagattttttttgaaaatttttttatagatggtttaaaaaaatatttccaaaaactgaaccttttagccacgccagtgtcatactttttggaaaggactattaataaaattaaaaaaaataaaaagtctaaaaaataaaaaaaatactccaaaagactagttcggtatatcttaaaactgactagttcggtacatcgatgggtctatcactaaaagaataattaatcataaacgcgaacacccatatcaaatctaaaatcttaaaattgggtgagctggttacaccataaggaatctaactgaatacactcgctttgcaaaatatgcacaatttatatgaatttgtttctttaaatataattcatcttacaactcgtaccaacttaaccctctttatttttattcttaattttcttggcctgattataagttgtctgtctttcccagacatagtaacggagatgatgaaatcactaagttaaagctgtggatttagaggttgtacataaagtgcctgattatacttctttttaatccttcctcacaagttaaagatgtggatttagaggttgtacataaagctccgaaccctataattaatgtgtttatgccttgtgggattagtacccatatgtcatagataccatagatacgtggaaccaagaatcatgaaacgccaccatacgagaaattttttaatcttttttttatcatttttcattttaaaactatattctaaaaacttatt

SEQ ID NO: 64295 - DNA, 20350 bp, Oryza sativa
aaccaacccgacccgaccgatggggtcgcccctttttctggtgcacctaaagctgggccgcacgcacgtcgcaccgtacgagatgggcgcaccggccggcgccaccgcgcgcggtaaatgccaacgtgcggccgccggagacgggcggcgagacggttgggccggccgaacagatgccgcgtgcatgataggtgggaataagtccactttgactcccttaaaagcaacccgaatctaatccgtggccttaaactacaaaccagatatcctgacctcctcaatgttaaaaccggtgtaatttgattccctcaagcggttttagagagcggttttgttgatgtggcgcttgacctagtcaaactagctgactcagcatgtgggacccacacgtcagcgtaacattttttctatctcctctctttttcccatgctgtctaacagcaaccgatgcagatgcggatttgtaacgatggcgccgccgcggccacacctcacggcaccgggtacggtggccacctcgccgacaccgccgcaggcggcgcttttttctcccgctccgcatcgtcggcctcgacctccgcgacagccacctcgccgacacagccatttgctcggcgaccggacgactcgccgccacggtggtcgccgagctccgccgggccgccctcatcgcagccgtcggagaacaccgcgacgtgcaccaacgacgaaccgcgtcacggcgacggtgcaccggacgccgccatgaccacgaagacgagcggtggcggcggcggcgctggtgggaggggaggccgacatagcgtcgcctcgaggccgcgagcgccgacggctccctcgagctctggctcccctcccccggcaccgtaggctccttcgccctcgcggagtccgtggcgcaccggccgtcgccatcgaggagggtgctcacgatggagtgtgtgtgtgtgtgtgagggggggggggggttgggtgctcgaccagagtatgcggcggtggagcgacgcgcgtcagagccgtggtcaagaccctcctcgccggcgagcgtcacctttgcgacgagctgttagcctccgacgaggagctcggccacgagtggttcgccgatgtcgccaggagatgcctcctgcagctcatcggcttcgcggacgccgtcgccatgtccacaccggcgacggagaagctctaccgcatgctcggcatgtacgaggcactcaccgccgtcgagccggacatcgaatccctcttcaccggagacgtccgcgacttattctcctccgaggtcaccggcgtcgtggcgcagctgggcaacaccatccgccacacgatgacgatcgaccagttcgtcaacgtcatccacggcgagtcgtcgcggcgaccagtccatggaggcaagatccaccccatgacacgctacgtgctcaactactgtggtctcctcgctgagtgccgcaccacgctcgacatggtcctcgccgacaacaacaacaccaacgatgaccaccacgacggtggcggcgcctcatcgtcagggcggtgcatgcgggagctcctcactcacctcctccgcaagccggatgagaaatccaggctctacgaccacaccgggctgcagaacatcttcctcatgaataacctctactgcatcgtgcagaagatgatggaggaggaagaagagatagacccacagtgggccccacttttttttttgcgcgaatgacgaatgggtcccacatatatgtttttagttctgatgccacctaagcgccacgtcaacagtatacaggcaacactgccacgtagacgccacgtcagcaaaaccgctcttcaaaatcgctgaaggagtcaagttgcactggttttaacagttgaggaagtcaagatatctggttttgtggttcagggtcatgaattagattcgagtcacttttaagggagtcaaagtggacttattccatgataggtgcagtagcccgtagggaataaggatgggcctttgggcgaaggacgtcgtacgtggggaataacttaataagtttactttgactcccttaactagtgaccgaatctgatttgcatccctgaaccacagcacatgatatctcgaccccctaaactattaaaaacggtgcaatttggcttcctcggtggttttggagggcggtttcgctgacgtggcgcctacgtggttgtattgacctagtcttcgttccacttggcgttgacgtggcgcttaggtggcattagaattaaaaaatgtgtgtgggaccccatttgtcgttcacaaaaaatatatgtgggatctactgacatgtggggccttctctctcccttatctctctcctctcctcgcttctcccttctccccccaacaacaccccacacacacacacaaatatatgcggaatttgagtttttttttctatgatagtcctagagatggcagtggtgccccattcaccgtttctccacggtgaattcacccattaggggacggggataattagaattggttcaccatgggaattaaatgggaggagacatgtcgccatcggttttcgtggggtggggatgatccttcattccccgtccctactcccaatgcattccaaaccggcctattggttggttattctttgaagtgtagcagggtagaatcatgaaacaaactcaaagtggtctatgagtattttacccgggaatatgaataatgatctagtctcagaattaatggtctttaatactccttgtaatctctttcttttggtgtgtgttggtttttgcatcttagctatgtagagaccggaagtgttctcagggcaatagaatcaccttgatataatgtgtttctcaaactggctactatgatacataccatttatctatttatctatctatatatattatattatatttattatttattttactctaccctatatttcaacaaatactttcactcatcacttatcactcattctttcattcctcactcatcactcaacggtccagattgcctctctgaaatctcaacgattgagattgctcccacctcccacctccctcgattgcgcgctcctctccgccccctctctatcgctctcacgcgctgccgcccctcgccaaccacgacctacgccctcatctctcctctcacgcggcaccaccgtcgtcgccgccgccttcgactgccgccgctccgccgtcgtcgcatccgtcgtctcgccgccaccgatccccgcgccaccgccgtcgccgccgccctcgactaccgccactctgccgtcgtcgcatccgtcgtctcgccgccaccgattcacgtcgccgccgatgccttcctcgcgtggtcgctgccgagaccttccgtgcagatctgctcctcgtcgccaccgatccccgccgccggcttgcctcaaccgatccccatcgccgccgtcgctccaccggctcgccctcgccagcgtctccccgtaggtcagtctcgcgccgccgccactcgcatctcctcacccccgcgattcccaaccctaaccgtcgtcactgccaccgccagcccccgtcgaccgtcgcaccgcgctgcgccgcactgtctcgcccttccaccacgcccccggactccaacgtcgccgctccagccccgatccacgccgccgcagccgcatcaccgtctatttccgccatgggggcgtgattccgcgcgacggctggaggaggcgaggtcgggcctgccctccatcgatggcggactccgcgtgacggctggaggaggtgaggtcgggcctgccctccagccccgatccacgccgccgcagccgcatcaccgtctgtttccgccataggggcgtgattccgcgcgacggctggaggaggcgatgttgggcctgccctccatcgatggcagattccgcgtgacggctggaggaggcgaggtcgggcctgcccttcacgacgctccacgtcgccgcagcccgcagccccggtggggccggtggttgggtggttccatcccggtccggccctggaaggcgaaccggcttgggtccctcgcgccgccactgatccagggctcctcaaccctgcaagccgtcatcctgcctgcgaacaaggtaagagtgcttctcgatcccgttcctgtacatgaggaggcatacggggcagggtatcgtttattcatagagatgcataatggctttagaaatcccctttgttgactaaatccccattgttcattattaaacattgttcactgtgcatggatatctgtgatgcaaaactctaatccaaagcctgttttgcatttcaactaaatttcacatgttaatctcattcgtgtggtacgatttttttttttttgggtttcattgctgtcattggatgagatacttcacatcttgttaacatttatcgtcaatctttcactgtaaaattgtggggaagaaatggcccgcctcagataattcttttgtgtcaatttttctatgtgattgcttctatctagcaaactgacttaacctttcatttcaaatgatttaatctataggacaaaaattcaggttgtcgaagaaaaattcaggctgacaggacaccatgtcaactgctattgtttgctgcacaatcaaggaaatttttggctgattctactaaatttctgtttggtataggtaatttctttcataatgattaccccttacaaatagtgcaaatatatactccgtgggtcaatcttcgcactgttgtagaatctgatgtttaaaattgcctgcatccggtttgcaaatcaagaaaaaaaaatgccctgattactgtgccaaccatattttcttcgagggattgaccaaatctttttcttgtaaaagcttaaccctgttccaaatgtaatactgcaattttgctcaatttcacatgcacaccacagtgtagtcatgcattaatgattttgatttcacagtgtgacatgcacatcacattgtgaacaagtatattgacagatcaacattttgatttcacatatatgcttccctgttaaagcccggttatcctaatcgatctgggatctaagaagttgatggtatatgcagtaccatttgtttttcttgcaattgactctaaattcttatgtcgttcagttcatataaatggctatattctacagaagatagatgaacctatttttctttctctagggcaaataactgaagagtgttggtatttgagttaaccactttttacgagcctaacctgctgcacttccacaaccatggatttaaatagattgttcatgtagttcctattttttctgaacaaagtgaaaaatacgtcgcctatgataaaatggcaacttactgtgtgcaatgcagtacactaatttattttttatagatcttttttttgttggtgattgatagcgtggctgctctccatagacggcttcttattttcttttcatgccatatcaataaaagtaatatatttttccatccgggtgaaatttgatctcttaaccattcggcacttatcttctttcacagatcatttattaaattttccctgtatcctacgtttacagtgttgcatgaatcagaaaaaatctgattgaaggatctaatatttgaggactcctgctctgctggtgactacttcactccagttattcaaggtatcaaagttactctaaaacgatgttgttaaaagggactgctttactaaattgtgatcatgtattatctctttagtttgtggatcttgggtctgtgatcatgtattatctttacgatcaaataacgcgcgcgcgcgcacacacacacacacacactcctactatctctacgtagaccccacatggaaggccactataagattgtgtatccgctatgtcatgtactggtgaaaaaatgataaatagtctgaaccatatttattttttcatatagagcagaaaaattactgaagcatcaatacaaaactttggttgttttccggccttgttgcagataatcatgatttcaacttggtgttactggtaccgacttacaggagtagagattaaaatttcagaaacctggcaatcgaaaaaatgaactctatagattttggtttttaggagtttggaatttcaagttgatggttgtgagcggcagtcgtagcagcaagcttgggatattattggcaaatcatatccaaatctctgtcaattacgctatcctgcagcagatgagagtaaaggttagcaaatcatatccaaatctctgtcagctgctattatggcaatatttccatgtattacatgcccatacatgtcaactcacaagacatacaaggcaatattgttatgtctttccataaaccataaatatcatgataacaacaatggtaacattatcctccttagcctatatatatatgtgggtgaaggagtgtgatccaaaaaaaattactgatcctccttagccggctgcatacgactgctcaacttcaactcatcatcttggtatcgttctccaatctatctcttttgtgttggaaattattatatactttagtttgcacctattgatctcctacttcttctgtattgtagtaaggcatggcatccatgtatgatgtggatttttcaccacatcaagccacacctaaggagtcaatgaacttcaaggatgatgcgaaggtgcagccttcgtcagggcaaacaccaaacaaggggaattattacatgggccacgcgaatgccatcatgatgatgtttcagtacatacgtgatggctgccggcatgttgagagttccatggaagacttcaagtccaagaaggtagaagaaggacgcgatgagaaaaggaaggtgggagaagggtatgatcctcgctggtcttctcccatcgagataacaatgaagatctgcaatgacgacgtctccgatgaagcaaccgagaaggaaccatgatttagtattgtcgctactgtgttttggccttacaataaaataacatttcttgtgaattacacaagaaaattcagtacacaatgtcgttcaggtccattaagtactgcttgtgaaatgcaaccaaatttgatgaaactttgttatgatgcctattcaatattgcttgtgattcagttgatttctgggacctatacaaatgtgctctacctcctgttgaactactttgtatttgtttggcacggttggatgaatagtaatgtccctttatatttgttttccatgtctttttatataaggagacacatcacacaccaatttcctgacgttggatatttagtcatgtgttggatatttagtcatgtgtagcactattgatttctgtaattcttttgctttagatcaaacatattttatttgcttcaaggctccattaatttaaagagctgaccaatcacatgaatattgatttgtgaacatgaaagcgtataaaaaaaagcaaatataattaacataagaaaccagtattgctaatttgctattatgttgcctattcagtcacgataaaggagtaaaggactgctagatgtcaaacttatgtgtatggcccaaatcctgtaatggcccattaacaactaaaatacccatgataaatacttatatgcaatactcaacctaagtgcctttgatctgtcacgtttatcatatatcttaaggcacatatatatgcattatcatatatctttaatatcatattattatgcattatgacatggggtataaatatattggtatatcctattattatattttacttgcaatatatttgatgcatgacataaattgaattaaaactcaaatgcacagttcatataataatattttttttacgaaacatgaaaattttaaaaattattatagacaaatagagttgcaccgtagcgtttagcacgggcatattactagtacccacaggagaaaaatgtgagagctgactggtaaatctcctcaagtaattacttgaaagttggtttgttgatgtactccagcatagcattagctgaaattagcacaagagtaaacatatcacagcatttataactaacaaccgatatgagccagaagagtctccatgagcaaatgtagatgcatgcatgttgtatttccaaataaagaatacaaagttgatcagtgaaataaatgaattttaacttcgaattaacatcttgacaacaaccttatcacaaaaacatgagttgcccatggctcggattcttcgtcttccccggttcctttgccatttcaagtaagattgatcatcagacatcagtcaatcataacatgatgtagattgaagaacacaaaaggatcttcaaattttagttgaaaaatcttcatagaacaattataaccgaacatcaacaaacacactgaattctgaataccaagaagtctaaaaatacatttcaccctcaatttctgcaactactaagagataatttctcgccaagaaagacaagaacaacaactaacgatcagcacatgctgcttaaaagtttaaaagaaaaccctgaacttttctacaaatatgaagaaccagaactgtgggatgccttttcagcggcggatgttagattggaggttgagcaaaaaagacctagccaagagcaattttaccatctaacatttggtacctaaaattgctccctagccaaaggcgggttttttttttatggaggttcaagtcctgacgaattggataagtgtataaaatatttcttcccttttacaacgtattttaactattttcaaccttgtagtaaaagggaagaaaatgttttacaaagttgaaaattttcgtggggctataaatttttttcgccgggctgaaaaaaaaagttgaaaattggtatgtgtttattgtactatttcaatcctgaaattaaccagattttttttaaaaaaaagagcaactgcaaagtgcaaaccacccgcttaactctgaagaacaatcacttccttcttcaccaacacaaatccggaaatggcatggctttttccattttctctcgtcacaaaaatttctgatttctcactagaaaggataatcattttaaccacctctttgcatccattcttcattggtgtaaaatctgcatgtgaaggagcaattcgagcacgcgtgatcgaatccaccctgttttcacattgtttggacagtcatggtttccttctttttcttctgaagtttctgaatcaatgctaaacacctgcatcattaaataaagtgaagcttaattatttccttcctgttcgacaacgatgacgatctttagcagattgatcggcggcacaattaatgcgtgaattcagtcagtgatgagagaaaaacagaagccaaatcagactgacgagaaaaggttcgctcacatgctgagtttataccgaaaagagaaggctcaactactgtgagcttttgtgttttgcctataaatgtactgattcagtgtgaaaatttgcctggaattgctgcgaaatttcgtgggaacttcgtatgttcatctgcaccagaagcgattccattttcgttgaggaggaaggtagctagcacctcaaacattaccggttttggtctgatgttctgaacatgcacgcaaagcaatgccatttctgaagaacaggctagaattgtgatgacattgcttatagaaatttgaagcggttggccttgtttgtgatcaaaggctgtgtttagttcctttcaaagttagaagtttgggttgaaattggtacaatatgactgaaaagttatgtgtatggcaggttgatgtgatggaaaaagttggaagttttgatctaaacacagccaaagatgtagaatttttcttttctatcacaattttcttttcagtggactaagagttggattttcacctgaaaaatattaccactgcaactcttgtctgaagttctgaacatgcacacaaagcaatgccattacagatattctgcaaagttgattttttttttttgctgggtcagccgaagataagtccaatcaaatttcattaagataaagagagtacaggttacaaaattattacatcgaccaacgttgccgaaggcgggacgagaattgccaaaatgcaatccgcccacagaaaggaacacctgaaactattgctgaaaatgttgatcaaatatgtgaaattttaatagtgggtcttcggttttcacttcaaaaaatactactgctgctgcaactctgcaagagataggtggagaaggtaacatgtgagccaaaccacgcttgattggttggtagtcgatcatatttattatttaaattactcaatatcgatagcaatacgatgtaacaagaaatcagaaaaaataaaatcaacatatcgtaaaaaagaaaagataacaatcggatatgacggtacccttagagcaggtacaatagcagattataaataatctataaacatattttaaagagataaaagaggagagagaagagcatcgagctacagatctatagccagctatagcacggactccaagacgtaatgtgtatatgacaggtggaaccaaatattaacagtatagtaagcaactattgtatgtattggtcatagatgatttatagttaatactgagtagatccgaaatttctgtgactatttctatccctttttcctcggtgccgttgggacacctgtccagcaaagtacgatcggaaatgacggttctacccctcctcctcgtctgcttcacctccataaaacccccacttgtgcccagggcttcacctcccacgtctgcgaggaagaggcgctgctgtgattgcgagtgcgaggtatgtgcattccccccacaaatctcggcccccctctcctcccttcgcttctcccgatccgtagaaaagcttcgtgcctttgagggatggagtatgcgtgctctgtttgatggtcagaggctgagaaaggagcgaatttttccaatcgttttgtgagcccagcggttacggtgtttcggggttgtttcaacagtggaggggatttcgattcatgcaggttcttggctttctggatgggattttccttttctcgtttagttgattttttcaataaaagttcctggctttctttgagtatatttgtttcatctgcctgctcgagtggaagtggggtttctaccgcttgatatttcttctctcttttttttccagtgtatttcttgtactccccggttattacttgcttataagataaaattctaaaaaaaaataacttggttataagatttgcagttttgatttggtctgccgttgaggattcttgtgttctatggctcgtctctgttttttatagtgtgcaagattcttcgatcaattattagctcttgatttctattggaggttattggcttgtggtttgtgtgtgcaatgtgcaatgcaagttcttggctttgttgacgttccagagtgtagtgtggttctttgatctgactgcttaagaataaagcacctgccttttgtaacatgaggatcctcaatttttcgtgtttgtgtattcttgtttcttgtggtggttacttggtcaagattattaagaatcctatagaattaggattcttaataaagatatgcactgttgttgaggatcctcatgttacaaacattttttttctttctgaaatgtgcaatattgttcaagttcctagctctgcgttattggctgaagatggatttcatttacaggttattcccaagaagacgaagtggtaaaaagctatgggcaactcctgccttagtgctcgtaaggattcccttcgagattcttaatctcttttgcttgctactaacctactagctactgaaattattgtggtagaagcacagaacacggttcaccagtggtgtcagtcgattctgtttcagatttctgatatttccatgtagaaataaaatgtcaagaaaaaattgtaattttagttcctggaaactagttacctttgtcatcgtgttgagcggtttggtctcatttatcagaaggtatagcaaatggcatagatagatatgagtttgaggcttgaactactagttttcataatcactgcctattgactctggctaggtgtaatcttggctacaatatgttggcagtggttaattacttgtgccatgggccatggcccatgaggttatggcatgtagttttgtataggaaacactttgataccatggtaatgcttgtttgctggatgatttggaaagaacaaaattcacacgtgttcaatcagtgttcccatactattggccggatcttttttagataatgaaagctttatttagacttagttaactacatcaagatgattggcatgtagttttgtataggaaacactttgataccatggtaatgcttgtttgctggatgatttggaaagaacaaaattcacacgtgttcaatcagtgttcccatactattggccggatcttttttagataatgaaagctttatttagacttagttaactacatcaagatgatacaatcaaactgagtcactcttggcctctgcataaaatgcacacagccaaaaaagaagaaagaaacaactagaacatctcccaagccccaaagtttgacagaaacatatatcttagtggctatcaatccgtaggctagaccgccacccatgctcctaggtaaaaaaactcctgtgccacctggtccaactgtcgagataccaccgtatatcttagtggctatcaatccgtagactagaccgccacccatgctcctgggtaaaaaactcctgtgccacctggtccaaacgtcaagataccaccataatagtatcccgcagtcccggttggtggaggatagcccaggtacgtagccaccgggtaattaaggtgataacctgcaaaggagaagacacatcttgttatcaaaaattactccattcctgcttagccaaatggaccaacatagagctgttgcacccatcaaaagtagattcctcatttatttggggacacatgatagccaactcccaaacatatgaccaacattgcgaggaggtttcagattagaagccaactgaattacagaccacaccaagcgagataagcggcaccgaaagaataaatgttggatagtttcatccttgtgacagaaacaacatgtcttgttgcctttccaatttctcttagcaaggttgtccttggtgagaattactccccgacgtaaataccaaaggaagattttaacttttaggggtactttcaccttccaaatccgtctattgatattcggaaccccgctatgtgttagagctagataatgagatttgaccgagaagaccccattcggggtgaggttccagtgaaactcatcttgctcctgtaccaaaatcaaatcagctatgcgaggcaataagttatgccaagcagctagttttgcaccaattaaatcccgtcgccatgaaaagcacggaggattggtttggaaaatctgtgcgatagtcgattgtttatgcctaactatgttatagagacaaggatattgttctcttaaccaggcattacccaaccatttgtcttcccagaacctaacttgggagccgtccctaatcttgaaggatccaaaacggaaaaagtcttgtttgaccttcataagactagcccaaaaatgtgaatcccccgctttccaataggcttgagataaaggttgtgatcccaaatatttattgcgtagcaattattgccatattccatcggtggtaagtagtttgtataaccacttactaatcaacgctttattctttatctcgaggtcatgaattcctagccccccttgttctttgggacgacaaataatgtcccacttagcaagccgatatttcttcttatgtccatccccttgccaataaaacctagatcgaaggtaatcaagttttttaagtaccccactaggaattgcaaggaatgacatcatatacattgggagactgctaagtactgagttaatcaaagtaagtcgtcctcccaacgaaagaagttttcttttccagctactcaatttcttctcaaatctctcgaccacttctttccattccgcatttctcaacttcctataatggatcggaatgcccagataacggaatgggaagttaccgacctggcagccaaagagctggttgtattgatcactataatcaagtgcttcaccaaaacaatacagttcacttttatgaaaattgatcttaagacccgacaactgctcgaaagctagaagcactgacttcatgttctgagctttttcaaggtcatgattcataaacagcaccgtgtcatcggcatattgtagaatgaagagtcccccatcaatcaaatgtggtatgactccatcaatttgcccttgtgttttggctctgtttatcaatgtggctagcatatcagcgataaagttgaataggattggggagagagggtctccttgccgaaggccctttttagtctgaaaaaaaggctcgacgtcatcattgactttgactaccacgcttcccccggaaatgaaagactcaatccaagatatccacttgggtgaaaaacctttcatacgcagagtttgtagcagaaaaggccatttaaccttgtcatacgccttttcgaagtcaattttgaatatcaccccactcaacttcttcctatgtagctcatgaactgtttcatgtatgatgacgactccatctaaaatgtttcgtccacgcatgaaagcagtttgggtcgggttcactaaatggtcagcaaccgagctaattcggtttgtagccaccttagtgaatattttatagctgacatttaacaagcatatgagtctgtattgttggatttgatttgcttctttaacttttggaactagagtaagtaccccaaaatttagtccgaaaattgggaggctaccagtatggaattcattaaaaaggttcatcaggtcatgcttaataatgtcccaaaatttttggtaaaattcagctgggaaaccatctggtccaggagctttattatgctccatcgcaaaaatggcttctttcacttcttccgaaaaaggagcagtaagcaaatcattttcagcttgtgaaacttgagccatatcaccaattatggactcatcaagcgaaaacgagttctcctctggtggtccaaaaagtttttcattgtcttatctttggtgacattaaggacgagatcacagtgtggaagaaagcagagtttttcattgtctctgatgactaagtgtttgtagtgtgaaggtttttgtcttcatgcctttgaggtgggattactatcaatctcacactggtttcgacaacttgtcgatgtaatattactataacctatacctccctaatcttaatgaaatttggtcggcctttttcatcagctgacttgacaaaaaatagtattatgtactaattctgactttactgcaaagaacggatagtttttcggagttgtctttgttctcatacgattagatatgctcttatatgtggaccaaacaatgatgtgacatacacaacagcagatttcctgccttacacgggagtaactcctcttcctttctcccttgtgtagtttgagttaatacacttgacatcttgatttcagccgatgcactgctggtaaagatccataatccagtgttcttatggaaggtttatggcttctcagcgctacttcagaggggagctttagcagccaagtctgctgcatttcattgctctggatacaactggtacgtatagctgtgaagacactacagcggtaatatgcattagatttaaaactgcatgtgactaggcagataccatgcgtcattcatcagttcatttgatatgttcaagagataaaatagttgcctataaacaataagaattgcgaaatagtcttacatgttcacgtcccttaaaaaaatcaatgtagctaagtaattagtctcagcgccctataaaatggaaattgcaaggggatgtttgataggatgaatgaagaaattaggatttgttattacttcagccttgatttttaatctgagttggtattatgctcattgattctcattatacaggtacttgaaagtgtctccaatgcataaaacccttggtgatggaactccacatgttgctctttctcttgtgctgtcccgactaagctttaagccagattacaccatgaatgcagtgttcgtgctgtcaatgtacaaccattcgaagggaaattttcttgtagtcaaaggtaatttcctgaatttggagcagtattgaacatattatctcaattccaccgctttaattcaatgtgtaaatatatatgatcaaatagtttccacattgtttaattcactttgtgttgtcttatgctaccaactttggtttcatcaacctatcgatatttgcagttaacatatggtagtgttgtatagtgcatacatgattccccccccctcttaagaacaaatgttcaattgttgtgaggtctatttatgttgcagcctagactacatttctctaatattgccacattttaaccatgagcagctagctacaacttcgacgtcaagaacacacactcaaggaatatatgcttgatttcccttgaagaccaactgaaatcatctgagtatctgcttgatgatacttgtgtccttggtgtggagatattacaaatagatgtgtgccgttctcttaaaaagaagaatgttaaagttcagaggttctcttcctccagaagaagaagtttgtctctgttcagaatctcttcctccagaagaaggatttcactaaaggggattacacctggaccatgaacaacttccctgagttggatttgaagccatcggtcctttcacctgcatttgaaattggcagacgcaaatggtatgcatctgttctggttacaattttgttgatgtttatatgttaccggtcctttctgtgtgcaatttgttcattatcacaaattagatttctaatttcatgctggccagaaacattgagttgttcttggcagttgacatcagtagtggattcaattagaaaaaggtagttgtcttccatgtcctgtatatcgtactgcaaatataccatgttccagttaaattatctaggatttatctctaagcaatagacctgaataactccaacggtagtatattttcagttagggaacaatatttctagtctgttaacataaacgacatatcttatttctgatagttaaatcctatttaacagccacttgacatatgtatcaacaacattatcttccgatgaacctagagtcatatggtatattttcccctggcatgagcactgaactcgtttggtcccaggttcatcagaatgtatccgcgtggtgatgagtacagcactaattccctttccatgtacttgttcccgcaatcctgggacaagctccttccagagcctgggatgatgatcgaactgacactatccatcctgaaccaaaacaatgcgcaacttcacaaagtttcaggttcagcttttccatgacagatcctgtggaatgaatttatatgcagggactgcttcatttttttgcagcatctcattcttagtttgtctcaatcgcaggtcgctttgtctttgctagtaagaatggctggggatggtccaacttcatcgcgtcaacaaactcaaggatcttgtcggatcaagctgcattgtcaaggcagacatcaccatcatcgggtcatccagtgagagtcagattgtggtctgaggaagaaacaatgcccttgcatccttctggcaagaacacctgccaaactatctatgataaaattatggtagcatcacaaagaacttgtctgatcaatggtattcttatggtagttaagatacctgagcaatggacgctgagaaaaatgtaagatatgccatgctatctatctatgtagaactggagagtaatgttatgttctgaaccacttttatgcatggatggtataagcatttgccattatatattgtcatctcggtgtctttaaattcagcatatgttaatctgctgatcagcctgtgttgttctgcttgatgatgcctctctgaattacattatcgtttcgagtttttgacaacttgtgtttgttgcatatgctgccatatatggtttaattggtcaagccctgtacgtgctaaacgggcccatcaatcttggccccaaaaaaatcaatctactgggcctcgtttttttttcctgttccctataaatctcaggattatgtgtgtgccggtggaggcgttgatcagttgagataaacgcgacgagttcgtgtgtgtttgtttgggcggcgactgcgagggcgatctggctgtttgctaggtatgtacattgtctttctcgcagatgacaaaaaatggtgctttcttaatttggttatctgatgccattatgatctcttggtaaaagaaaatccttttcattgagtggattaaggtacactgatcctacatctgtgatcttgtcgtttcactagcaaaacctagctgctcatcaatccattgttttctagagttcttggttatgagatatgcgattgttacatcagtctggctggactgaagctttgagatatatattttatcgtgaaagctgagacttaatctcttgttattgattatcacctagtatatgctgaggttaatttactggagacgggatctaaaaagggagctcgaagagagaaccatgggcaacgttgctggacgtgctgcaggtgcttgtaagtattcttttctgaaaaattgctctctcaacctggatctcatttgaagttttctttgttcagattagattagacactagtaacacattagtcattctaacctgtacatcggtatgtatgggtatttcaagttagtgcaaaagatatttgagcaaatgggcagtaacattagttttacttgtgtgtactgcaattgtcaatgggcagacttgtattttggagtataaaacatagcattcaaaccctaatgaagttttaattcattctgccaaaaaagataaagtttgaattcttagcagtaaatttctcttcagtgctatatgattttgaaaatggttactgctctcaaaatggagaaagaaatatttcgaaaatgattaattcctaaattcaggtacagtgttgtctatgctaattgaattcaccaaaaaattacaaagtgtcctaatctcatgagtagattcaaatggtttgcatggagacttatgtacactgaaatgattaaggaatgtatatatcgatcctttaggactaaagaatcagtatgaggatgcttaattatatggtgccaatttgttgaaggataaataatttgcataccactgaaattttacatattctctatctacccacgctctgattgagaaattagtgccaaataagagattgaatacttcagtgcaaaatttgagatatcggattggaataggggcgctgctagagaaagggtattgtccaaactaggtgttaacagcccaaaacccactccttagtattaattaaaaaccagatatgcccacaaaagacacaagacacaagaatgtgctggatagaaaaatataaatgatagtacaacgcattaacctagcaagggatttgcatgcgcatatatatttgttacagtgcgctcaatgttatttttcttaaagaaaattattcatggcagcattatcatggtactccctctgtttcataatgtaagtcattctagtatttcccacattcatagtgatgttaataaatctagatatatatattaacatcactatgaatgtgaaaaatgctagaatgacttacattatgaaacggaggaagtaaatcgtatcaatgatgtcctaagagtttattaattgatattgcaaaatcaaatttcagattccaaggagccccaaaatgctccttttgtaaaagaacgtgaaccagctttccaatggaagatttacaattcggatcctctgcattagaggtactaatgcagaggatgaacagtaccacgcgttagaatcactgtggaccgtcggatcaagagtgaaaggaccagattgtgtgatacagtaaattcggaacagtaccaaatagtgcgctacagtgttttgaatcctgtagctacagtaatcgacactgttcatggcattagctaactgttcccctcacatgaacagtgctcttctgcattacggcagacgatccggatccaagatttatggcttctctgcgttatttcagcgaggagccacatcagtcacctctgatttgttccactacggtgggcacacctggtatgtaatatctagtttggtggaaggagaatt

SEQ ID NO: 64296 - DNA, 3945 bp, Oryza sativa
aaaggcttattgaaacataaagtcatataagcttaggtagctaagttgggagtgggtatttcagcaatgcccaccccattaatcaaaagcaatgagaaactaacacacaaaaatagtgcacaattagtgaattgttatggtgttagtgaccaaaagttagcgagatgcatactggttgtaaatgatggagtatgcattatagtgcaattaactaatagagccaatgagacccaacatctaacaattcgtctgaatcaaaacacttgaaacatgaggcaaatctaacagcttgcccacatttacaattggtacaaattaatgtcctgaaaggaatctgaaatgagtaggtggttagtttgttggataagtatgtaaatagctaccaaggaaggagataagtagatttaagatcgatgttgtgttccacacgcatgctcgactagctgctagcttgttgatacagcagcacttgtgcagatttttaattcacgcatgggcagaggcaggcaggcatgtatccttttgaatctcaagatggatagatttatcgtcagttgcctatatcaacctataatggtatctagctttagacagagtaaccacaagtaatttaccttgaacagggagtgcacattacaataaagcttaagtgaaagctaaagagagggaaaattgtacaatttgaaacgaattcggcgataatctagttatgaaatggtaccatgaggagggagctggtaaggaggcttttgttttttgcttgtttctggtggcgcctccttcatacaacagagtagcattcattttttaagacaacagtaaaacatttcaactagagaataaaattaccttatgcaagctagtaggtttccaggaaacattcaactagaaaacactgtactaattacttaagtaattgatcatgaccaagtcaacagcctaaggctaaaccatgcatggtatgcagtctcagcttaaactgaaacttttgttggctagttaattaagcacagacaggagacaagttctcgagtagaaactacaaaggcgatccatacatacgaatacgattccctgaacgcaattcaaatgaaactgaagggaagaaacttgcgagtttctgacctgtcgatctgcttcacgatccgatcgcggaccaggcagcttcttctccgcgtccgggcagggctctaccgatctcgggtggactccggcgacggtgacgacaagttagggttaggggttggggtgctcggaggcaggagggggaagagggggggcggggcggtggcaggtgacggagaaagggcgcggcgaggcggcgcgggatgcgttacggggaggtgaggaggcggggatccgacgacgttagccgccgctgacgcctcgacggaggggaagaaggcggcgcggaggcgaggtgttgatggcggcggacggggtgggaggaggaggaatacagcggcggaggggagggctggccgcggcggcgcgtgttctggtgggccttgccggagtcggaggcgacaccggcggtcgtcaggggcgggtgggggaggcggcgggcagcgtgaggtggggccgtgtgatcaaaagtactcatcacaagtgcccggtcagatctgcaccgtagggttcaatccaacggcccgaatttcgcatgtgatggaatcataatttctttatatcgttttaatctcactcataatttcttaataatctatccacctactattctactactgtctatttattaccatatagtttcacgaacacagtactcatttatcaaatccaatatcctccactcatatatgtcaaaccgaacgggttaaaattgccttcacctccccccaccgcattcctcccgtatgcacccaccccaccccaatgagaattttgattatttaccatctaaaatgcgcgctttgatttatttaccatctgatccatatgtcttactacactttgataccaccttctacactaatactttctacccatagccatcgacaactatggcagcaacgacgagaagagatggcggagcctccgccatcgtcgccaaatgccacggtggtagcagctgcggcaaggggacaaggagaggaaggaggcgccagacctagccaccggcgaccatggcagaagtgccaagaagagatggtggagctatcatcggtggcggcaaggcaacgcgaagaggatagaagtacgggctaggaagagatggagtgatttttgatgagtttaatgtcaccggagcagaggaataagatagatccaatcacctaagtggaagaaaataacagacgatagggttgttgcagtctatcgtatatgtttgttgcactctattttattcaagtgtttcatccttgttttattcgatgttacacatgatgtactatgtggtttcttcgatgtttgaagagtagagtgttgatgttgtgagtaatgtttttcattgtttgatgatttgattgaaatatttttggcgcttcaaagaggactatttctaggataaatttttttaggggtctatttttgaaataagtttttaagaaggaccaaatagtaaaaaaatcagttggtaacttgttatatgctctttctgatttctgaagttgcttacatgctttaatggtgtgcttgtcagtctaatggtcgctttggtttcattggtgagaacttatttctatgtgactatgtgcatgtcagagttgaggaagagatgaagtttgtcgtgccaacttgatctggctggagacgtggaggcataatatatatctgcgtacacctatgtatctgtggagacccgagtcgggcaaggcaccatgcacgcatgcagagatgggatgcggcttgacacgggccggtgttgaggtagacccgaatgcccgtatcagacgtcggcggctacgtacaaaaaattatgtgacgatggaacgtgacgcggacgaactcggattgacggatgaaaatacgagtttacttttgaaatataaatacgtgtttgagtttatttttaagttcgttcgcttttggaaataaaaaaatatcttataagaaatctctttaaaaaaacctcgctcagctaacttgggacacttttggaaatacaaaaggagtcgtataagaaatcaattttaaaaaactcacatgctatcttgagatgagaatcgaactcttaattacaactcattattttacaaaaaaaaaatccaaacgattttccacaatgattttcactcgaactcaaccgtatagaataatagtaagactaaaatggctttcactcgttgcaacgcatgggtatttttttctagtttttataaaaattgaagatgtttttatcggtattttggtacgtcatccgtgtataagttggtttttaagtttgtttgcttttgaaaatacatatccgtatttgagtctgtttttaagatcgttcatttttattaatacaaaagaaaacatataagaaatctatttaaaaaaacaaactcgcatgctaacttgagacgatcggactcctaactgcaacttatgattttctaaaaatatatatatccaagcgaactcccgtaatgaattttatcttcactaaatcatataacaataatgggattaatatagacttcacccgttataacgcacgggcattttttctagttttatagtaggtaaagatttagactaaaagtgtcccagcgttgcaacacgaagaaaattgaggaaaagttaaaaaatatttatattatataattaatcaaaaatacaaattttactatcttctttatataaagaatatatatatatatatatatatatatatatgtgtgtgtgtgtagaactactatatggcgttacaggcgccacatattacatggcgcctaacacagccgcaccaccactctgtcccatcttcccccacccaccaca

SEQ ID NO: 64297 - DNA, 12291 bp, Oryza sativa
aaaaaaaagctagcagattggcactttctgtcatgcatgggtgctgatgattatcttgtatctaatttaatcaatcccatggctgtgattgatcaggaatagtttgtgtgtgcagctatattgcctattggtgtccagggtcacacaccataagggcatgcatgtcagcagctggtcatgtgtgccttttcattcccttcttccttcctagcactatataaaccccctccaaccaggtgctaagctcatcaagccttcaagcaaagcaaactcaagtagtagctgattaccagctcttctctcttctcattgagaagagggaattaagttttgatctctgctttattgcctgatcatcctcttgttacttgcaagcaagaacagtagtgtactgtgcctcattgatctcctcccaccaaactctctctctctctctcatattccgagctagctagttaatcaagatcttgctgcaatggctggcatgtctcttcagcatccctgggccttcgcctttggtctcctaggtgtgttgcctttgatctgatccaaggaattctcttgagaattaatcttgcatggttatttacttttgttgttattattctctacatttttaatcatgtacttttccatgttccacttttgttgccaaagctactatatttttcctaccaattcatccaaaactactatattatagcaaggcagctagtggatcgactttgcacttttggatgcaattgtgagtggtttacattagaggggccatgcatagccaaataaattgtttggcaaaatatgatttcccttgtagttagcacaatattgtgatctttcattcctttactctttttgttccaccaccctcattattgcaaagccccctcttttagaaccaaactaaagataagaaacatttgattcatcattagaggagattagatatacatacatactacacatgcattgctgtgataagcctagccaggcacagaaagagccaagacaaaaggagctcaaaagaaaaggggctccaatatcttgcccggcctgatcagtgtaacatgacgtcacccacacaattattaaaaggatagatgcatatgtgttcgttacgtatctccttgtgtcacgttgctgtgcatggttcactcgcttaattataacgtccgtcgcattttatgcatgcacttcgtttttagttaatcaaattaaacaagatcctaacatatgatttctattttattctctttgcaggcaacatcatctccttcatgacctacctggccccactgtaagtcccacacatccggatattttcttttctttagcgaaattttacattgctccagaaagtaccttttacactaaaatttcttatacaccaccataaaattaatgtggtactattggtaccttatcaaaaatgataaaattacctttttcttcagataaaaacactccccgtctctgtataactaagatgtagacaaccaatacacatgtctagagctaatcctatcaattaacattgctagtaaatacaaggaaaaatataaagaattaaccaattgcttggatgtcttgcaggccgacgttctacaggatctacaagagcaagtcgacgcaggggttccagtcggtaccctacgtggtggcgctgttcagcgcgatgctgtggatctactacgcgctgctcaagtccgacgagtgcctcctcatcaccatcaactccgctggctgcgtcatcgagaccatctacatcgccgtctacctcgtctacgcccccaagaaggccaagatgttcaccgccaagctcctcctcctcgtcaacgtcggcgtcttcggcctcatcctcctcctcaccctcctcctctccgccggcgaccgccgcatcgtggttcttggttgggtctgcgttggcttctccgtcagcgtcttcgtcgccccccttagcatcatcgtaagaaaccctagaattgcctgtaaacaataataactttcggtctctgcaccaactaaggatgcacatatttacgcaccgcttttgctatctctgcagaggctggtggtgcgcaccaagagcgtggagttcatgccgttctcgctctccttctccctcaccatcagcgccgtcgtctggttcctctacggcctcctcatcaaggacaaatatgtcgctgtgagtagctccgattcgacccgttcttcttcctaaattttccgctgctcgatttaatttctatttctaattgtggaagattgtttaattatagtgattatggctagctgataaccgattttaatttctgatggtgatccaaaatggaacagcttcccaacgtgctgggcttctccttcggcgtcatccagatggggctgtacgccatgtacaggaactcgacgcccaaggccgtgctgaccaaggaggtcgaggcggcgacggccaccggcgacgacgaccactccgccgccggcgtcaaggagcacgtcgtcaacatcgccaagctctctgccgccgtcgacgtcgtcaagacccgcgaggtgcaccccgtcgacgtcgagtccccgccggcagaggcgccgcctgaggaggacgacaaggccgccgccgccaccgccgccgccgtcgccggcgccggcgagaagaaggtagctgcatgagtgcgtgcatgcgtacatgggtcgccgtaagaaggaagaaggcgtgacgtgtccagcccgtacgcgcgccacgtggccaagctagcttcagagctagtgaagctgcagacatgctagctggctagctagcagtgagagagtgcgacgactaaaaaaaaagtagtgattaattaagggcttgtaatttaatcgttgttttttttttctctgtttcgttgagatcgatatcgttgtcaccatgcatgtatttcgtttttgattctcagtaattaattagatgggctttctgtaattcaacctgtaagggttccttccatgattaattaattagcgtgttaataattgtcccaccaatacagtgcttgaattattttattgatagtctttggagttttgttgggtagtactaattaattaattcatggccattctgaagtgatgcctagatacgtaattgatagagttgagtgaattacaagaaattaatttgacgcaagtgacgagaatttgtgcatatgccttttgtgcttttctttcggcggcagattgtaagcttttccgggtctatcttagctttaattgttgcctaatcctcgctcgctccagagatttctccttttttgttccaactgaaatccgctctttcaggagcaccgtagaacgttaacgaggctataataaggaattatgtgaccatattttgcatgttctagaattttttttctttgttttgataattttctagggacaaaacaagacaggtcattttagtcatggatgattggatgttgtgatcaaactctggcaacgaaaagcgcagaacaaactagggattcgaatttattttaaatctattcaaaacagcttgcaaaaacccacgcaaaagaaaaacaaatcgctaagagaactggtgtggtgcacgtctcaagcggcccaagttggcccagtagcacgcgggctgcatgcgttgcgcgaggcatgcgtgacagccggccggcggcgttcagattggcgtttggtacttgggtgaaagtatagttggccaataggcccgcagtccgacggcccgacccatggtatgaagatttggcccagcccagacacgacacggctcgactgttgttaggcctgtgctggcccgacccgacccgaccgtcgggccgtttctgggtctcttacttgacacgacatgccagcccagcacggcatggtccaacaatcggcacaaccgcggcccaacattcctggctcttgcaggccgtagcccgtcggtggccggactaaagagatgagggagccaaaatagacttattaaaaggacgagtatggtaggctgatcttgccttcgggccgacacgacatgacccgagtcttattgtgggccatgcttagatgcaacccgtgggcggggcacggcatgacatggcgtgttggtcgggccgtgccggtgctggcctgactgatcacgggccgtaccttggtcatgctcaggctgggccgtgcagggcggtccatttggccatttatagatggaagcttatattttgacttagtctatatagggtaccccttctgtgttttaattataagtcgtttctaatttttcattaagtttttaagtgtaattaaacttaagaaaaatataatggggcgatggattaaaaaccttgtaaggaaaggctatcaaagtcgttgactattaatccggttgaaaagtttgaagtcagtccaatttgcgaatcaatcgagctccccttgcaatgatgtggtggtcaacctctcattcgtcttttagtgctcaatattttcaataaaaataaatattgcccacagactgacttggacacccgattagctagtattggggggggggggagataggggttcggaggaggaaaattttagagagaaagaaggatgtgttcaaagggggcttcaataataggtatggctgcatggggtaggaagttgatcgatggccggtgatatatatggcagtgcatcatcacagtgatagtggcaccactagccacaagttggggtgaggcggatgtattaagcgggttagactaagggaacaagcaaatatggtggtaatattgaactcctaaaaatcttgtattggggccatcccaaaacaaattagacctaaaaatcacctcatactccaagagacacctaaaatttggatcccaatattttagttgtagagtggactggttcggtactgatatcaatctcatacgccccacgcataagagcgttctctcgcggtggcctcaccactacagtacatcgcgtcatcgccattgtctctgttttctgttcgccggtatagtacgtcgccggcggcttcaacgtgtagagaaacagaaggcaaaggtgtgatcccttacctgaacatgtgagaaacataaagttgcattattatcacataacatgacaagttctgctccaaattcaagtgctggtgttaagcaatcaggttctgtgtcaagccgattgttcctctccctatcgacaggattagttcatctcaagaccaaagatgctaatcggtccacttcctcatatcagtacaaaattttatttatgggggcttcagctactccagtctgcactctgcagtacaacatctaaatggattgcacgaaaaaaaaaccaacaagtttgacatgatctgatgatcagtaagcaacaaaaattgaaaatttggagtttcacaacagagatagaactgatttttttatattactggacaacagggatatataccttgttctcacattaagctgaaaatgaatcagacttcacactgaactgtccaagaatcatagaaactctgacccatcaaatcttagaggaacatcataaactatcaatgtataaatatactagtacttaaaattataaatctgaatataaaaagtcaaggctgaagttggagtactctacattctgtacagcgaattgattttcagaaaaccgaaactatactgccaagccatcatcctccacgctacaaagcacatacattctaatgaacagagcaagacatgatagactcctaaagttccacaattttgagccaaggaaacatattaaaaatctgtgtccaggtaaagccaatctttatgcaatctctgtaattcaaccacgaatgaacaaaagaaatctttctgcaacaaaaagggaaagcacatatcagcagggttgcgtaataatgcagcatggagccattttattcaacaattcataaggaaatggtattggtatttgttaacttcagagagacagattttcaccatcaaaatctggatggaggagacgacggaggcagcacgggaccccatgccatggatggaggagatacggcaccctagacgaggaatcgaagacggcgtgagcgtggtatcatccgaagctagagaatacgaaagaaggaaagaaaacgcgagggtaaacatcgcacatacatgcgcgagaggggaaaagggcacggacggacaaaaaatggcgcaggcagagaaaaagtcgtgcgattagttggattgggagcgcgtccacgttcccaagtcttggctcagattggccctgattttggtcataggtaaattttgggactatggttgggaatttgttagaggcctgtttttcatcgaaatcctaaaatttatcttttaggaacctgtttagccctctcttggagatggtttgcaaatcttacggtgcaaagccataagagaaggggatacaaagcggcgcaggggaatcacatacaaaaatgaatcttatatcacactcacatgcgcgcacacacataccatgaggatctgtcctagcacatttctaaactataaaaagaatagaaatctagccacctagtgacaaagcttgaacctgaaaaaagtagatttcacaaaaaaaaagatagcttggctcactaaggagtaaatgtaattttcatatctttaattagtggaagctatcttctggcgaaagtatacctcaagggttttaaggtggtgacaaatctttacttgttttgtattgaaacgatatatgactaattttaaggttatgaaaaatgggttaattggacccatgctacaataaatcattcggtttgaaaataccacattactattcacttatttagagccacaccattataattttatattttttcgacatatgccactacttcggctgtgtttggaaggtgaggttggaaactcatctcccacgacttaaaacggagcaacgtattttcttatgattaattaagtatttattatttttttcaaaaatgaaataatatgattttttaaagcaactttcgtatagaaattttttttgtaaaaaacgcatgtttagcagtttgaaaagcgtacgcgtagaaaacgaggtaggtgagttgagaaagttgtgaaagaattcagcctgaccttcaatgcattgtctaacatttttggactgaattgcccatggcttgttcattcattttgtgtttattgtcttccagccctttcttccccttcaggatttggatcttgcggcttgtcatcttcattcccatctcgtactccctccatcccaaaatataagcatttttagcatagtgacaagttaaatatttttaactttgaccgttaataacaaaaagaaaaaagatcaataatgtaaagttgatgttactagatttaccattaaacaaactattataatatacaatattttttatttaaaacatcttagttttacagatattgttggtcaaaatagcatctcggagaccgtgtcaagaactaaaaatgcttatatttggggacgaagggaatatctctttagctttttcattttgatctcttctttccttgtccttttccttcgattatcttctctcccattgtctagtgaacctaggcaatcgtgggccaccctctccacccacctccgccttgcgccgtcctcagatcccaacgagtaggagatgaaggtaacagtgacgacaactgtcagggagtgtctcggaggaggtgaggcgctacgatggtgtgggtactcatgtgggatcaggttgaggtgcacaagggagatgaaaggcaccagagatgaaaagaggaatgggaagagacaaagcaagaagaaaaagataagttagtatttatgttttgttaaatgcatcatattggcaagtagccacatatatccaatatctgaaaagttgtaatggcaacagctaaaatattatgaatagtaataacatatttgaaaaaccgaaaactttatattagcatgacacgattaattaactcttttttgatatagtcttctatagatggccaaatggaccatacagcctagcacgatcggccctgactgaggtcagtcgggctaggctaggcccgcccatgggttgcaccaacggcccaggcacagcacaataagactcaggtcgtgccgggctagcccgaagacacaacagtccaccgtgcttccctataaaacaagtctatttcctccctcatctctttagattcctcaactattttcttcctgcttactggaccgtgccgtgccgggccgggccggcccaccgtgccaagcaatcagtccaagcacggctcatctgtcttcgttcctttggtaacgcaccaatctcaatgcaaaatatagagagagagaaaagggaggcacatataaagccaagccggaacaggatcctctgacgtagagcaatctacgtcagagggacatccgatgccgctacgccgctcgatcatcatcgaacagaggtaaacaagcacggcaaccaactggcttcttttcagcccatgctgacgaaatcaacctacgaaaatggaaaggctcgctcccaatctattccctcgtcatatgccgctgagttcttcgccgatgcatagtcagtaatccatgcatgaaccaaaacaaaacatttgcagtaaacaggaggaccatagaaattcaagagaaggggaaggggagatcatgtaaataattgcatcggggtacaggggaccggaaaggttgagggcaagagaatggactgtggcaaactaatatctttgtatatatatttgggaaaactaatatctttgtgtggtacttttgattcagatgttcctctatttacctcgtgcaagcatgtcctgcaccgtgagagaatagaatctcttggttagtgagagaccgacgcttgtgctctctcacatggacccagcgccccgccgccaccgttgttgcagctggcggcggcggcttctcgtctctctcctccctcaccaccctaccctagtcctgtcccttccccacttcttcttcaccctcttcgtccttcctccgtgagtatatctcgccgccgccaccaccatagttgtcatgacagaagcagagcagagcagagcgaacaatgaatatgcccgactccgttgaggaggcgccggcgccgccagtgacgtactacacatacaggatggtgcaagatccgcgcccacatgagggtgctgcaggtgtagcaggggtaacctcgaccactacggcttcgtcgacatcaacgataggatgttttacccctagctagctggctagatgcctagctagaccaatcaacgaattatggaataaaacggcacaatgagaggtcttaatatttgtcatgcttgcagctttgtattctgtaatttcgtggtattaaatagtactgcatttcatatataaggccaagttctttcgttcaactccgaatggtgtgttttgtgcaaaaaaaaaatctatataattttttttgttaaaagataaatagatctaatttgcaagggtataatagttactatatactatacacaattaattatgtgctaatggctttctcatttcgttaaacagctaaacatggcaatggtggccttgtaactccacgccctgaagtcctgaacacactgtagttgaacagactcaccaacacactgtagcatatccggcacgggcaacagaatacacactgtagcatatcagaacacacactgtagctcatccagcacgcacgcagcaggacccacactgtagcttatctggcacgcacgcaacagaacatgcactgtagctcgtccggcacgagaacacgcaagattaccaaattaaaccaaacaaaacagaacgtctgatgagaaggaaacaagcaagagtgcagcaccgagagtatcttgtaacatcactcgttgtgctccgtgtaggatttacaatccaatagtaactggcaagagttacgatgttctccaatatttctttgcagagtgcaccatccctaaaggttcatcataaataaaactacagtagtgataataattcttttgttgccattctaatacaaggttattctagtgtgtacagctggaactttctctcttaaaaccaccatcaatgaaaatatctataatactcctaaatagcaagattctagagggctatttaatagccctccggatccaaacagggcccatgtatgaacggacacttaccactgatcttaatggctgtacgacaatgtaagaaatatccatacaaatcatttaggttatgtgtacgatcgtaatatatatatgtaagttgagatggatgtcaatgccaaaataaaaaagaaattgaaccagaaaagtaacgaccaacccaacaggtactgaggtaaaatctaaataaataatcaattcttatctttttttttgaacctgtaaacttttcgataaaatgttgtatgcttgaaccagaaaagtgacgaccaacccaacaggtactgaggtaaaatctaaataaataatcaattcttatctttttttttgaacctgtaaacttttcgataaaatgttgtatgctttgtagtaaaagtaacctaaataataccgttgatataatgcgagtctgactgggtctcaattttttttttattttttagaccttttatttttaaattttattagggggcatttgcaaatttgccaccgatttttttaattttgcaagaatgccactcgagtgacggttctagtggcatttttgcaattttctagtggcagtcttgcaataacgattcaaattactggtacatttgcaattgccccattttattaatagaccttttcaaaaaatattttcaaaaactgaacattttgaacattttggccatgccaattacagtagcgtggcaggccaataataccacactagctgtacgtggcgcgacagagttatttggacacgccaagcgagctagcttggccaaaagttcggatttagaaatattttttggaaaggtctattaacaaaattaataaataaaaaaaagttcctgggtctttgagtagcgcgctttctcattggacatactctacagaagcatatagtagtatgtcttctcatcactctacgaacagtcgcgaacccagaacaatataatcagggtcatgtacatactaattatctaattattcactgatatactaactaatactacatccgtcttaaaatataaagtattttggatggataggaaacctgtccagattcattgtaattgtcctatccatctaaaatcctttatccagattcgttgtactaagaattgtcccatccgtctaaagtcctttatattttgggacagagagagtaggatataatttagttagaattagataatctacctagggtctatgaccccagggaagaaaacccaggagcaccaatgtctacaaagcaggatcgacttgcatgaaaagattaagaggtgtgatctcaattttcatgtaaattttaccgctcaacaaaaatgacagtgctcaacgaccttattattcattaataatcaacggtaaatacattgaatacattcggcgtaaaatgcaaagaatgtgaagaatacatttgcctcccgatacccgaaagaatgcccggcttgcgtcccaatacctgcaagaaagaatcgggtatcgggaggtaaacggctagctatagcgaaggggtccggcttagctgctgctggcctgctgctggggagctagctattttgtttttttttactttttttttcgtatatgcccatgtgttgtaaacagcatgattttcttttcctgatattttttattttttccgcatgattttttcatgaacttttttaatcacgtgcaagtgcacacgcacgattcaacacgaatttagagtcaaagtttttaaaattgtagttagaagttttaaattttcagtttgaaagttttttaatttcaagataaatgttttgaaatttgggatgaaaggtttcaaatttgagctgaaagtttcaaagccgaattggaagttttaaatcaaagttgaaagtttttaaatcttgactgaaagtttttaaaatttgagtcgaaagttttctaaaaattaggagttccctgttgtacgtctctatttatttgtcgtggagtttcctatttacatacttaataaccccctcagtttaagattaagactgttttacaagctttgattttctttttctctaagtcaaacttcttaaaagtttaactaactaagtttatagaaaaatatagcaacacttataat

SEQ ID NO: 64298 - DNA, 4855 bp, Oryza sativa
tacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgaaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaatggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgtgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccaaagatgtacagcacgtacgccctgcagtatcgctgtactgtagcctcgtctgcctcagcgggacactgaccgaagttggctcgcaaccaactcgaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccaaagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtactccatcctgcaaatgaaaatggaataattagtaattgaaaaaatattaaatggaaaaatcacaatgagaatggaaaggaggacaatagaaagtaaacattgaagcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgactggctctgaatttgtattgttcggcttttgtgaccgtcggttggctgagcctttgtatgctttgtccatatcgttcttgaaccttcttgtccttcttcttcctcgtgtgttgttctttaacgacaaatcgggcacgaagaactctccatcataacttggccactgcgatggatctaggtaaggttcaaacctaggggagtacgagtcctgcacagccttattggaagcttcataacacattcggggggccacctccacatccaaacctcacaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcattgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgattagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggactttcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcaactcgcacaaatgcctgtaacttgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtgg

SEQ ID NO: 64299 - DNA, 6305 bp, Oryza sativa
tggtttgtggctcagtctggttataaacaaaagtacacggatggagatggacgaagtcggggtcgatggacatctctaggacaaatgaaggctacacgagctgcggcccggtagacgagatgtcatggcacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttttaaaatggctttgggcaactaagtgacttttaaatgctgttttctgcaaaacttaacccctatatcattaccccttgtacccccttgcattagtcgtgcatctgccggtgtggcttgctgagtactgtggttgtactcattcttgctctatctttctccccccttcagcaagagaagctttggagaagaagtcttaggtggagtcttggcttataccccagttgagcgcctgtgaagatggagccgtaggcccgctagtccgctgctgtttattttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttgagaacccgtcacagaacctaagccaccctctagggtagagtcgttagtcgtgtgtttccttgcttgtgtgtgtagtgtgtggtttgcatcggtgggttgtgatgtgaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtatctcaagctcccgagtgaatgaagcaccagacaccagttgtgtgacactggtccaacacctgattaaccagaaccaattgcttatagagatactacagcagcatcagacgccaattctgaacctaagtcagatacaacctcaagcgcagttggaggcagtccaagcactcacaccacaagtcagcatgccgccagcatcccgaaggacccatggtgaagtgccacatgttgactcaaaagaagcaagtatcatttgttttatgtgtgatgagcaagggctctatgcaagggagtgtcctcagcagaaaagaaaaacaccaatgcgaaccgaagatgaagtccgtaagatgagcattaccagcacagaatggcctccaccaggaatgacaaaacgtcagagaagaaataccttccgaggtgcgccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtcccaaaagattgtcaattcagttttctgctgacgaagaagacggccaaccaacccgccagttccaatggagagaagtatcaaggcaacacaaatcctcaccaagattacagttttagcctaactccagtgccaggacagaggaatcaaaatgagaaaagaaaatgccgagtccggaaagatatctgttgcttcaattgtcaaggaatgggtcatttcgccgacaagtgcccaaaaccgagaaacatagctgccagcacgtcagtccacgcaactccctgcaatcagaagcttgctcctcagcgaactgtcatccatgcatcccgaagcagtcctacagcccgcgttgcaacagctccaactccagcgagtgcattaccacaagatgtcactgcccaatttcagccccagccatcagttgacgagaccgaggccagtatcggcattgtacctttggatgttccagcacagcagccaagaaatcaagtacaagatgaagaacccgagcataagaaagttattgtcagttacaactgcagtacctgttaaagaagcggacatgccaatcgccaagtggtcactggagcaaatgcagtacctgttaagcctagcactagtcagaagcaaccataatactcttatatcagtgttcaaatacttttgttttatagttgttccccatcaatcatgtaataacagagaaacatgagataatgaatgagtttgataagtttattgagggatccatgttaagattgcaagtgctgggagttgtgtacattttgttgttgattagggagacctagggtctcatttctgtaaactcataatctattataaatcaaataacctagcgattgatggcgaagaaaatcaagtgatcaaccaaagagacatttgtttggactgagagtttcagatgtgtcttcttcggatcagaggcatgcacccgttgtggagaaactggacacgttgctggcatgtgtctcacactctgctctcactatgaagaagaccatccaccaggggagtgtcccactcgcaaggtgacatgttttctgtgcgaaggaacaaaccatatgcccaaggatggccaactcagtgtgttgttgaccaagaccgcggaaatccaacgaacaaccctacgattgtctcatcagctagtcagctccaatagcaacatcgacaatatcatccccagcaccaatgctcctcctgctccacctgactctgcaataaatcatagcaataataccttcagcaccaaccattctctgcaccgacagcctcagcaaagaattgtcatcgatggaagaagttgtgtccctccccgacctactccaggccgagcaaagggcaatcaacctccggagggcgataccaagcagaagaccgtcatccgcttcaaacagcaatcagaaggaagcttctcctatgaatgatagcaatatgcagtcctatcacatcatcacagaaccaatcaaggatgatgcagtcactagaacaatgccagctatatctctccagaaacaaaatgagcagctacgcttgtggttttcagttcgctacttatcactgtaatcgaaagtttgcagcgatcatatataaataaacatattgatgtctataaacagtgagcttgctatgtttatggatgattcctattgagggtacaatgtaccgatgttaagcaccttccctttttgtttaaggcagggccttgtattcgtataataagggagaaatgtgtaatacagacaagttctaagaggattcttttggaagatgcggatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataatgattgttggatgaaacccataagggtacccgccatgcctctacattgataagttcggatatacctgcaagcagttaagaagatccaggagatatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggatctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctaggaaggcaaagagtgaaatcttcaactcggtgtcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaaaccatttgggaagacgtcaaagtatgtcaagtgggataagttggttctcttgggaagcataattcaaaggcaaagttatcgacccttacatcgaatagcagaagtagcttgcacccggtgaccaggaaagctaatatgaggcagttggtggcaagttagaagtaaatgacaagcatggtattctcatgatgacaagcatggtatcttagtaatgacgagctgatctcgacgcatgacatgaagcgggtaacttgtatgaggttgacgccaaaggtacgaatgataagaagttctagaaccgaagccccatcctcaaccaccgcagcctagtctgggtcagttagaggttcaaccagggacaagtcgggtgaagagaagattccatctgcaacaggagatcgagccaagcattccagagtggagaagttttgttaggcaagttggttatagaagacggagcggaagaagtcagacaagaagagaagaccgcccaacctatcttcatgctagcctcctcgaatctcggggacgagattcttgtaagggggggtggatttgtcacgtcctgataaattcatcccgaattaaaaatcattcgctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatgagtttataaaaagaaaaaccctaaaaagtctttttcccccccttcccctcttgggccggctcggcccacctccctccctctctctcctctcccccgcggcccaatctgtctcctccccgcgcgcgtgccgctgacgggcgggcccgcccccaccctcgctgacgggtggggcccacctgtcatccctgtcctcccgccgctcccgccgcctcgcccgtgccctagcgccggcgccgccgcggaatccgccg

SEQ ID NO: 64300 - DNA, 10842 bp, Oryza sativa
aaattcatgtagcctaaaagtaatctacatatattatagaagtaacttatatcaaaaagaaagtaactgtaatgaatgtcttttttaattggatatgactacacagctagtggtagctagcttggactccatctagtatctcctttcaacttgaaaaatacaatagtatcttttttctcattctacatgaaaaacaaaaatgaaaggaaagaaacaatcgatgattaaacagatttatagagagttacttttgaaccatgcaaaagttacttccaattaacattgaagttacttttaaaaattgttaaacttatgtgtgttgatctgtgctgattaaatttaatttctagataaagtcatatttttatccctacaacgaatttacttctattgtcgcaacaaaagtacttccgttttgttttaagttacttttataatatatgtaaattacttttagactctattaaatttacttttatatgtctaagttttatatgtctaagaagtaatttagtcaacttaaaagtaatatatatatatatatatatatatatatatatatatatatatatatatatatatatatatatatatatatatatatatatatatagaaaaactattctacacccgggtatagaatagctattctatacccctcctccctcccaagggtcacacccacctccccctccttaccaaggcccaaaaccgacctcccaccggtcaaacccacctcttctcacctctcgtcccaggatggtgcagtaacacaacgaccactatgcagtaacactgtgtcttacgtgcagtaacagtgttaaaatataattgaaacatagtcatgatggatctacttttgataagcttttttttctagcatcatggtgcaaacggttttaaaagcccttacatcacttgggagatattgttattcaaaacttgacatttttgcaatttgtctctccacaagtagtaatactatacaattacttgttactacttgtctgttgtacgttactacaatcgcatcacgatgttactacactgcgttttactgtattttttgggtagtgttactgcataaacacgtggtaacgtgtacctttcgtgcagtaacacttttatttttgtgtagtaacaagtatatggttagcttctgagacttttaacctatatatttttgtttcagttcttgatttactgtaattcaccacaatattactgtcacatcttacacatgcagtaacactatattggtgggaggagaccggttttcttgagaagagggaggaagaacggttcttgaagaggggagtacgtagatgcattttgaagtttaaccctctacatgcagtaacactatagcatcatggtgggaacgattttaaaaaaaataatatatatcttgtgagacattgcttttcaaagattggcactttgaactttaaccctccacatgcagtaacagaatgtgtaacttgcagtaacaagggcatatacatgcagtaacatggttttaccaaatgtataaaattgttcaaaacactcctacatcaatcagacctcgctcaaagtgacgtacagacattacctatagcccacctatttaatcttcatctcgtaaaaatgacatattaaaactacaattattgtgcagtaacatagttactttgaagtggtaacatacacctaccatgtagtaacacttctacttttatgcagtaacaagtatatggttagcatgtgaagctttaaccagtaatactagtcacttgaatgtaataacaacctatatatttttgtagtaaccggacgtgttactatatttcatgatggcgttactacgaaaagggtgggagtacatagatggaggaaggagaccggttttcttgaaaagagagaggaaggccaagtttttgggtagagagagatagggagaggagaaagcggagggatcatgagagggagagagagaccgggattatatctattttgttactacacactagttacattattactatatttatttcacactgttactgcggggttgcagtaacatatagtacaaagcagtaacgagcgggagtaaatactaaagtttagaaatcgttagttatacaaacaataatcaatagcgtggtggtgaccactactcatgaaaattcaatgatggcatatcatgttacaatagtaatctataattcataattctgatggtaatattgctatagctgtgtagtaaaagatttgggatagtgcagtaagatggtttgaagtgtatactaacaaccatcctagtaccattactacatgttttgtgccaaatactacaggatttagcacgtatgagaagataaaaatttactaagaaaactctatcacaattgagaaatagcctattagttagtgccctgtggtaatttgagttgaaggtcttgagttctattcccattgaatgcaaaatttttctttatttttttctctctaaaaaaaagagaggtggaaggggatggggagaaaaaaaaggagaggggaggcgcgcgagaaggtgggcgagggaaccccaggtgtagaatagtcttaccctatatatatatatatatatatgaaaatgtttatgtactcccgggagtacgtactcctggtccgcatccaccgtccatccgcgtaccgcatagatcgatcgcacacatgttcctgcttatcggatcccaccagacccaatttgaattttctaaaaagaaatactggaatatttgattatcccttgatgatcggatctggcatcggtgtatatatatatatatatatatatatatatatatatatatatatatatatatatatatatatatatatatatatatatatatatatatctcctacatatataataaaagtaatttacgaatataaatattttttcatcttaatataatcatgtaagatcttgttgtgaagatttaattgtaacgaacacaatggtgtaatcggataagtaatttgagagaaaacttgtttgaagaggaaaaggacgtacatgtatattaaaaaaatgcatgcatgtagtaccatgtattagatggacttctccacgtttctctgtgtttaggcgtcgctagttaagacaaaatcgagagccctctccaattagatgttacgtcctaatctcgtagtaatttcatcgaacgtgcgattctgactaagaatcctactccatgtcgaagaacttcacaaatagggccaagaataaattcggaagaaggcccagattgtcctctaaaccaagcccaatacataattcaagctcattccacatctccacaagcccaaatccaagcccagcccagaccaaggcccaggcccgcctctgcggtctccttcgtcacccgcgcgtcaaccaacctccggcgtctcctccccccgattccccattcgccctcgccaccgccaccgccaccgccacccctcgccgccgccgccgatccgcgccgccaccgccatgccggccgccgcggaccccgcgcctccgacgccaccgccgcctcctcccccgagcctggacctgcggacgggcgggcggatcctgcggcgggcggcggcgcactccctccgcccgcgctccctcccgccgctcctcctcgcggcgctcctcctcgtcctcttccgcctggcgctcgtcgccggcacgctccgcctcgcctccttcgccgaccacgacccggcgctccggtccctcctctcccgcctctccccgcccgcgccgcacgccccgccgcacccgcccccgcgccacctcccgcgccgccgctccccgttcacctcctcctcctcgtcccccccttccctctctgacgacgacttcctcgtcgggaccctcgatcccgcctcctccgccccctcccgacgccgcaacgcctcctattacgagtttctcttcactccctcctcctcctcctcatcgcccaaaccctaccccttgtcgctcccccaccgcctcccttccaccgcgatcccgttcaccttcgttgtccgtaacgagacctcgccgccgaagcccgccgcggggcgagacggcggcagtgagctccggttgctcgacctgaccaggcgtgacgccgtggccatcatcaacctcctcgcgatgctttcgtccgtgcacgtgctcgcgatcctcggctacatcaccgttcactccgtagctctgggcaccgtgttcgcgtctgtcgccgggcagcacttgcaggggcggccgcggcggtggttccatttctctggtatggctttcagggtgagacggctcactgggtttgcgttcctgcggtgggcgacgcgggacgcgatcgtgcagatgctctgcctctggttcttctccgaggtgcacgaccaggcgcagctgttcaggctctttgtcgtcgccaagctcatgcccttttcagcatctgtcaacccgtggctcgctgcgaccgttggagggccagagcttgatgggttcttcattgcgtgggctctccttgatgcggtcgtctcggtgcttttcaccgtggtgccatgggtgattgttatggaccgtgatccacgaccgcctggtcgcaatgctgtgaaggaaggatgctaccttgtgtcattgatggcaactgatgccactttgatcaaatgctggcaaacagtggtatgcggcagcatgggacagcttgccatggttacacttggtgggaaggttcttggcggatttctccactcaatcggagaggtgtacttcatggtggtgtggctgatgttctacttttcagcaaggtgtaaggaggttcggttggggggccgccattttggattggaggatgtggcagctgctcttgatgggttcaggcaatagcatgttgacagttgcagcattactttttcagtgggaagaggtatatttcatgcctcataatgctcattcatgccgcattgctggtcttggtggagtcgcaatttcgtagttctcttaatcttccaaattgtgctatgatgttctgattcggatgagggagagagaacttggcaatgcttgtatatacagtttttgtcctatgggggtaatcatgtatagtgacaccatttggcacacaagaaaggttgtcttgttcctttttccatcggaggtgagatgccttgtgatagaggatgtagatccaagatgatgatagcgagatttatacagtcctatggtgtagtagcagaattatcttgagtgatttttgggatggaaactcttggtgcttcaagttcacacgctgttgacactatgttgatatcctttgtttttcttcttttgttgtgtgagcaactttgtctataacttcatttcaataaccctttaactttcttttcaacgaagttgctaggccattgctgagttttcttttaatggcccagttcttttttgggtcctggttctactagtctgccattatttgtctcttcaattgatacgatataaatttatcacacatgatctggaattctctccaacacatttggtgcacctctataagcaactttgcatgtgaggttctatttattggataataccccttttggaccagtgtctatcatatttcattccacaatgacctttacttttagatatgatctgcggttcatgttcccttacatgtcacttgttcagttgttccaactatttattcaatccataattcattaaaaagtttaaagcctgttgcatgtgggatactggaaaatactgaattggtggtgttgattgatattggtccaaaatcagtagtgaacccgaggaagtagaagggtgggtgcaaagtttggactgattataagagacagcgtattgtcattttaattctgtttaccagtttgtatcatgattgcaacccttacttaattcatgttcagaacataaaacgtacttctcatgagtatttaccatttagatattcacttgtatgtattaatacatagggcaggcattcaagctgaatatactcaactgcagtcttcaaaagacaattgatctttgccttgttcatccctttttccccttatttgtcatgctactaaattaaaggaccagttgctgttaggcttttataaatggcatttagagattggttaagatatgaacaaacatatggtttcagtaatttggtataagaaaaaaaaatataggacacgtatcttgctacgctaggctcaattccaggtttgcccagtattctgtgacccatcgataaacaagaagactaaaccatactctattttgacttatgctgttatgcatcctggtattgattttgcacacttaggacttgaaaggtatagcttagaagttaaaacatcaattttatgaggcagggggccgtgccaactagaaactagataaattggtactagtactatgaagtatggtgccatctctgaagcttgtgccatctactctcatgagtcatgtactgtgaccgcagcaggtattgtttaatttgtaaaagaagttagcatttgcttcgatggcattgtgtttgtaatttttttaaagtttgccagtacatatatgaccagaggatgccgatcatatgtagccatgcattgttatgattcttctcagtttctcagttcttatgtatcatgttatgtttcatggaaagatgaaaaggtatattgcatactgtgggaactatggagtcataaactgctgatgcttatgtaaatttttgtggaaaatgttttgctttgggataatacttgtatcaagtatgttgagaatatgtttgctggctgctcatggaaatgtatttgttcatcggttgcttcactgcatatctcatattaccttctgcacttgaacctgcagtcttccagttatctgaaggccgcatctgtacatgtctgaatagctggtcgcttttacctatggaactttggcttgtttatctcatgcgactatgcgattatctacctgtgttagaggttgctgaatgatgcatttgctattctttgtgtcgagactaattcgttctatgttactgaccctaaattatgctgtgctgtggtctggaaaatggtttgaaatgcttcattaccatttgtttctcctgtcacttgttagtcaaatcctactatcagagagatgaggtacagagcaattgagtaaactgattcatgaaacctttgggcatgtcatgtcgtgttcttccctgttatgatctgatgagctgcgaacaggatgatatgcatctgctttcttttgctgtcctttttattttggagatggatgcttgtgttttcagatgaacaggatttctctcgttgacatgttggcctggcccaacctctcgtagaaggaacggctaaaatgtagcccgcaggcaggtcacgcttcgttatggttgctgaaaattactgagaatatctgacagccaacaggagctctatggtcgtgtactctccctggttataatgtttttcacctgtactctttgtctgttttttaagtacttgccaccggacattattcatgtataaacctcgatcgcttgtatttctttaaaaaaatatataaatactttagagccccttagaaaaaaggtgtttcatcaaagtgtttttcttaaaaaaaatactaagcattaaactttcattcgaagtagtttaaccatttaaaaatttaggggcatgttagtttttagtcacctaaaagtacccacatatttacttttggacaacctagatcgcatcaagatttatgcaagaacaataaactttgtctaattcttccctcttccttcctgtgatgcgtgtcttctctcaattgcggctgaattactagcgatgtaagtgggtagtcctgttacccgcataaaaacccgcttgttagttcatttctcacatgatagtataaaatttagaaaaaaaatgaattaaaagtgagataagcgggctaaaaaaaacccgcttgcccaccccgcttgaatccctatgaattacatgagctcgatccctaacccaagccgccgcctccctccctcccccaccccctctccctgggctttgcttgtgccagtgagccccatcacataggtgtactccctcacgctcttgtctcttctcttatacctatacctagtgagatgactccgtcctgcctatatatttttttttatttctggtgacttacactatcgagacaccaccgttgcaaccacattctaatcactacaaatccaacgtcagttcccgccactgactttgtccatcgtcctcttctagcccctcaactctggtggcaatgtcgttgtatgtcacagtcttgctgcatgctcatgttcaccacctccttagccatccctataaagttgcccacaccgccccctaccacttcaccaccacccaaccttaaaacataatccatatgtcatttgtcgagttttgatgtcatcgccactataggttgtcgtcaacgccatcgttaagaagttgttgccgccgttgtcatcattggtgagtcttttgtcatgaatcccgcttcttcctctccccatgctataggttggaatataactttataaccattggatttagatcaagtgactgagatttgaccatgagaaaatctttgtcacctaaaacctagcaatcggtcaaatggttaatagtaacaagtaatcttggaagagtttggtctctcctggtaagatgtatagtactcaatccatctcaatttaatcatcatctaatatttttgaggtcttcctcttcccacaataatcacactttaaaaagtgtattttcgtttaaactcagtattaattacttcttatgtttcaaaatataagatatgatctatccagatttataatcctgatacacttacattttgagatgatgaaagtagtttttactacccacatggccacatgatgttaatctttaagagaaatgagatgcaaataataagatggctggccggctagatcgatcttcatgagcgaataaaaagatgcacggcggctaacgagataggcccaaggacgtacggccggctgtcgtatcaacgttagtaatagcaagtttaatagtataacccactactagatctaatttatttatagccgatctaatagtcaattcatataatagttgcttactatactattaacatatggtcccacctgttatacacacattacgtctttgagtccgtactgtagctagctataaatctgtagtccgctgctgttctctcttatcttttatctcattaaaatatgtttatagctggttaatagtaagctattgtacctgcctaaccgcacgacgattagtagccaacttggaacgaattgaaacggcgactgcgtctcatcagcagcccatcactggagtagtagtgtaaagtggccgcgccatgtacgttaattacgagctcacacacatgcccatgtgagataattaacccatgcatgttgccctaattaaacaatggaacatatgagatcgagttgttgattaatccttgagccacaacaatacattatattatactacaattcatggactgaaagatatactagctagccatgagcatactgacatatatgatgatggctatagctaatcatggctcaacttttaggtaaacaacgtgccaatatttgatagatagagggactatactagctagtgtgttgaaaggatttctgggtggaaatggcctttttttctttcaggagatctgataggagattacgtgcaagtattttaaaggttatataggttgataggtgtacatctgtagtcaagctcaaatgtagctcatgcattctattgctattatcattatatcctattcaaggcatatatatagtgcaacaaccgtcaaaccgacaaatttttttttatgattactaaaagaagtaatatgtacattacgagtaaatttcataaaattatagaaccatgactttcacaaagcgatattgctctatcgtttgcttttcagcttatcagcaacaaccaaaatttactttttaaattttaaagttaattttgatgttttcttaatcgtattttattattgatggtaaaatcttatcttattcatatatataaagctacagatttaacgtaaaatttatcatagaattctactccctccgtcccataatataagggattttgagtttttgtttatagtgtttgaccactcgtcttattaaaaaaatttatgcaaatataaaaaacgaaaagttatgtatagagtactttggataataaagtaagtcaaaaaaaaagtaaataataattcaaaatttttttaataagacaagtggtcaaaccgtgtaagcaaaaactcaaaattccttatattatgagacggatggagtatattatttaacctacactatgacaattcacaatgcactatcacaatcttaattcatcgcaatttctgcatgatctgttgacaaaatggcgacatgatgtgccggcacgtgcatataccattgttatgtccaggatgtacatgtagtactggagtcgtagcatctgtggaggccatatgctaccactgttacagattctcaggcaactcaacatccatcacatccatccgtttgtgactcggggcctatttggtttccagagacttattctaagtctatgtcatatcgaatgtttggatattaatttaaagtattaaacatacactaattacaaaacctatttcataaccttggactaattcgcgagacgaatcttttgagtctaattacgctatgattttaacaatatgatgctacagtaaacttttaatgg

SEQ ID NO: 64301 - DNA, 1672 bp, Oryza sativa
aggtcctaattttctttttgtccttcctggtgacaagaaaaggagaattaagcagccgtagccctgtagatccttttgcttgtactttttctttatcaactataaaaaagaaagaagctggacaatgaaaagacaaaaacaactctaaagttaatctaaaatcaaatcctaaaatttaaaatcagcttcatgttaagcgcacacttaattatagacccactggctataatttatctcttaatttcagtgaacttttggctccaaggagctcaattatttagtgattacctgctaaataaagtaagagttccacatgattccccaaaattagttaatactacagtacatggttgggtgtgcttcaattcgtacggtcgaacaatagtatacagtggcatctcttctgtctctcatcatcctataattatgctctgagcctattgatgctgatgcaccaatggattattacctgcattgtctccctatctctccattgatcgatgcatgccatgttacacgggcaattttttttttgaaaaaaaaaaagccggcagagttgcacatatatttattgtattttctgttcaattggataggcaattgggcgtatgatctcgatgcggttttatctagcacacaagccctccactctaacacaccagcatatattatccgtaagtttgtaatgatttttttaagagaacattatcatcaatccggttttatcatcacattttatatacattgttagctattaattctgcatatacttgttaaactggccaatagacattttggtctcgtgctcttatttatgctatccttagaaaaaaaagtaaggaattattggtggagatgggatgctacctaggaggaatggtatcgactcaaagcgtcatattgacggtatcctgtggttataatagcaactctgttttgggtaacctccactggacaatattttcttgaactccatttctaaaagaatttaaaatatatttgattcccttatatttttatttttaaaatatctgttgtgtcagccctccatcagatgggtggaggctggagggccattggagctcaatccaaacgcacgccagacagttgagatgtgagaatatatttcacttatatatagctaaatcataaaactgttaataaaaaatcttaattagtagactaatgtacagaaaaatcgtaataaaatctctcacggctatatatcctctcgcaccctaaaattcctccctctcaccaaggagattcgaattgagggacacaagccattttattggaggaatatttctaattattcctaagatgaaataattggtcatacctacatgctaattgctaaacgtatgaattgatgaatcatgcatgatttatgataattattcgagactacaaacgaactaattgacttattataagagttgaaaaattggcacgctgccctgttaatccataccgtacaatcctttgaaagaaaaaaggacatgacccagtggcacatatatatatgtcctccagtcaaagatagcacagtgtgaaccctcgtctactcctcccccaatctttgaaccctagcttgcaatatgcaggagatcgagcagctaactctacatgagcttaattagcttggaaaaagttttcccggtctctatct

SEQ ID NO: 64302 - DNA, 564 bp, Oryza sativa
aaactacgatatactccctccatcccataaaaagaggattcctagcatcccaaggcaaatttagtgagaagtaaaatgactaaaatgaccctcatcaatagaaaaggtagtactggtgataggtaggtaaagattatttaagagataaaacttctcgttttatgtgttgaagataggtaggatggtagaagttggttttttgtgggataaaatttaaactctagaagttaagttttttttttgggatggagagagtatcaggcaaggtctccggttcctgcagcttgtccatcagctccttatgccacttgtctgggcaatctccttccatttgtagcagtttccatctttgcacccacgccagggctttgtagactacctgcaaaggtgatttagcaattttattttcaaaaacccactcatttctatttaaccaaatcccccaacagaaccaagcaacgaacacaattgtgaggtttgtttttagtttcttctttagcatcctcaagccatcctcaaaatcatttggtatttctgacagacccagagttactgtcaacacac

SEQ ID NO: 64303 - DNA, 737 bp, Oryza sativa
gctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataccaataggaatatgaaaatagctacaagatgccaattaatggagagcaaagactgtactatttctgaaccacatagtaaaaaaatttaaatgtttaaaaaaatgttgatggagg

SEQ ID NO: 64304 - DNA, 10347 bp, Oryza sativa
aaattgtacagtactaacagaggctaaccgtacggcgatggcaaattgtagaagttaagtaaaagtcgatggcatattgtagaacgtgacaaaatcggtggcaaatcatagacatgtaacaagtcagtggcatataatagattccctataataacaggaggtgtgatgtaaaaagaaacagtgaaatactaaaaggtttgttacgtaaccctttagaaaaacatttttctagccaatcaaaccaaggtatacatatttaattggatttacaaattgataaggacatcataagtattcctccccagtacaaaaatgcatgagaacggctagaaataaagttttcgagggtatttaattggtagttttttttgttagttatactttagtgagaaatgcttcgtcattataatgtctataaaattggtcgaagttgggtataggtgttaataaattaggcgtgtaagtagagaaattaaataagagaggtatgatcggttgagataagtgagtagatactcaattgctatattttgagatagactttagatgctagaaactactctattttgaagggaagaaaaatatgtattttatcattaattcaatttggtctttctttgacgtaaaaaaatagtacgaccattatttaaaaatgtccatttttgcaaaacttatttataaattgacaatggcttatttagctgaagataagacttgataattaatattttaaaattaagctatgccataagtaaattaaaatatttagctgaagttgctcataggtattaaaataagcctttttaaaataagtatatttcaaataatgtagacttacataaaaacactttgtaatagctatgccataaatagattaaaatctgatgattttcagttaaataaatctacgtgttaaatgaataatttattgaagttggtctaatcctgcaaaatattttgaaatttatatgttcatacaagtaagcacaggctaaaaagagcgcgccaattggcgcgacaattttctagttttatttaattcggtggcggacatgttggcaattcttataagtagatcggttgaaaggggtatgacacgaggagttgttccaaatttagttgataatgggttatcaatcctgcaatatgcagatggcactatactctttatggaaaatgatattgatgaggccaataacctcaaaatagtactaggtgcctatgagaaattatcaggcttaaaaatcaattttcataagagtgaaatgttctactttggtaaggccaaagaaagagaaaatgttttctctctaaggaggttttagaaaaggttaagtagttggaaaggacaatttttatcaactggaggaaggctagtgctcatcaattcggtcctaagcagcacgggaattaaatactgctatagggattacaacaaaaagaaattgaatgtagcacaggcatgggtatagcaactcatcaatataagcgaaacatctataatcttgttgatttcctagcccagcattgtcctgtgattcctgtgtgccaccggctaccttcagagacaacatcgaatgaaacaacattagacaagcacaacatggttggttggccagctgggggatcagttgagtcagctggtgtagtttggaacttgaacgccctacaataccgtatgtgtgtatctaacacaacttcgtatgtactccctccgtctctgaaagaagtgattcctagatccctaatgcatgtttagtactaatgtgaaaagacaaaaatacccttagtaactgcatattcaattatcaatgtcgtttctctcaccttaggcaaaggcatttgaggcaaaataaaaaatgccaaaatatttgaaaattttaacttgctgaaagcaaatactactagaacatctctccaattgagaaaataaattctctgaaatcacatgtaagaactactactactagcaatagcactataagaactgctactactagcaatagcaggaacatagcaagatcacagcttagaaaaaaggaatgcagtgttgtttgccttcagcaccgcaagttcgtgcatggagcaactgcatcagatccgccgatgataggcaaacaagtccccacagccaatggagccgcatccactcgtcgcctcagtcgctgacgatgctgcaaccactcgtcacctcctccgccaccgccgatgccgcgtccactcgttccctctgacgccgccgacgccgcatccacttgtcgcctccgccgccgcctaagggaagaaacaggagcgaggggaagcagcgtggagcagggaggggcgtgccgggaggtgtgggagggaggggcagagggggtaggaagcttggtaaggtctcgcatctagacgatgtcgtggcttcgattcagtcgttttgggaacgagaaagagatgagatagaatgagagagagaaatacgcgagagaccgcgtggaagagataaggttttttttgtgtgagagaagagaggtcaccgcccactactatggcccacagattatgcaacagagatgaagtatctggatttttgtgctggaatcattttttgagggacaaagtctccgctccaggaatcacttctttttgggacggaaggagtatgtatctaacacaagtactcactaaaagattacaaatgggacacccaaaatcaatttttaatgtagaaaactgacagaaaaacaaacactaatatgggaaaaaaagactaacttgtgcagaatagtgggatggcttacaaaactatgaaaatacaaagccaaagaattgaagacaaaatataaagctaataaaacttgcagtaccatgattagtagacagaactttatttaaatttaatttgaattggcaaacgaaactaacaaaattgacaaaatttcagaaatcgtcaaccattgctaatcttgttcaactttatctcaaaactgaaaactgtcaaaactaagtattgttcactcaaaattttgtgatgaggcattctaattactgacaaaactaacaaaaccatatgtactattaatagattacaaaactacaaaataacaaaagaatatttcaaaaattatctactgctagagaaaacaaaaaacataaatcatgcttcgtattcgagcaggtactagtaacaaaggtaacatcccaaggctgaaattttgataatatagctacatatgatcagtgctaacttttcgacacatatgtgccataaggaaataagtatgtttggagttgggtcagaaacatatataattacaatgaatttgcctttaggaggagagcgttgtggtgaacatcacccagttgtgcggcatcatgtgcccattgaacactaggaccacaacgaaaaagagatctgactattagtgcaatctaatagtaaatataaacagagttgaaacaaagaaacatcatcctccataaccacatcaaaccacagaaaaagcaggaaaaatagaaaaaaaatcagatttactgaattttcagaccttggccatcagaaaaaggaattgacataggaatgcacgttcaaaagagatgagctgctgccttgtccattaatggtgaaaataacgttagactcaagaacaaatgggatatatcaatggatgaaattcttctgtgctaataaaatgaaattgatggcaacaaacctgcagctgaatcccatgagctcctttgcaacaaatcccagcaaatatgccatgcagtagaatggcaaaaggggatgcaatatttgtacatttcacttttagttaccaagacgtatatatattcaatcgcaagaacaagaacctcttttacaaacacacaaactacataataattgttgctaattgtgcatcataatgccaataacaaaaacaaattagtttagtacatatagagtattgtgaaaaatctatcaaaaccttcatgcagattttctgaaaatctgctcagtacccacctagcaatctgatttgattatgctgccctgttatgaccgccattcctaatggatggatcatttatgccgccaatatattataactagtataatatgccttgaagcacgaaagatcaaaataattccaatgattacattttagggctattagttggaaaacaaaattcagaaccatatatctctggaaacaatgtaaacaacatatatagtagagttgaattaaaaatgcactttagtttggttggtttacccctgcaaatggtgataaaattgacgagcacttgaaaattgatggaaacaaacataaaaggattgtagtttctgaacatatataacacaaaacttaaatgattcatataagataatttttaaaatatctgagaattactaaacccctcctaaataaaattactactgggaaacataactacatagagaactaagaaactaaattttggcacgcctgcacacactgctagtctgatacgaaacatatgccatcaaaaaacataacagttctgctagtccaacagaaagagaaggggagagagaagcaacaaaactaatgaatattgtaactactaatttcctctgaaatatattaacaaagctatgctttattattacaaagcaaaaatacatgacaaattcttagttcaaatccttaattttcatcagaacttttagcaatatcttcttagttcaaacatatggtttgagctataaaccatcacactgctgccagaattcttaattcgaaaatatatagtatgagcaggaaggaagcaatttaaacttcttatttcatgctcagacaagttaaagcaaattaattttatcaattcagacaaattgagcacgtaattagtgagctcaaaaaatagtttcttctaattagtgagcatgtaacaactaacagaaacaagcaagattttcttctagttttcttgcaattagaaaatgacatgacatgcatcctctaaaacacaaaagaatggtgaaaaaagaatgctaacatgtcatgttcaaacgagcccaagaaacgagaatccagttaaaataaaacaaaaccttaccgccaacttgcatcctcccctccggccggcgggatcctttggtggggacgccagggacagagcggagagtgcaaaggaagagagagagagaggtggtgagagatagatggcgcacgacagcaactcatattctcccctctagccagctggatccgccggcagggagactagggatagagcagagaggaagaggagaagaatgacccacagcctcacatctagcagatcttcttcccctcatgtagctggacccactggcagggaggccggggacactggagcgacaatgatggcagcaacgtgcgtgaggaagccaacgactcaggaaggagtcgaggacgacaactggacatggtgacatgtgtgacgaagtaaggggaagcatggcccgggcagctgggcgtctcttcttaattgggcagagctttgggccaattgtctcctagtgggccagatgaagacgcaattccggccaacaagtcaaaataaaacagccggtagctgcctagaaaatcccataaaaatgttttttttctgttttcttttgagggggtaaattttcaactctgttgagctagatgttaaatggtttgctcgagacgatggatacaaagtgttactcttacttagttacaccctctgtaaaaaaaaactatcttttggggttgaatctgaacatatgctcgaccagattcgtccccagaagttgtttctttctttttggatggagggagtacgtattatgaccactctaatttaagcataaacatctatatttttccaccttctctcttttattgaagaaaactgaggatttacggttcgcaagagcattctcaagaggcgagatatgtctttatactaccagacttgagagctatgtagaaaaaaaaagtgatcttgaaatttgtcacatcccattcatacaatatctaagcaaaaaattgatgctaatagcttcatcacttagattccaattggttatgttgtggaactagaaagggttaaaactctggttttgagcagaacatgcaaaatcgaaatgcacagtgaaagtaaaagttgacaaagatagaagagaaaaactttaaattctcatgtaaaaatagtggacattttttcttgcagcttgttctacattgtgtattttgtgatagctacaagattgtccaacgttcaatctgtaacatttcttctaatatgcataacttgatagctttgcttgccttcctttaaatccatataagtgaaattgacctatttaactgaaatgtctttgatattatgtccatacatatatactttatagctttgcttgcttgccatgtgcatccatgtgtgcataaaccgctgctctttcttgagttcatggatcactttgatttgtacacaaataccgctatctagcctgccgtgcccaaattcttctttttctgaacaaactggcacaagagacaatgccaactctcgatttggtggaaacttgacacacacgatccggctttcgatcaacacaatccgaaccctgcaattgtagcaccatatctccactagttatcaaccgtgcactgctcggttgacctcgccaagaagactaatccctgcatgcgaatcgaagaacacaagcaagaacaatatagattgcaacacaattgcatatgaatgattaagcactcgaatttggggttctactaaccgaactagcagcgaaactgcaatgacataaataatctaagcaaaaccctactctaaactatgacggctactgaatgaatatgatttggggagtcctagggttgccctagggcgcacacccccttgggcttagcccatggcacaattataaggcccaaaacccaaatcagattcggtctggatgaggtgcgtggcttgttttgcagattcccgatagctcggtggggaattttgacgtgggaccaaaaccatcgaaaattaggctcaataagctttccaaccagtactcatgggcccttaaattccttctagatcagcggctaggtccatttgaagttgatgctgtcaggagaaccgaatccgaatccaaaacgtgtaaaactttatctcttgtcttctatgaaccaaaagtgtggtgaggtagaagtagacttggagaagatcttggtttggtcccgaatcaacttctttgatcatccatacattccttacgctcggtttcttttccttcacccaagcaagtatctctgcaaacgaaaagatacaaaactcatggtgtagtaacgtttgttcaaatatataataagtaaatctaacatagaacatatgcatctttggttgatgaatacataagttagtcatggtagttgtgtcctcatctatttcattagataaagcgcatggtcatgttctcaaaatcctacatttctgtttctaattaaaagatggcactacatttaatttgtgctatcattttgcatggacaggtgcaaaaaacatgcatgcatccttaaatactctcttcttgccaaaatataacaacacttcacaatttttggactaagtagcaaagacaaaagtctatcgtgcccctcattaaacacacgagacaactcttgattggcttaatattgtttgtcagctgttagactaatcaggtaaccatgagggagtggcgtgcaataaatcagctggtacacatgataattcaattacttgagggttgggcctattaaattcctataagttgttatttttaggatctaccaagtagtggttacgtttaatagtaccattggttttcttaaaaaaaaggagaaaaatattggaatggatggtcataatattttgttagggttatttggatatattatatagagtaaattacattggtatggtataataacttgataggtgggtgcaatacataaacttacaaaatagttgttttggtatacagacttgcatgatgcgtgagaaataaggctaaaatggtacattatgactagtaataatgtgttggaacctacattagaatagaatccgcatgcttaagcgggtcatgaggcatgctacatgtgcaaataacctctactttgtatttatttttgttcatccactattttcagttgactgcatatccttcatatcactagtacaaaaaacctcatagagatcggtactataggtgctgaaacagctagaaccggcacctataatgcttttctctcatccgtggactcaaaacacgtaaaaccgacacatttaaccaactataggtgccggttctaagaagaaccgacacctttaatatagtataggtgccagttttctatagaaaaaccgacacttatactataggtgtcggttcttctttaaaaccgacaccaataataaattataggtgtcggttttttaaaaaaaccagcacctatccaaaccgagccgagctatcgagccgagccgatccagctgatccaggccgacgcatatatcagtctcgtccttatcgcctcgtctctctcgcctctctctctctctcgcctctgagtgtagcgcgcggcggcagtcgggtggcgtcccggtggaggcaacaacggcggcaccctcccctccgccggatccggcgggaggggaggcagcgggcgacggcgggcagcggcacgctcccctccgcccgatctggcaggagtggaggcggcgggcgacggcgggctccctcccctccgccggatctggcaggaggggaggcggcgagcgacggcgggcagcagtgcgctcccctctgcccgatctggcgggaggggaggcggcaggcaacggcgggcgccctcccctccgcccgatccggcgggaggggaggcggcaggcggaggtgccctcccctccgccggatccggcaggaggggaggcggcgtgcgacggtgggtggcggtgccatcccctccgccggatctggcgagaggggaggcggcgggcggcggcgcaagagggcccgccggtgacgaagcagatgaagccttgggccagcctctcttcctccctcttctcttgtagattttttagatgttttggtggatttgtgaatgattttattggagtatgttcgcgatgtcaatcgattttggtgacgatgaatgattatttgtgatgtcaatcgattttggtgatagatttgtgatgatctgtggatgatttggggatttggggatttcaatattatttgggcgcatggcgacggtggtgctcagtgaggtcggctccattcgagccggctctctttttttttttgctcgagctaagctaaaggtgctggtttaataattgtcataggtgccagttttaattattagtgctgaccaataggtgtcggttgggaaaccagcacttatagccggttcccaaccggcacctatgcccctttttgtagtagtgtatatatttgatattatttctctatataattaacagccctattatacataggtttgattgagcacatgtacatgtatactaagataactgtgaaattgttatttgggcttgggttgcatgcaccaaactagtttgtgcatcaaattaaacgaatattttgcaagtttgtatactaggttgcaccttcctgttaaatttgtgtaccattagtataatttaattactctattttatatgtatggataatcttgccctctaagtaatttgtatgtatctatctatgtatatctatctatctacctacctacctatctatctatctatctatctatctatctatctatctatctatctatctatctatctatatctatattaattcaacactttctacaaatctatctatctatctatctacctacctatatatctatctatctatgtatatctatattaattcaacactttctacaagctctcgtgttaaccagataaatctggacattgaccaagtaaaccgtgttatcttagccgtagattattaattttcatttaataccgtggcctcatggcttgcaatacccatatatccaacctgtctccaacgtagtacgtattcaattttttcatacgtacatactattttggtgggaaatccgtttttacatttttttttaatttgttgtgacaccataagtattcccatgatagttttcggcactaacactggtagagaaaccatctttggtcggtcgacccatatccacaatagtcccggttccattaaaaaccgggactaaaaatgatttttagtcccggttaataagaggaagatctttagtcccggttgttgttaccaaccgggactaaaaa

SEQ ID NO: 64305 - DNA, 7834 bp, Oryza sativa
aacaagtcacttaaccaaatcttggcttaagtgattgttggacatgggatattattatatatttaccatccgtatatcatatctctagtgaaatatagatgtagttgatctcgagcgaaatcatcggcatgcagtgagagaattatttcattattcgtggttgagatgtgctgcacaattattaatattactcagttataacattaggagtatgtgttatgtatagacaatgagatactatcatatttagagtgagtactgagttggcaatgcttgcattctggacatgttttcatggagaaaaaaaatacagataagaggaagaatctgctgccatgtgtacgtatgcaaaaaggtctagcagattaattttatcaaattttgccatgttagaagtacaaaattagtacaaaagatatatatagcatggctatgcagattcaaactgagatcatatagatttccccccagtactgttgttgtaaaacatcttcatattatagcacatgaacataaaaacacctatatatgtatatattgctcactgttaatgagggaaagtttactatttgccaaccaataaatgcattaataattatttgctactacatgcacagatatggctgctgattatttggcatctagctgatcactactcccagtaaaatgacaatttaaccaaactatctgcacattacccaccccactacctaatcatgctaaccttaacttttcgcacagaaaatcgactcctttccccactaactagttgctcttgtctggcaagaagaaaggatttgcagagtggtgcttaacccttcctgtgtctgctccacatcaaatttttttctaattttatgagtatagctagtgctgcgaaaaactatatgcaaccaaagctattttacttttatatcataccatgattaaattcatgttgtgcttttggccatgactagatgtggatagcatttatcgttgcgtattgcattgcctttaaacttggcctaggggttggcgaaatcctaggtttcctgcagtgacagaatccctgtcattgtaaaaatcccagcacacatacatccctactgacatcttgtgcaaggaaatgtatcttaatctcctgcacaagaccactgtgacatgtgtaggggtaaagtcgacatgaattacggtgtcccgtgattatcagtgggtaaagtttggagaaaattatatacaaaaaatgtttcattaggggcacctatggtggcgtgaagctagctttaaactcgatcacatttccagcacaaggccccccaacgtgtgactagcaaacaagaaaaggaaaagtcttaccaaccatccaaatgataatttaattacaagcttgcaaacaaggctcattcaccctttaattccagccttaataggcgcccacagttttcctaatgattactcttgtgcatgtctcgtcactgctgtctcctcccccacaaagcaacaaacaggaagtgaggtagagtgagattaaccggttgggtgaactctcaagggatggaaaagcacaaaaaatcagaagagaaactgacattggggtcatcatctatcccctccccatctcaaattcttcttcttttgggctttgtgtgttagtgcatgcatgcactcatacacaatggacgatagctctatagctgttgcttggagatatatgatagagttgtgtcggagtaagagacaaggattgatacggcacccacagctgcccatccaagtgtcagtgatgagttggagatgcccccctagctgggtgctataaatacagccctttcttggcatccatctccatcaccacagaggctttgagtattcattcatttgagtgaccctatagtgtaactcgagcgagtgagcgagtgatatttgtgtgtaggctgtagctagcgagctaggacgatatggccagggttgtactttccactcccatagtgaatggtgcaacgatgcacctccccgctgtgggcatgtcacaccccaccgagggtgagcttgtcttccactacctctatcgtcgtgccgttaacatgccgctgccctctgaattcatttgtgatgtcaacgttcttcctcataacccatgggacatcgtcccaggtaagtatattttgacttatgctgccatatcatcttgctcccataaaaattgttagcacatccagatacatctcgaattgattaatctatgtctaccaggcttgattgattgcatggcctaatgtccgatttgttgttggttttgtttttgtctttttctctctcttgttccatgatggtgatcatggacataggagcactgacatagagggagaaagggaagtacttctttatgcagaaggagataaagtgccctagtagtcgccgtagcaaccgtatcacaagtaaagggttctggaggtcggcaggctcagaaaagccagtctactacaaccagggaggtggcagcgactgcatgctggtgggaatgaggcgcaccctaacattttactttgggaattcacggaccgcagagcgcacaaaatggggtatgcaagaatttcgccttgctggcaatggtctttcgccttaccctgcgatgaagcatgccaccggggatggctcaaaaccaccctgcaactgtgccgaaacaaccatcgccaaggtaattaagatgttgacttcaaacattttcctgtcatcattttttaatcgtcttgttcgtttcatctgcaaattgaatctaataagtttgttattttcgagcaagtgtactattgtgaggtttagctttgggaaatagggagggggatttaataaatatgatgagccgtcttctagatataactctcatgtcgattttattcatggaaaggaaaaggtagagattgtctttgatgccgcttagggtacatgctattagatctgtagttatggactgctgcgatgcaaggaacgtgggatctatacatgattcaaattttgtcgagacgtagggatttatagttggtaaaatctagatatgtatatgtgtcagtggggagttccatgcatatgtgtcagtgggatcgagtcgatgtattataaattttgtcataaggttagatctggttacgagatctataatcgacttgaatttgacaagaagacaaaagtggtttgttgtcagcttgcgagcaatgaacctatttaatgaacaccatgtgttgttaactcgtttctcccatgatttttggagttttatatcagataatgtatcaaccatttattggtcaaattttctgtgatgttcaaactgaacaatggagaatactcattttccgacatcaggaagaaaactgataacaaataagttaccatgtctttcaaattcagtagctatgttattagcatccgtatataacatatatacaaaatattcctttccaactaatagtacttcatcaattttcccttaggtatacatcttacatataccatgctttgtgcgttcagcagcatccattaacaggcaattcggtgactgttttgcagagaaatgatggtctctctgcagttcttcgtaatgtgctcgccgtcaccccccttgtggaaaccgttgtcgaacctgatggatcatggctgatctgccgcatctacaggacaaggcagcgtgcattgcctgttatcactcctcctgccatagaaaatgcaagggaaatcattatccctcctgccaatggcaatgcaagggaggctcaagtccgctttattgacttcctgcagcagggatcgcacattgagtcatcctccccctgtagttgtatagttggcccctctttggcagagggaagtgatgaatctgctggtagtgttgaccaaaaggattgagcgcaatggagggagcaactaatcgataaaagcatgtcaactagtaaggaataaaaattgtgagtgaggtgacctagtgcaagtatgacctgcaagttatataagtactgttggagactgtgttctgtttaagttggggaactgtatgttctgtttaagttggattgtaagctttgttcaatagtttcaaggaattaaagcgtgtttgggttctaggaggaaaacaaatggtcattccagatgaagaagtctgagtaagcaacttttctaaaaaccgtttggtctgtccttcttcaatatattgtgttctgtattatctcatgcctttgtgtgagactactagctatctattaatatctatatgcttatcttccaccgtatatatagcttcttcagtattcctgttccgttgctgctctgtgcttgacgttgtcgatatccaccatatgagatatgtccacaagtgtaggcgtgtgtgtgtcttttgtgtgtgtgtgttgtttgtgtgtgtgtgtgtgtgcgtgtgcgtgtgtgtatgtgtgtgttgtgtgtgtgtgtgtgtgtgtgtgtgtgtgtgtgtgtgtgtgtgtgtgggcttgaagtgattgtatacacaagggaggtacagagtttccatccatatcatatctaaacttgttgaagtgaggattattacatcttttgttgtagcaccttgcgcgtgctgcaggatcactcgcaggcgacatctccatcattgcaggcgatagattcacccgcctgcaaaaaacatttcagcgaataaaaaaaagacaccacccacgggcgctgccatgggcctccccttccgggctctcctatgtccaccgacgcccgtcgtcgtcaccgttccatcggggaaggcaaggaggcgcggtggatctggagattggcgacgacgtacggcgaggggttggccggcgatgacgctgaggcgggatccgatgccggagagtgccatgatgctagattgcgtcggatggaactgcaagttggcgtccaggcgctgggcctctgcagtggcggagaggaagtcctccgcctcgttgacgacaatcaggcagagcaggtcgggcgagccgccgagtcacgcggcgaggaggcggacgagcaccacccactggttggcgtcacaccgccgctgaggtcgacgacgtggatgacgccccgcttggcatccatcaccttggtgatggacaggttggacacggcagcggcgagccggatgatcgggcacatcgcgtggaacccttggcgcgtggtggagatggttgccgacggtgtggcctgcatgagatggagggaacggcacaccccgacacatggtaggatgaaccgcagtgcaagcacctcggcgaacggaggacaccagccgctgcatcgaccttcccccgccgccgccgccgacgaggtcaacgacgctacgcagcccatcgttgacttgcatctggcatgtcccatcggccaagaaggcggcgatggaccgcagaaacctcaccatgagaacgtcccgttccccgtcactagcaaggtactccgccggtccacctagggaaaatgagtctagctggatcccagtctctgccgccatggctgccaaggaggaccccaccatcggtgcttccccatgttcgtggcggccggtgaatcctccagcactatggccatcggtggcgctggtagccactctccccttctctctgcttcgtcggcgccagacatatgtcactcgtcgtggccagcgacggaggcgacgatgaggggagctagtggtggaggcggcgaggaggggagccagtggcggaggcggcgaggaggagagccggcggcggatccatcggtgtcgtcgtcatcgctcatcgcggctggcgacagaggcggcaaggaggggagccggtggcggttccgtcggcgctgtcgttgtcgctcgtcttggccagcagcggaggcggtggggaggggagccggcgctgttgtcgtcacggtcggcgggggaggcggcaaggaggggagccggcggaggatttgtgcgagtggataaatgtgagagagagagagaggggagggggagggaaatgagtggtggagaggatagagatggcggaggagatgataaggatgagacttagatattttttttgtggcatgatttttgcaaacggacaacataaggttccgcctgcaaaaatcatagttttctaggcggacctcttaagtggttcgcctggaaaaattgatcttcacaggcgaacggcgagcttcactccggtctacattttcgtaggcggccatttagctccgagggtcatatctgtttggaaaaaaaccaagtctgcgaaaatgctttttctagtagtggatataattaatattccctccggttttttttatgttggtaaactcatctttgaactaacgaccaacgtcgttaaaaaaggaagggagtattactgatctatacaattgatgagttgtagataatcatatatattgctagacatgaatgagttaaaattgatgtcaagctttaattttgtgctactcgatccaaggcatgttaatcagtgtgtgcacgtacctgctcaaaagttttctgcagctatagccactaatctatttggaactgcttgtctgcattcactattaggatgtctttaatggaaaaaataggaaggaaacaaagaatattattgtgacatgcatacatataggtatatacgtgcaaactatagctgagattctatcgaatttattttcatattacaagtacgtatgtcttgatagatagcatagctgaatgcaggtttgaaagccttcaaagatgtaatgtgtatggagcgaggttgttatctctggatctagatttagatatcaccttccatgccattctcatttctcttaattaaattcagtatgttctagcatgctgttttcatcgaaattgaggctcatcatacatgtgtataactagttattttgcaaataaggtctatgttaaaaattctgatgatgcaaagaaagaaattaagaaataacttcaacataggctccatttaaacctaggatgaatggtggccttggtgttttagagatttgtagctgcaaagtaagggtctcgttaaacatctgcacatgttttacaacttgcattggctcatgtaccatgtgtaaaattcatttgggaaacttttatataacagcgtaccagatatgtcctcaccccatcgcactttctgatggaaacacgttcttcaatttggcattatctttattagaggccgggatagacaaattcttggtgcacatatgtcctcaccccatcgcacttttggaatgataagtactagtgaagagcaatttccttcccatggccttttaagctagcctctatgcagctgaccatcactagtttaaaattatcatcatgtgatcgaatacctatatatgtattaaggctagttacaattaattattacgaacaagcatgcaataaacaactccctccatgacaaaccaaacactagagacaacacattgtattatggtaaatgctgaccttgattgtgctatttgcaactgagaaattgtagaagagaacagttatttttccgtgtcctttctgtgttgcatgccattggattcatatggagttcatgtcatcagaacaccctcgcactcacttgatcactgataaacctttagtctgaagattcccagacgatgaacagtgatctgacgaaactgaaaatctgaagaaagaacagagagcgagctagagcaagtttgttcgttccttaatgccttgcagtttttcaggtttacttctccttttcacctcccatccaggtgtttgacatatatagatcttgaatgaacggaacactggatcgagtgatcctgccatcccaccatatttcttccagcctggcca

SEQ ID NO: 64306 - DNA, 22550 bp, Oryza sativa
caaccgggactaaaaattgatttttagtcccggttatttgaaccgggactaaagatagcgatctttagtcccagattcgtagtcccggttggaaaaccgggactacagggggttacgaaccgggactaaaaagcatttctccaccagtgtaacttctgacatgcgctaactgcttcgtctgatttgagagattaattccaagaaactataaaatacactattatttggaaggtttaattgcacctattatttgcaatatgtaatttgatatttaattatcgtgtgttatgcccatcgtatataaccatgtcgctgcagtaacatgtaccatgtaatatccaaactgctggcaaatatcgaaagaatcttccaaacagggagcgcaagatgcatctcgagaggagtatgtatgctgatcacactcaaactttgtcaacgacaggacacttgggaactgctccaacgtccttcatctaacgctgttgtgacggatcggagattatggttcagatttatgattgtgacaaaactcactatatttccgcttggtcagaccccaaagatgcagattttctaagtagaaatgtgataaattgtgtgggacattatatatagtagaaatgtgataaattctgatccgctggtgtgattttgtaatcgtataatcaattcatctgatgattctccaatccgggccattggtctgatcttcataaattggagttgagctgccgacggctagttgtattttgatggacagttgctcgggtgctattttttcctaatataaagactctctggcttaacgtgctatttttctccatatttttttaccttcaactatttttctctatataagattgatttctgtacttgctaaacaagtgtataactcaattattatctaatacaagttttataattacttcatctaaaacctaaaattaggacttcaaaccgactataactcaatatttattaatgagtgcagtaaattcgagaattattaaatcatgaaaagctctatttgatgctccaaactaactacaacctgtcatttctaaaatttcaaatttctgaattaatttgaaataccacaaataatttaaacaaaaaattaatgttttgacttgggcacgactacacatcaatatgtactaattttcaatagtaaaattaaaactattttgtccttaataataacaacagtggtaaatgaattctatatgtataacatgtaattataagagagaatctatgctataccactgagtttgttggagttcaacgatttaccatcgactttgtctctttctataatatactggcgactttatcaattgttctacaatacgtcattggactggaccatcttttcaaaaatacccaaaatgcccttagagacatgcaagattaacaattgatttatctcattagaagtttaaaaaaaatatgaaatttttttatgtggcctccttacacaacatggaagtttgtgtacaagcttcaagttttttcagtatattatgtttttagaagaaaatattgttatgtggtatatgagagagaatttgcttatacaagacataatatagcacaaaaatatcttatgtagtgtatgaaagatgatttatattaaaaacaacaataaataagtattttatatatcatataacagataagttatattttttaaaaaaatagaaatgtaaaaaacttaaaacttctatacaaatttccatgttgtgtaaggaggcgatataaaagttttcatattttttctgaaagttcaaattagataaatcaattgttaaccgtatatgtccataagtgtattttgggtatttttgaaaagaaggtctagcccgatggcgtattgtagaacaattgatgaagttgctggtatattatagaaagcgacaatgtctatggcaaatcgttgaacttgaacaaactcggtagtatatatagaatatattatctcttattaataacgcaatattcaattgttacattttgtaatatcagtattgataacacgtgcaacgttaacatattgatttgcgactagtttacatattccttcggtaatacatatgttttattctttccacatgtaacgccatcaatagaagcaggctcaactaatggcacatcctcaatattaataatgttatggtggaatataacaaaatgaccatccaatagatagcattacttgtacttttccgttgctttggtgtcaccagatcactatgtgttactcatgccatatgtcaagttctcccttagtacgttgtcaagatactttatatagctatctacaactctacacatgattgtttgatgatactctttgtgcacaaaaaaaaaaaccttctcatgaagataaagaaaaacatcccccaaagtgatggatcttgcctgatgatacatgttatttgtataccaagcataaacaaaaagaatagaaatgttagccccagaagctatttcactacttttatcctttccagcaacgttacaattgtagatggttttattcttgccatatcttttgttgcctagacggtattaccttaatgtgatcttccttttgttttatgggccccacttcctttccaggccattccactttacatttgcatttcagtttctgaaagctaataccactagcatccagtctgctcatgtgtaagtatgcatgtgtacaaagcattgctctgccaaaaagtaggatttacctaatgtcatgggcttagtttgttagtgttgtttgaatgtatatttcttttaagtagtgtaaaggaatatatagagggttctaaggatagcacgcaaactattgatagacagcttaagcaaattcttttctctttttgctaagtagccaagtcatgcatagctagttagcaagatccacaccgttggtattgtgtagctattacaaaaattttgtaatatactactttggttgaagcaaaagattccttacattggtatagaaaacatttgtggaggcgtctgataaaccttttatataggtgtttccccaaccgcctgcaatcaatggcatgtgaaaatcagctatttacaagggtggaaagtcagccgcatgtggagaaaccttgatacaagtggtttacttaagataaccatgcatggaacatcttttcatgggcagctcacttaaaagaaccacccgtgcaaacacttttcaaggtggacgactcgccaaacctcatgcgaaaattgtttgtcatgggcagttcagttaagtgaaccacctttgtttttatttgaacagatgcagaaattatttatttctttattcatcagtacccagatgtttcattacacattgtattgactcatctcataattcatatcattatcccaccacatatatcaaacagagaaattggatgcaatcctctatttacaacacatcacaatccaatgacatgattatttacatcacaatgcaaccacattatcatgtttcaaaatcaaataacatcaatagtttgagtgtcatgcacataggtaggcatccctacctcccaacaataaagtgactcatgcgaggcaacgttggtctcatagtcaaaatatttatccctcttgttgcaaatcctatggtggatgaaccggcacatgtcattttgtatgacagcaatatgcctatcattgagtgctccactggttggatctacgggccgctgcaatgaaacaacaacaaaaagagctataacattacagtcacaatagagaacaatataatcaatagccattgttcaattaaaaatggttgcatacttgtcttggttcatcatgtacctcactccaacccaacaaactcacaaacatattgcccacaacgatcagtaccactaggttgcttgtggcatttcgtaaagtaatgcatgtaattcattatcatacttgttcctctgatcataaatattgaagaagaatagttagaaatgttgtcatatacttgtccgttatttcatttgggtgcaaggcacaacacatgatatttggtttggtgtatttggacccagcttgctcaatccatagaggggggctagttaggacatatttcatgcacaagaatggaaaataaattaaaatggactgaaagccccctcccaattggaaaaaatgtatcagtctgtataaaggctggctttttaaaaatgtgcaatgtttggagcagtcatcaacgcctatcaatttctctctctcctagatccattccccttccctcattcatcatctcttccatcacattgaaatgttgcgcacttaggccaaggccttttaaatccccaagtaagatcatgactcaactaggcctgttagaccagtctctttcatcaacactgtaccactcctttagactagctcatttacctgctatcattactttagattatgctctaccttgtttgaaatagacagctctttactaggccttgttgcggaactatttgctcatttttacgtaatgaatgccgtagcttcaaaaattcaatgatttgttgatgcatgctcactctttttatgtgggtagacctagtatgcacaatagtatttggtgtatgctacttccctatcatcattaaaaaaggttatcctatacttgttatgattggaatgcttaaatttatatatgttggtcccaacctatcttagtaaggcaggccgtatgtgaaaaattcttttcacaggctagcctactttacatagctgcctgagtaaatggtttattacatgcggttggaccggccgcgtgtgcaaatatccattttatagacgctcacaggcggtcttgttggccaacatgtgaaaaccaccttttgctgcctatggaaatggaatatgtagtagtgactaagctctacaattcatgagcccaatattcaaatgcatagaagcccaacaatcaattgccacaaactgtcttcatcaaaatttatagcgtcacagctcttgcatccatgtaggacaacctgtcatctttttagaaccccttgttgccgtagtccaccaatataatgctgaacttcatgccctacctctaagacaacaatatgagaagattgcacataccagctatatcttcaaaataacattttacatattacaccgttatttttcacctcatgataagcatgagagagggaatatgtggacatgatctaagtcattaataacgacccaccattaaagtttgagaatgcaaatctcagtttaatttgaaatgaaaattcagccatgagtggcatgtattaatagtattgaattttttgtatcactttcctcaatttgacgttggtgtccactaattttaggagtacacacatgtttgtgttcaatgggttcaattaactctcatcattcattcttgtaaaattgaatgtctagaaaatctaacattcaatggattatccgtaaagttgtgtcaggatcctgatacatgggtgtctgataatccctccattgtgctccagcagatgccatgctcatatggtaagtcttaattttctagtttaagtacctaaccattaatttccatattctaaatgttcatatagttgtgtcaaattactaacatttgtaatgatggcctaacttaatctgtcatatttttagtggatttccaaaggtgttctaggaagtcgtgtcaaattactgacattgcaacaatgatggatcaacttaattagattatattatatttttttatggattctaaaaggtgttctctagcaagtatagccacatgccatatttaaaaataaaatactactttcgtttatatttttaaaacttaattatctgtcttatttaaagtttatttccccagattatttaatctgcagtgcttttctcatacagtttgaaattaattaaggtacttatggctaaaatccgaaactctgcgcacaatcaatcatgtgataattccttgtttgtaaagtttgtgcatatagatgcatgttgtgttcataaaaactatatatagacttacttcataaatctatctacgatgaattttaaggagatcatgtctacagttaaattgacaatgttatatataggacggcgctatgtagcgctagaagctacatagcgtgactcaggataattcccacgaccggttttccctcgttcccccttcattcctggccccatggctcgtctcagtaaaaaaaatattcccacaattgttttttcagttccaatagtggaccgtgtttttatccagacactcgtggtgtgactcctcccttacagagatgtgagattgacgagtgggcttaacctttagaatgttaattaagaagttaatgaaataaattaaaagtgagagatatacttaacacgttaacagggcccatccattacagaaacctaattaaaatctttaacgaatatttttctctccatttcatgaaagcagttggcccatgggaaaacttgtctttaataaacattatatctccatttctttcttatataataaatatgccacaagtgaccagcaaccaattatcaattttttgcagcacactccagcagaaatgcattcttgcagtaccctccaacaaggagcacaaacattaggtgtcttatagcaaaatttgcctttagatgtaatgtgggaatttctagtttttctgattaatgagagaatttatatcttgtttatgttttagattaatatgtatggattctagtagacctttccatctgtatatataaagatgcagcccaagttttacagttctgtcaaaaagatctatactactggaccattttttatggtgtgatctctatagtacctaaccttaaccaaatgaatgcttactatagggtgaaaagattagattggtacacaatatgtataatatgtctgtagccttttttacccaatacaaattttcaacaataactatatatgacaattagtgcaaggtaagaataataacaaaataaaatattactaatgaaaatggtaagaataaaaaaagagactaggacaaactgttgcaaattttctatcaatattacgaaatattattatcttaatacccaaaaaacattaaatagataaactttaatttagggacaacaatgcaaaaattagaaggaaaattcctttttttttcatgtctacccctccatgttaggattcttcacaacacaaaccttgtggtcccaccccaattaaactcatattctccaacacaagccccctatctttttactaggaaacaaaccccaaaaagctatctaacaatccaaataaggacacaaataaacatgcttgcaagcaacattcacacacctttaatttcagcctcaataagcatccacagttttcctagtcagcatggttgttcacatctggtcatagttatctctagcccccataaaagaccaaataggaagtgaggtagagtgaaattaaccggttgtatgagcttccaagaatggaaaagcacagaactgaacaaaacatggcattgggattctcatcccatcaacacaaacctcaatgctatctcaccagccatatcttggagatagagggagtgtgtgagggccagaaacttgcaaagggagaaagtgaggttgaatctccgtcacgtcactcacagttgcccatccatctgataaaggggtgtcccctgggctctataaatattgtccctctttgcctccatcaacatcactgcagtgcctttgagctttcgttctctagagtgtctagggtgaatcttgagcgagtgagcgagcgatctctgtgttgtgtagtttgtgagctagggtgatggctaacaccggacttagcatccccatggtgaatggtgccacaatccacctcctccctggtttccggttccgtccaactgacgatgagctagtcatcaaatacctctacccccgtgcttttcatgtgccactgccctgtgcgatcatcaccgatgttgacatccatcatcacaacccctgggacatcgtcccaggttaattttgatatgcacttctttgcttctatgaaaattattaccacatccgtctgcatatatctctgatttgactgattaattgcatgtgtgtcctgacgatatttattctcttgttttgtttatcatttttttcgtttgttcgttggcaacgatctgatgatgaagtggcggagagggagaaagggaagcacttcttcacaagaaaggaggtcaagtaccctggtagccgccgtagcaaccgtgttgctggtaatggcttctggagagcagcaggctcggaggtgcccatctattacaaaccagaaggtgctgctaacgacatgctagttgggatgaggcggactctagtgttccactacggaaagtcacgatctgcagagcgcactgaatgggccatgcatgagtttcagcttgctggtgctggtctccttcctcaccctatgatgaggcatgcaaccagcaatggttcagagccaccctgtggctgccttgaagcgacaatcgctaaggtgagatgctacgtccaaaaattttactgttccatttatcatgattccatctaaatgcctgttgaattaaattgctcaattatttggataggttggattatgagttttagctttagggaatggggaaaatatgatgacttagtatacgtgatgatatactataactcttgtgttgatttattaaataagggaagggtagttgttttcgatcttaggactaagggtacgtgacgcttgatatagggttcatttattgttgccatgcaagatgcgcgggatctagaagtgattcaaattttgtcgtgacaaggaatctagaggtggtgggcctgctgatttgaatttgtcatagcctcacatggttttccttatgtattactaggatgtaatgatgattaattgattttgccgtgaagcgagatctagcggttacaagatctactagtgattcaaatatattgagaaaaaaaggggtttgctgtctacttgcattttcagtagggaacctctttattgaacaccacgtgtcatgatacacttgatactgggatatttggatttgtacatctggttttaatttgatcattgccacaagatttatataagtgacatgtcaacagtttacttctcaaattagttgcaacattcaaactggacatgaagttatcacacatctttctaattcagtccccatatgatttgtcacagtaagaggcttataaactagtttactataatggtcaattcatctattctctttgttgtatatgttgtatataccatggttgcaccttaagtagatccactaacagacaaaatggtgtctattttacagaaaagtgatggtctctctgcaactcttcgtgccaagcgtgattctgcccctcttatgagaatcatggtagaacccgatagctcatgggtgatctgctgcatctacaagaagaggcagcgtgccccgcctgttgttatccctcctgtcattggcgatgtaggggaagctatcatccctcatgctattggcgatgcaagggaaggccaacttcacttcattgacttcctggggcagccagctcgcaatgatccatcctcgccccatagctgcaccattgacccctcctctttggaggaagggagtgatgagtctgccggtgatggtgaagataaggatggtgatggcatgaatgaagcaaattgatcgagtgtgaaggaagtgaactgagtctcaagaataaaaactgcaagtatggcgctccattccatggaagacctgcatgcatcctatatatgtgcttttatgttcaagttggagaactatgtgtgttgtctttaagttggagtactctaagctattcgatctggagattatgctgtttttaataaaagtttgaagtgtatctgtcctgtttaattagtttcaagaaagccaagcgtgtttgggttctaggatgaacaaagtcgtccaagatgcaagaagttctagagaggtagctacatttctggaaattgttgcatcttcctttcttcaatatatatatattgtcctatttcataatgtcattctagccagctatctatattctatatatccatttccgttgccatactttattcactatgttgcatcgagtgagctgcattgctctgtactacatgttacttgatatgtgttgttcataaacacacacattaataatgatcagattgtgaaaaatcaattctacggtccttgaggaggtaccatgagataccaaaaatttagtgtaaaatttggtatctcatggtacctcatagtatctatgtaccaagaggtaccaaatttacaatagaaaaagtggtacctcatggtacctccttaaggaccgtaaaattgctcattgtgaaatgcatgtccagaattcacttaccaagtgttcggaaacaaattcacttaccacgtatctgggcttgaggtgatagttggacatgggaggtaacagagttgtcatccatatcatgtatttatttatagtgaagcaagcattgattcatgctgtgcaaattagtcgcagtgagagcattttctatatattttgtggcctatgtgaattaggagtaatatatattaagttggaacacctatgtgttataccgaatttgaatgatatatcaatatagatgaacgaataataataaaaattaatgacaagtgtgaattttgtggcatagcttcagcgttaagtccctaaatttagaggtaagttagtgtactagtaccgtcacttcttaaggtgctccaagtttttctctgaccgtacattagactaaggtccaactgtggacacagtctcttacattccaaaagtaataaggacagggataatattcattattaggaacacaattaataaggtaagtggagtaatttataaaatgatattaaatatttatgctgtactaatttacaaatacaccatggtaattatatgtttaccctgaatgcaaatttttaatggcatttcaatcacgatcaaatggaaaatgcaaaatttcaaatctgatatgagaatacaaaaatatatagacattgcgaaaaactaatgtgcaactcttaatttaaatatagagtgaaaagtttgcgatgtgctgctgtttgaaatatatttacgtgtgatttcacacattaaatttaagcattaatgggcatccagatcttcatatcaatatagataggctaccaaagttatagtccttaatttcctgcgtgcatgattaaggttgggaagggtaaataataggtgctaatatttccttattctgttgtgatatatcaattgaaaggagcaaatatttttttattggaaaatgtatacaataaccaagtgctagaccaattgtaagttggagtacggtaaaactgctctgaacccaatggttggtggcttggtgcagctagtggtggtagcagaggttaaatgcttggaaaggttgatgatggcttggttgaagatggagttggccgctgatctaggtgaacagcacagcagtgaccaaccctagacgagggaaagatggatgttcgtcgggcactaggtgaggtttggagaggcggtgatagcggcaccagccaggctgagtaaggatgcgacacatttatgacagccccactaggaggagaggtgccggcaaagctggttgatcaatttgatgaagctgcacacatgcacttttgaaggagaggtagggccttaggggtgcctacatgcgcagttggatcttgacgtcactagaccaccggcttccactagccgcttcacggtgcacaaaccatgttgcctagcaccctgccaccacacacatggtctggagcactgcaattgttggtacctggcggctactgcttgaaacccaaggtcacactatccagtgcatgcactcacatccgcttccctctgccacctaggcatactttacagtcaacgccctactaggctcaccaccacgcatctccttaatataatgtggaacaatggaaaagatgaataaactaacatacattgtttgaggacatggatgccgccgtctccttctctgcttcttttggtgccgttgtagatgtgcatgtcctgaatgtgagtatacctacttgataccataggtgaaactggcgataaacgagcggatgatgccataggtgccactcgcactgccctagaaccacactatgggtcctctctagcatttgcttaggatcagtggtggtatggtttatgaaggagtttgaggaagtggagagttcttcgcctgtccacaggctgagctctccttattttattgcactcatagacttgggggtgatcccaatcaggacattatgctgctcccgatcatggtgaaccaacaagcatgacagaaaaggatggacaatgcgccccttgtgacttggtcttggttgttaatcaagaggatcaaccaacaagaaaaacaatatcctacataacataggcatggcatcaaggagacagcaaccctggccccatcgatcttcgcgatggccacagcatgctgtggaggaagcaccgggaaggagggagagcaaggaggtggtgctcgattaaaggttaaaaaggatggaggagagtgacagatctagtcagttagggcttctataagtttttatactcctcagtttataggtatatatatgtatatgtatttttccttcttagtgaaatgaagtgcaactctcatgcgttttctaaaaagataattacagttataggcttgattatttaaaattgtggatggttattttcaatcacatggggggacaagtgctaaaacggtgtcactagtatacggatcactgccctgagcgccgatggcaataaataaattgtagaagcaacaattaagtaagtatcaaatagttaactgcatatctttgggtggcaaataattaattttatagttaatccacgcagagatatggtccactcattattcacaacaattaattttgttactttctgtcatctttgtgatggatttagaactcatcatacatgcattactggtaatttggaaagatctatttgaaaattttgatggttcaaagaatatatgcataaacttagccttagccttgcagcggccggctccaactttacgtagatggtgctctcatatagctcaaaataaaattgggaatacagaaaggcatagtctagcttttgaactcacattttcctgcaccccctatctttattctagaaacttaataaggccaaaataaaaaaaagcttgccagttgccaacaaggttcacacacttttaatcccagccttagtaggcgcccatagttttcctagtcagcactattgtgctcatctcattgctgttatcttctcccaaataaacacaaaaaagaaagcgagagagagagagcttctcaaaaggaattgaaaagcacaaaacaacagaatatataactgacattgggattctcaccccctcatcaaccctggccatctttatttcttcctctttttggactttgtgtgttactgcatggattcatgtgttgcaacaccctggatgctatctcaccatctgcagcctggagatagagaaagaggaagtgatcgtagagttgagtctctgtcacaacattcacagttgcacatacaggtggcaataatcatgagttggaaacacccctcttgggtaaataaataagagctcctccctccctccaccttcatcacaatagcatcattcaatctttaattcatttgagagttgagagtgagcggaatatatttgtattctacgattgaggagaatggccagccctggagtttgcatcaacttggtgaatggtacatcgacgcgcctccccaccaatgctgatctagtagtccactacctgcaccgtcgcgccattcaggaaccggtgccctgtgacttcatcaccaacgtcgacattctccagcacaacccctgggacatcgtccctggtaaatatttttttgacccacacaggcttactcccattagatatattaatccaaaactttgccagcttcttcagttaatttgatcaatctgtagtataacctcaatagatagtttgcagttgttttgatagttaatttattgtctgctgggttgatgatgatggagcagcggaggagaagacaaatgggaagtacttcttcatccatgaggagaacgaacgccttggcaaccaccacagcaaccgtgctgctggtgatgggttctggaggccagtaggctcagaggtgccgatatatcacaaacgtagtggtggcgctgatgaagcactggtggggatgaagcgcaccttggtattccactacgggaattcttcgtccgcaaagcgcaccgaatgggtgatgcaggagttccgacttgctggtgctacccttataccttgccctgtgacgaggccagccaccggtgatggctccatgcttccctgccaccgcacaggaacgaccatcgccacggtaagacactacacatccgaacatcaccgtgcctatatattggatataacatagaatcgatctacttttataatctaattggttaagtatttacatgcaagcatagaactgtgtcattcaacttggggaatatggacatgatgaattacaaacttataattataagaacaatatttttctatgttgacgttgatggtgcaacaaggtctaggatggacctagctagtggtgattcaaattttgttatgatgtcagacctacaggtgctggaaccaaaaggtgatttgactttttggatagcgattctatatatttcagtaagatctaattacaataaataagatttttccatgaatcaagatctaataattaaaggaccaataagagattcaattttgccgatgtgcagaaaggggtacgttgtcggcttgcacttttatcagtgaaactctttattaaacattacgtggttatcctagtagtcccaggatgtgtagagatctaactgtcatgggatctataagatattcaattttgtcaagacgcgagaagtgttatgtcgtcgccgtgtgttttcattagtgaaactctttttttaacaccacaagtggctatcccctttgtcccgggttgtttagagacataacagttatgggatcaataagatacttgactttatcgagatgcaaaaagaggtatgcagccggcttgcgcttttataagtgaaactctttgttgagctccatgcatgatcattatccccttagtgtcgggaagggatgttcagatcatgttttgatcctggtctgtaccttttcatggaaagtgacatctctacagtttattggtgaaaccggatggtagattgatgacactcctttgcccatatatggaagaaaattggacatagaagataccaattccttctaattcagtcactagatgattagcacaaatctggaatacaactatgtctttgctattaatagatttcatctatctctctttgttgtacatgctatatataccatggttcctccttaagcagcatctagtaacatattatatgtcgaccgttttgcaggaaaacaatggaagtccatcagctggacaaactcatggcccacttgagaaaaccatggtcgaacctgatagttctttgcggatatgtcgcatctacaagaagaggcaacgaacaccacagttcatcatccctccatccattggcgatgcaagggaactcatcctcgcccttcctacaattggcaatacaagggaagtcgccctcgcccttcctgccattgacttcctggggcagccatctttcgaggaagggagtgatgtgtctgccgatgtcatcacggatgacaaggatggttatggccatggcatgaactaaataaaggaagccactcagctgtgtccagtaaaaattgcaagcggagtgtttcctcggtgcgagaaagacctatgacctgtttatgtgttttaatttgaagttcatgcttgatactatgtattctatttaattaagtcggagtactctatgctgttcaaactggagtctatgtttttctgtttaagttgtagacaatatatcatttaattagtttggggaaagtaaagtgtgcctatgttctagcttctaggatgagacgcattcgccccagattcaagatcaatgggaggtagttacctggtagaggtaactgttgtaactgcccttcttcaatatattgtgcttttgtgtttttttcttccatgggcatagcttgttcactctgctgcatgtgatcgattcacatatgcgtgtggtatacgtgtgtcgacaagtcacatagcacatgtttgggctcgaattgattgttggacatgggatgttattacagagttaccgtctgaatcacatgtagtgatataatagatatagttaatcttgggcaaatcattcgcggtgagaggattattacatcttttgtgtctgagctgctgctgtattattaatattactgattacactcggagtatgggttacatgtagagaatgagatgacgatatatatggagatggatacaaaaaataattgataacaaaagttaattttttgtatgcctaggcctagcatattttttgtgtatgcgtaggccacagttttgaactacttcttgaatggcgtcgatcttttacatggagaaaaaggataaaagtggatggacgaaactaccagtgtggccctcaatgggaagggaggaggaccatgtttgtgcgctgtcccgcacacagatgaactcatgtcagccactgttcccaagccctctcattctacatctcatgcactcaaatcagccacctttgctgacttccctcatactatggtggctacaggggaggaatgtgagtttataatcaatgttatgtaggattgcacaagaccaaacaaacctactggaggggggtgaatggtagagaaaaccaaaaacccaaaatcttttgcgggataaaagatttacctcaaatggagtagatgacaaagacctgtcgccgctagtcgaaccgccctcctgccatcaatcagaccaccgaagcctcgccggtcagaccacccaatcacctgcggttagaacaccgctatcggttagaacgcgtacatctgtggttagaccatcaagacctagaaacaccggtagatgacatactcgaagatgtacattgaaactttcgactttattgcatcaactagtgtttacaaagtgcaccaacagcacccctcaccaaaatctcgaactaaactcgaaaccttaactttctctcaactcgagtctctctaaaaccaataccgggaggcctcaccctccctctctatttatacatgagttagactgtgcaaagcccacgaatctaacataacttaagatgcctaacccatgtaggaaaccttctcttgcaagtatccaacttatccctttccttatctcaatcaatctttccgaaattcggactcccttccaaattcgactcctctttccatacgattacaatccctcttgtataccatatggattcttcatcgccacgtgcattgctctctagccttttagtgtcccgcatgatctcttgatccatggacatcaacttctcctaagtcgactccgatctatcaccggcaatactctcccgaggcctcaagcaacacctgcacatgcaacaacgaagaaaccatattccaagcacaagttcgtccctacttgactcacattagtataacaacagtatccatacgcatagaaaccatctagaagccaaatccccaagggaacatctaattcaacaggacaacccgaaaccgaacacgataagaatcctgccggtcagaccatcaggtcggatggtctgaccgctgcaacacctgcagtctggccggcggcacccggctggtctgaccgccagggtcaaccaaaaaccttcacttcacaaaatcaaccgtctacaaaatctccaaaataacatcagcaaaccaccaaaattttcaccgcaaaatctaaatcaactcattggttttacatgttataaagatgtgcttagcctaacatcatcaccttaatataatgtgaaagagaagattaaactgactaacattgtttaaatctatggatgcgacctccttctccttctctgcttcttttggtgtcgatgtagatatatgagtcatgagtatgagatttcttgcttgatcccctaggcaatgctagcgatcgacaagtgggtgatggtttcactctgagtgccactttcagtgccctagaactgcactacaagcctcatccagcattagctaaggaacgatgatattaggctttatcaaggaattaggggaagtggagaggtcttcacttgaccacaaggcgggctcctgttgtttttatatcgctgacgaactcaggggtaatcccaatcaggacgttaggatgcctctgatcacaactagttaacattcgtgagtggaacaaggtggatcatgccccctgtataccttggtctcagttgctatccaagatgatcaaccaccatggaaaacaaggacctacttaacatatggaaatcggcatggcatcgacgatactacatctctggcaccatcaatcatcaccattggcatagcatggtgtagaggaagcactaataaggagcaccacaacaaaaaatacttcgtagagacatttttctaacactagaggcagttttaaaatgcctctagaatcctgtagaggaattttgagaatatcttcaacacacttaccatctccacctcatgtcatttgagaaataagtcaatttatcaagatgaggcattttgattcagatcatttgatttacgttttgaaaactttcaaaccttaccagagaggggccacttatgctggacgttggcttcaagaaatctcctttagcattacttcaacccgggctttgaccatgtctcccgaacaatttcagtacatattgtgcaagacgattcttgcattaaatcaaaatttgaaaaagtgcctctacagaggttaaaacgccataacaaaattcctttacatatgaggcaaatattaaagtgcagaaaagatgcctctacaacattaatttaacaaaatatgctaaaagtgcctctaaaaagtatctttatactatagaactcttggtttaagtggcaaaataaaaactgtctccacaaaagtgcctctacgtaatgattttgctctagtgagaaggaggagcggtgctcggagggaggaatggaagagagtggcagattttggcagtttgggcttctaactttttattatattcctctatttataggtactagtcaggttcctgtggttcgcaatggattagtatgggttattcactattttatgggtcctgtaattcggaatggttggaatgggatcaaagtaacaattttttgaaccaatcgcttgatatcttttacatgggagaagggggttaattagttacatttaaggagtagagataggctttaacatttaagattgtggttagttattttcattctcggtggggatcaaaaagttgataaaatagctcgcacgagggagggtataccctgatcacctctgacaataaatagtagaagaaataattaattaacatatgttgagttcaaaacagttaatcacatatgtttgggtggcaaataattaattttatttttaattcaataggaagatattttgttcactacaattaaattcattacctcttgctatctttatgatgaaattggagctcttcataaaatttctaactgtttttggaaaataagatgtatttgaaaataagatgattgaaagaaaacatgtataacataaacatagactttagctgccactacacctatgttacgtatagatggtgcgctcatgtagcaccaaaaaaaaatttaggaattcagtgaggcaaggactggattttaaactcacattttccagcagccaccccccccacccccaatctttaatgctgcaaattaacaagcctaaaaaaactgtatcaactatcccaataaggccacaaattaaaaggcttgccaacaaggttcacacacatttaatatcatccttataggcacacacagttctcctagatcagcactattgtgttcttctcatcactgttatattgtccataataacactccaagaaggagatagagtagtccacctcaccagttgaaaaacacaaaaaacaaatcagaagatataactgacgttgggatcctcattcctccatcaaccccagccatctttaccttcttcctcttggattttgtgtgttactgcatggatgcatgccttgcaacaccctggatgctatctgacccatctgcagcctggcgatagagagacaaaaaacagtgaagtggagtccccctcacggcactctcagttgcccatacaggtggcaatatggtgagttggcaaacaaccctcttggttctataaatacagctcctcccagcctccatctccatccccacgggaccattcaatcttacattcgttttagtgagtctagcgagagcaagcgagcgtgcgagcgaaatctgtttgtaggttgcaagctaggacgatggctggtcctggagtttgcatcaacttgctgaacggtaccacgatgcacctctccgttgggtgtgtgttccgccccaccgagggtgagcttgttgtcaactacctgtaccgccgtgccatgcaggagccgctgccttgcgacttcatcaccgatgtggacatccagtgccacaacccttgggaaatcgttcccggtaaatatattttgactcgcactgtgtcactcccaaatctttggcagcatctttgattagtttcatcaatcagtagtatctcctcagctagatcgtttgtagggattttgacagttaatttcttgtatgattatgtttgagtgtcaacttttctattgttatgttggtgatgctggagcagcaggggagaagaagaatgggaagcacttcttcacccgcaaggagaacagccaccctagggactatgaaagcaaccatgccgctggtgatgggttctggagattggcaggcacagaggtcccaatatacaacaaacccagcggtggtgccgatgaaaaactagtggggatgaaacgcaccctggtgttccactttaggaagtcttcatccacagagcgcaccggatgggtgatgccgacttgccggtgccagccttgtgccttgccttgtgatgaggccggccaccggtgatgtctccatgcctccctgtggttgcaccgaaacaaccaccaccaaggtgagacgctgcatccaaacatcactatgtcattgtattggatatgatatagattccccctcaaaaaaaaaaggatatgatatagatttgtttctgtatttttaatatgattggtaaattatttgtataaaaccgtaggactgtgaggttcaagttggggaatagggaaacatgaggaattactatcttataattatatagagtatttgtgcatgtcgccattgaggggtgccaataggtttgggttgattgattgatgccatgcaaggtgcgtgggatctagtggtgattcaaatttttgtatatagtgatctatgagatggtggaatctagggttgatttcaatttttcgcatagtgattctatataattcaatctagtaggatgtgtcacccagcaaggtctaatggtttcacttacagaatccataagagattctaatttgtcgagatgcaaaaaagggtatgttgtcggcttgcatttttattagtgaaactcattattgaacaccatgtgtttttatccccttagtcctgagacgtttggagatctaacaagtacggattctattgaatgttcaaatttgtcgggatgcaaaaagggctatgttgtcagtttgtgtttttattaatgaaattctttgctgaacactatgcatgcttgtccccttagtctcggtaagggatgtttagatcatgatttgatcttgtactcctggtcgctacttttccttaaaaaagtggcatcactacagttattggtgaatcgaatgggggtgacactcctttgcccatattaggtactccctccatttcaagttataagatgttttgactttggtcaaagtcaaactattacaagtttgactaagtttttaaaaaatatagtaatatttataataccaaattagtttcattaaatcaataattgaatatattttcataataaatttgtcttgggttgaaaatgtttttttttcaaacttagtcaaacttaaagcaagttaattttgaccaaagtcaaaacatcttatgacctgaaacggagggagtagaaaattggacatagagaagttaccaaattcttctaattcagtcagtacatgagtagcacaaaactggcatgca

SEQ ID NO: 64307 - DNA, 558 bp, Oryza sativa
cagcagctggctaacaataggatggtcgccatctcgcacgcaaataaagagcgaatggtacacgagtactacgccggagtgctaggctccaccccttgaacttcaaggaagcacacactcagcttacccttctttagccctagccgacctgtcatgcacaacctcgaggtgtgcttcactgaggacaaagtccggaatgcaatcaaggacacccctaatgattgcgcgtcaaggacggatggcttcaccggcttgatctacaaatcttgttggtcggtcattaaagaaaatatccttgtagccctcaaccaactctttcatctggacggatcaagatttgacaaagtaaacaaggcccttataactttgctacgaagcgtgcggacgcaagtggcttgaaggactactggcccataagcctttgccacagctttgcgatgttattcacgataatcctatcaaagcaattagtgcccaaacttaatttgctggtcgccgacaaccaaagtgccttcatcaagtatcgttgcatccacgataatttcgtgcttgtacacc

SEQ ID NO: 64308 - DNA, 575 bp, Oryza sativa
tcatgctccatcataagagaatcacagctagcacttccatttcaatgatgtttttcctaacatgacatgactgcagaggatacttgtgattgatcaacaacattttgcagcaacgttctgtcccgataacgctgcaatggaattgatcaattggtgttcctacttattggaatgaatttcccattgtggaaaaaaaatggaaagactggtacaagctgctgaaaaatgaactgtcgttactcaagttgaaacatgtgcgtaactatcagaattgttgtcgacaaaaccgttgggatttgcaaggtaaaagaaaaaaaaatcctcagctctgtaaatgctattgctgaactaaagttcagaaagccatagtgccgaaagatctcccaacacctcagatggcctactgcaacaaattcaaaacaatgcaaaacaatgtaacattacgtggcccagcccatcatggcccatctaagcccatactgtatgcgctgcaaactaatgttagttcaggcaattactctgaattttctgatagacgaacctgattttttcatgtcaggtgccgtgcttgttca

SEQ ID NO: 64309 - DNA, 974 bp, Oryza sativa
aatccagaaagaagcagaaggtagccgggccggatggcttctaattgtgcctgggattgaagttggtcccggggttgtgcttcatgctggcgtcgaactccaccttgggctcgccgttcgcctgatgaacgccattgactcggaaggtgttggtagccattgccgccgtcggcgccgctgccctgggctgctgttgctgcagcagcaatctcctgctactcctagcagcaacagcagctactgcattgttgttgccgtcacgcaacaagccggtgctggtctttggtgatgcagcagcagttacagcgaggagaatatggagcaagaagatggcagcgaacatgcggtgcaaagccttcttcttcatggtgatgatgctttgttgatcaactgtgatgtggtggtagttgcagtactgtgtgcgtgtatggcagttgggcatcaagggggagcaatgctggcttatatatattgttcttgtaacttgtgttacacagactagcttgtttgtagtagtaacatgcagatgcaatgtgcaggcacgctgcatccactacttgggaacatgcagagaacatgccacacatttccctgtaaattttagcttctgtggaatattttgttaagaagacaggagccatgcatcaagtgggtctggaacatgccaccctgagacctcagttttgttttgcagacctcaaattgacaagctaataatagtgctgtttctctttgactgaaaaatctccttttccttgagcgtctcagatgatctaatccattaaaatgcttcacattaagcatatgatccataattctttctagggatatatgcgtgagtgccgaccatgtgagagatgcttctatttgactaatagcatctcttgcagagttgcagtcaggccggccgtatacaaacaaccaaatacaatacgttcggtcatgtgagcagatcggacattcatttttttcaa

SEQ ID NO: 64310 - DNA, 684 bp, Oryza sativa
ttaacaaccaaaccgtactgcctgtactacaagcaacatgtcactctttttttttgtagtagaatttagagttgagaatattaatatttctgcatcatggaccactatatggtacataaacctagtgttaattgttgtgattgcatgtctgtctgctgaggaatgtgaacaagctggacggacatcatggtggtgacagaagacgtcagtcggtctaatcgacagtcagtcaggttgggccgaaaagaaatttttttttgagtgtcacatcggacgtttgatcagatgtcggaagggattttagacacgaatgaaaaaactaatttcataacttatctagaaaccgtgagaagaatattttgagcctaattaatcaatcattagcaaatgtgggttactgtagcacttatggctaatcatggactaattaggcaccaaagattcgtctcgcggtttctccctaactgtgcaattagtttttaaatttatctatatttaatattacatgtatatgtcaagattcgattggatggttttaggaaaaagtttttagaaactaaacatggcctaattatctgggcaactaccgtcttgcagcagactgtctagacaaaaatgtggtcagaaaacagactcgtgataaaccattttggtgagtatgatctactacaaaacaaataattt

SEQ ID NO: 64311 - DNA, 650 bp, Oryza sativa
tttttttttcttttttttgctttctccatatttgtatcggatgagactagatggcgcattgccaccgtgctgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcatagatgagaactgtgtcagtaaccccggataaggtaagcaactgttttctacttttatctctggatgtaatgcacaagtcaatgtgtggtagaataggtggttttggccatctcaagccatagcttcgatgcaggagcagatgcaagtgtcacttggtcctcattcgatcttggtctgggccggtccaaagtggtggcagagatgtgcagctgcaacgcgcacggggttagcaatagaaa

SEQ ID NO: 64312 - DNA, 696 bp, Oryza sativa
tgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctggtcgaatcgcctccttcaatagcaaaaccgggtataatgactccctcatctttgaaaaccggtgcaaatcgac

SEQ ID NO: 64313 - DNA, 12885 bp, Oryza sativa
tcttaagcttcactaaagataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaatgtcctcataatctctagagatcaactggttagtcaattcatcatcaagacccgacaaaaacttctcctgcctctcggcatcggtacgcacgtcctcaggggtgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggtggtggggacggactgttgtcagatgcaccgttggcacgtgctccattgatcggctcttcactgccactggcgttgttcgagtcgcgtgaaccattccttatctccatctgaaggggataggtagaaatatgagaaatggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaatccgactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaagtaaacaataaattaatgcatagactagttgcatggaaaatgatgcgcataacattgcccccatcgaatatagacacgacctaatgcataacccccaataaattcccgactgactatcgaataaactccaactaaaatttttctaaagccctagactgagctaatttttttttttaaaaaaaatccgatccgaaagaacgaccaagatttttcctgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacggcaattgttgacatacagatccacgtcttacaaaaatagaaaagattacaaatgcagcggaaaagatgaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaattgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcaatgtattttaattaactaacaccattgcggtggcaccaatccaaagctatgctcatagacaaagtctatgtaataaagtgatccccatttgtgtgctagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcatccaaggggggggggggcggcgggcaccgacaggcgtgccccatgggtcagcggttcaagagaggggagagagaggcgccggcaaacgggcccactaggcagcggctcaaagggggtcggtccaccgtggaccgggaccacgcgggtggtccaccgccggtccacgggaccgacggtccagatcggccgggagaccgatcggacggcacggcggcgactaggcacgactcggctcggcttcaaaaccggccggccggccatggcgaggcgacgacggcgcacgaccgccggcggtgcggggagacggcggcggacggcgcggaaggcggcggcggacggccggagcggcggcacggccaaaggcggcggcgcacgcgtggaggggagaaaagggagggggagggaggcatcggccgggctcagctcggcctcaaggccgaccggggcgaggcggcggcgaggcacgaccaccgacggcggggaccggtgtcgcgggaagcggcggcgacggccgaaaggtggcggcgcatggccgaagcgcggcgatgcacgtgcggagggcggcggcatgcacgggagagagagtaaagaaagaaggagagagaggtagtcctcaccggcgatgtgggggaatcggggtccggcggcggcggacggaaagcgagcggcggccgaggtagctctcgcggcggcgaatctagcggcggtgattgcgcggcgaggcgatggctctagcgacggcagcgtgcggccggaggcggcggcaagcggtggcgctagcggcgagcggcacgggctcgttaggagacacgggaggggacggcaaatgggggaaacgagagaggggactcgggggagggtttttatgggtgagggaggggcggaaacggccgggaatggcccctatttggccggcgatgtggggagtggagggagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaagaggagggaaaagaaaaaaagaaaaaggattttcctgggattaaaattgcactttggtgatttttaattggtaaaaattatttccaaggctctgaaaattccactaaaaatcctgttaatatattgtgacatgtggaacccaagaaaaaatcccacaatgccaattccaattattaattgcatttattaattatggaattagctctaggttaattaagataatttcttcggacaatttatttagccaatttttaaagctaggagagggggaaacttcaaggcgtgacaggtatcgccgtggttcgctccgccgctcgccgctgttgtccgccgtcctttccggctggcgtcgtcgtctacctcccgccggcccgcgtggcagccacgtaggtgccacgtcagcgccagctcagccgaggtcgggacgggccgaccccggtcagccccttccgtgcgcgtgttccaccgcgagccgtgaggctgcgcgtgggcccgccgcatccgttcctccgcagaccgcgcgcgtgcaccgcgtccctcccccgcccgcgcgcgtgcgccgcgtgctccctccgcacggtgagccgagccgctgacaagcgggtcccacccgggaccgcgcacggtgagcccggtccaccggcccactctctcctcccctcccgcgcgcgcgcgcttgggccgtctttggccggccggcccatttagctcggccggaccgccccatctctctcgggccgcgccctagccgcccgaggaaaagtctaatttccatccctcttttcttttgttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgccccgtttcgcgtgtagtttcggagcccgaagacccgcagtgcgaggatttcgaggatcaagctctagatctcgagcaaggcaagccacctttgaacatcttgagcctatatttgaaatttaattatgttgcttgcaaaatattatgcatcgataggatcgcacttaatctgttgtcccgtctgcaaggcagattggcggacctacctaacttgttgcatttgatccttccattgttaattgctataccatgtccccttgtaaccatccagttgcgcctcgatattcgtgcactctgtgcgagtatcgacggtcaccttcaaacttaaaatctgagtaacaacttgggtaaaactggagttttacaaaagacttggaaaacccgacacctgggtcggcgcttgcgaactaaaggaatttccaaaaccgcggaccggggaacgtaccgggtgtacggtttttcccgctctcgcacttaaggaccgattccttggaatttcatccaaacataagacaagtacgaccacatgggtggaatgggacacccctggctgagtaactagcttatcaggggagccttgatgtcgagagacatgtggattcgccggggtggtgtcggggaggacccctgggcttcctggcacagtatggtctgggacctaacctgttgttggtctgggacccctctcgtcggcatatggtaaacctgtatcggctttggaaatgccttgtcatgaaagtttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttgtttgactactgcttgtgaaattgctgttatggaaaggggttcgatgtttgaaaaatctgcagctgatgggatcagctaggcccgggtggccgtttgaaagttgtaggcccgggtggccgtttgaaaagctgttggccgggtgccaaccttgttttaaattttcaagactgatacattgcacatactccgaccggacgagacgcactgtctcatccgtgtcgtttgaggagcactcacttagttgtttttagaaaagagttcaactaaaatcaattgcaaaaacaacagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttctcaagtcgcgcctgtgttgtttggtcctagtcctggcttccgctttccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccagttgggactagttcggggcgtgacagatatttttaattattaatagcttttttcattcttttcactttcgcagacttcctttaaatttcttttatttgatgcaaatgaactagcaacggatgtataccgcggaccgacggttgaagaagtttattgatggctatttttttaggtacccatttctagtcatgaattatgcgtaccgatagcacaactgggactagaaggggttgctaaccggccagtactattgtacacttctccagcagtacacatgcagcttagagatgctatttgacataggatattaggcctcttgagcaaaaagaatacaattattatatgggatctaatgtggatcactatttatcatctatgtaatcgatcaccctttagccttctttaattaaaggatgtaaaggacggtgtaacggtgtttatttatgcagatcgaaatccccaatgttgataattctatatattacatatgtacaaagagaacactacgacagaaacaatttttcctgtgtgggatggccagtagattgtaggcgggccataactactattgcctgccaaaattgctcccccgatgggtgcttcaagggtcgcagcgaaaatatattattgcatgcggtccattaagagaccagtctaaaaaatagacttatttcttaattcttaagaaggacctcttaagcggttgcatgggaaaatgcattattttcatggtgggctagagtgggaccgcacagctgcgggttcaacggcgacgacagcgattacgatagatccatagcttctctctcaattccatctgggtggcaccacgacagggatccaccgctgagcagcctcgcgatgggcaaatccactgctatcggccctttgaccggtagatccaggttgctgccgccatcagggtatggaggggcagtggagaaggttgtggaggcgcagggagaggtgaaggcggcctcagtgatggcagcggctacaacgacgacgagctgtggagactcggcgactgcgacagcaacgacgagctacaatgacaacgtcaccggtgaatgggagctagctagggttttggattttggtttttttatttttttcatgatttttctttttgcaggcagacgacataagcacccgttggcaaaaaatctaatttttgcatgcgagtgcaccacccacatggaaaaattatgatttttatagacacctccgggtatacggatggccaattactgcatgcaaaaattgggtttgggcgcatacaataatgtttttatagtgatatataaaaaccattaattacatcatacaaaactagtcaaaaagctgtggcattattaattttaattgttgcaaataaataaacgacctttgttgtatatatatcacaaagtgatcctattataagcagtacatacaaatgaattattggtttgttgattgagtcgatcatgtgtgcatagtggttcggacacccgaagttatatatatatagtcccgattatccaaaacataaaattgatatcctaaaaggtcaggcagtgactagagggatggcagatttatcagtactaggtccttttatatgacataagcgaatgagcctctctatctgagttagttaggtgactctagtagcactcctcgggtcctgggttcgactaccgtggagcgaatttcagactggggttaaaaaaattctctcgcctattccatgccaaagcacaggtctaaggccgtcgttggtcattctcacatgggctacagtaccgttgtataagggtgcaagggtaagggtttagggattttcactactagaaataatattttttcaggtggcccaaaaccattttcgtaggcgggggagaggaccgccgctaccatctcgcctgtgaaaatagactattttcgcaggcggacccatggcccgcctgcgaaaatcatctcagaaaaataaaaaaaaaacatggggcgccgccaccggcctcaccacggccgccgccggctagggctcccctcgtccactgtcgtcggcgccgccggcgtcatcgtcgcgtcaacgaggagagccggcggctggatgcgaaccgtcgtcgtcgcctgtcgtggccggcggcagagggggcgaggaggtgaagcggcgaggagggatagccggcggcgcgcgcacgtgggagaggagggagccgtcggcggaggtaatgagtcggcggcaaggagggagccggcggtgtcgcggtcgtcgtcgtcgtcgtggccggcggtgcgcggacgtgggagaggagggagccggcggtgcgcggatctggagcggagggagctgtcggcggcaaggagggagccggcggtgtcgcggtcgtcgtcgtcgttgaggagggaggcggcggcgcgcggacgtcgtcgtggagggagccggcggcgggcggacgtgggagaggagggagctagccggcgattttactaagtgtgtgtgtgagagagagagagatgagggggagggaaatgagtggtagagaggagaggataaggatggtggagaggataaggatgactgatttttttgtaggtactatttttgcaggcggaccatataaggtgcgcctgcgaaaaggcgcacattcgcaggcacaccttatatggtctgccaggcgtcgcttcaccccgatttatattttcataggcggtcatttggctccaaaagtcatatccgcctgtgaaaataagacccctacgttagggaaaatgctttttctagtagtgtttattgacctgcgtgacaagatcttctacatatgcgcatgatgctcaggagttgtcttagcctcttgcaggtcaagtttttttatatgtcataattaaatacattggaaaaaccagtagaaatacatctgagaaaaacatacagtacaagcaattggatgcatgtgctactcacaccacacatgtaagaacgtatgtacgtagctatagatcagtcttaatcaatttgaaattgtcactacattgttttacaatgattaaagcgcctgcatagaaaagtatgcgtgttgtttttggtttggaagtgccttttgttattttttgcttttgttgtacgttctttttcaacgtcactctcaactctcaaaggtgtgtaaacatcggaaatttttttttttaaaaaaattctatcatccaaaggttcagtaaagggttggctggcctgaaagcttcagaatacttgtaattaagttgagagaagagaaacagacggaatatattccagctggaattaatatggcagtagaagagtataactagttgcttagcgtcatcaattctcattttataggaataattcaacgaagaacatttgatttcgaacgatacttctgctttcaaggagtatttgacgttgattaattagtttaattgatttataaaaaacaattagtggtggtctgtgcatttgatttcgaacgatagttctgcttatcaaacatccaaccactactggagaagtgctcatctctcccggttcgcaaccacctttactcccgagtagcgaactgggagggagaatccgggataaaagatggcagtctttagtcccggtttaaatacccgggagtaaggatacagaaaacttctacatttatttcctagtatttgacgttgattagtttaattttaaggtaattaactagccttaaacaaagaaatgagggagtatatgaaattgtttgtctagacatttgtacactttactttactctataattttttttaaagaatttggcatagtagcatatataccattacatctattttagccacataataagaaaaaacaaaatcacaatttatatagatttttttaaatacttgctagttgttacaaagtctttttttcataatttttaattgactaaatttcacaaaactatacttaaaaaaactacatatataagaatgtgggtcataaaactacagaatttagcaccaaatttttcacaaactgtagatttaaggtatagtatcacaaaattatatattaaactctaattatatctgaaaactatagttttttaactaaaaaatagtagtgctatgatttgaaatctaaaatattactgtctttgataacttcttccctaaatctatagttttatagtacgatatcctacatatatggttatgatatatatatatatatatatatttaatgctaaatccattgttttattatacacatccttcatatgtagttttgtaatagtttaatctacgtgtttgaaattttctctttttaagttggccttgcttgggactcacatgtaaataaccagttttcattctgctagacgatcatatacttaagttctttcattagtgcttttattcctagaaagaaagatatcagcactaaccctttttctctggatgagctatacgtaatcttttggccactcggaaataattgaagtagacaaaagaaaaatataacaaagatggccatgatttaaagcgctctgattgttgacataacaactttaatgataatttgatctccttgacaagtggtttattttgatgctatccgttgactgtgcagatggctaattaaggtgaaagatgtcaccataatgtacatacattgaatagacaagctagggtctcctatataatatttgtatatatgacgaaatatgtgtggtaaaaattaattaattctcctctttaattcgcccctataattaaaaagttccatacatgccatatcaccaagactccttgaaagcattttcaagaccaagttgattaaatttggagctttatgttatttcacccgcctcagcacaaagaacagtgctagcggctacaatacattttaagaggttgtctgtccaaccatctctatcctattcaaatgtggtggaaagacacgtccatcatccagtccgagtgtgattaggatcctgtgccttgtgattgtattgtgggctgaaagggttgggtgaacgccctaaggctaactataggatatccctaattatcactggaggagaaaccatctttgctcggtcacccaaaattcacaatagtccctgttcgaatagaaaccgggactaaagatgatttttagtcccggttaaaaactttttgacctttattcccggttggtaatattaaccgggactaaagatcatttttagtcccggttcaaaaagttgtcgggtcgagttaggtcccagctcatttttagtcccggttggtataaacaaccgggactaaa

SEQ ID NO: 64314 - DNA, 22271 bp, Oryza sativa
caaccgggaccaaaaatcaactgagccgcgcgcgccagtccaccgtctctcccctctcattaattatcccttatcccttcgatcccaccgtcctctccatcccttcgctagctagcttatccctctcagcctcaacctcctccatccattctcctctcaccttcctcccccttctcttctcttcctcctcctcctcctaccacgtgaggccgagcggcagcggcagggaggcgggcagccgagcaggcggcaggcgaggccggcgaggcggcgggcggccgggcgggcgaggccggcgagggccgcgaggcggcgcgtggccgggcgggcgagtccggcgagggccgcctcggccgggcaggcgggcggcgaggcccgcgaggcggcgctccctgggcgggcggcgaggcggcgggcggcggtgctcccggtgcggcggcgctccccaggcggcggcggagcacaaggcggccggcgggaggacggtgaggcggcggacggccggcgcccgatctctgtgttgtggttttttttcctgatctgtgtgatatgtgcggccgatctatgcgatgtcgattttttttctgatatgtgtgatgtgtgatgtgtgaatgaatttgtggagatgtttttgtgattttgtgaatgatttgtgatgtatttggggattttgtgattgatttgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaaacattagtcctggttgttaattctaaccgggactaaatctttagtcccggtttttaacactaaccgggactaaagatccatctttagtcccagttattttaaccgggactaaaaatatgcatatttagtcccggattcgtagtctcggttgtataaccgggactatatgaggttgcgaaccggtattaaaaagggtttgtccaccagtgtatatttattcaatagccatcatcgtttagagtcaggtttgcttagattatttcttgcattgaatttttgccgctagttaggtttgtgaaacccaaacttcgaatactaaatcatttatctgcaaattgagttgcaatcttccttgttcttgcttatgttcttcgattcacatacagggattagccttcttggcgaggtcaatcaggcaacgcacggttgataactagatgagacgtggcactgcaattgcatggttcggatcgtgttgatcggaagccgattcttgtgtgtcaagtttccgctgaattgggaattatcaatatctatcgaaagaccgggacctagttcatcatcactaagggccacttctgcaattgaaatttgtacgcatatagaatatgagccaaaacaagaaatacacacagaaaatacagaaatacacaataacgtattgcaagaataatccagctcctgctcttttgctcatgctctggctggagcgctcctgcacttggtgattgctcttgcgagaaatcgtggagagtagtcagggttttttccactaggtctaggaccaccattgccagaactgaaaattagggtttccctcgcaccggttcttgtctccaccatgaggccaacactagggagggagggagggaaagagtgaggaagaaagtatgagcacggagagcaaataaggaagtgagaagctagaagccactacattattcatagaagtagaattctagaagcggttgtttaagccgaccacccaaaaatcaaggttattacgcattccaaaagtaattaacttttcatcaactaattaataacacatactacaaattaattacattactaaactaactacattaattataattaactactatactactcctgacatagtctcttcgctagtagctcgcctcccgaaggcgcgctggccaccatgcgggctgccatgcctaccacatgctcctctatgtgcctcccgtcacatcctcctctgtgccagtcacatctcctgccacttttttccttgttgttgatgtcctcctcctcatcagagtacaatggcactattgacctatcatcgaaaaaacgctcatcattggtgtttcatagttcttcctcagtggaagcgctagcagggggaggaagtagtccgacaatagctcagggagctcctcttcctcatcagtggtgttgtaacaaagttggtgcggcaagtccatcatggtcgaaggcatgcgagaaagaagaagagaagagtgcgatgagaaaaacccacccatattgccctctatttactgaatatgaggagaggggaggtgaggaggtggagtggtagtggatgatatgactggcgttcggcagctggcatggacgtctaggctactagtgtgatcaatgaagcgccagctcgatcggcttcctcgaggaagatgaaaggactagacatttttcagaaatagttttttaattataggcggtcccttaagacgaccgcatgtggaaatgtgttattttcagagacggtcatcctataagacgacttgtcagcttgtatatttggggcccatttatcagtgaccgataggatcctctgatgaaagattgaccacacatatatctcccacaagcttttaaagcctttacatgcatggacaccacgctcctcgagaccctgatcgagctaattgagcctcatcagccagcttatcctccttttgagctcatgcatgcacatatctgtgattgacagaaagcgtacgacgatggcgagatttgcacggcccatcttgtcccctttagcgcgcatttgctgctgtttggaccaatctgaattcatggagataagcgttatcacaatcgactcaagaaagtgtggctcaatccctgtaccatgcgccttatctttgttcctgccgtttgggccaaatgcatctaaaggtcattccttgataattagtcattttatgtgacgttacaccattgctccctcaagtgtgcactccattaaccaaagatgatttgccaaaagaggggtaatgagaggtacttatggggggtcctaatagcgtttggaaggagattagaggtgtgtttttgtgttttgccagggctactttgggttgctccttgcatcatttggttatccttgcatgcaccttttgttgtgccaaattatttttcaatatctttggcacattctctgccttatcttgttagctagtgtctagtgatgcatgcctcctgcagttgtcagcagcttcagagtatgtgtgttatgtgtatgaaaccctaaaccctccaatcatgatccaggatagaaaaaaatcttaatttgctgatgtctagctctactgtgcatcaaattgacccagaaaatgttgtatgctaggactaataaatttccacttctttcaaaaggaggactgaattatgtgttaggactaaatttgtagaattgtgccaaccaataaagattgttgtctttcagcatatactataataagcaaattgtgttatttgtcaattcaaatggagatatcattttcattcagaaattttgcttatccgtagttttttagcatactataataagcataacaatattgcctcaataatctcgaaaagatcaatatatagattggtcctaaagcatactaacgttgaatttgcaatcatccactaataatactgagcactacagcatcattgtggccatgcaagtggcaagtcaaatataatccatatatcagtctcaccatttcttttctttcacataatgtacatgtacagaccctatcaacattgacatatagatagttggcatatgatatgattaacgcagatttcaaggatgtacattgtgcgctatatcatcaacattatctctaaagagtaatacttgaaggcatacgcgtaggctacgatagtataaatcaaaattgttgtacagcataaaccaaaaaccatgcaagtattagataataaatcattaccactcaacaagctatgcagcagaagttagcgctaagaagccgaagaaacgtcgggacgtagtgcgcgtcaatatagagaaaatagtcgatcgcaacagctcgatcttctcctcctcaagtgttctcctcgccatgctcttacgctaatcagtaccacaaaccaacagcgcctaattcagaatggtttggccacaggtagagagctgcagagaagaaatattaaatagggagttcgatgcttatactgtaatcgggaggaatccctttttcaccggttctgggactgcccatttgctaggtggatttggcagaaattggaagagcatcgtggtgaggacattccacaaccgccagcggaatgcagaaacaataaaatcttatctgtttggctactggatcaattatcaatacagacacaagaagtctctttagtgctgttagttacaatctacattatgtggtcagcacggaatgatgcacggaatcaacagatcccagataacccagacaggacggtggagagaattttgttcctcctggaagagtgggcaagtctatttgaaaaatctgatcatactgtcctagtccgacaatgcactggaggttgccggaatcaggatggattaagctgaaatcggatgggggatttgctgcagatgaacagatgggaagtgggggagtgatagtgagaaatgatcggggtgagtttatgggtgcgaacaggattttcttcggggaagtgttaagtgcaactcatgctgaagcgttggcttgcctcgaagcgacgcgggtgggtgcaagacttgcagcaaccagagtagtcttcgaaacggactcagttgaagttgtgagtttggtcatgaataaaagttttgatcggtttgaaattgggcctgtaatccaggagctgaagaggggaatccagtcattccaggatttcaagctcatatgaacgaggagatcggcaaataaagtggcacaccgtttggctaaggaaagccttaacacacgtgcttcttctagctggatagtgtcagcaccggagtttttattttctctgttatcagaggactgtaatctggatgctgtaatttgagttttgcttgctttccactctcaaaaaaaaaaaataaattgcccttattcgtcatttagtctatcccaccatctcccttcgctgttcacatacaatccatccggtggcgtgaagatttcttctctgtcactaacgtgccacacctgagatacattcatatgatcaacatattgttaaccttcagtctgtacgatataacgagattctctacagtattacttgttatcctgcaaaatataataatatataatatgtggctctcacttgatctcgaggtattgtgtgcctctacagccaagtctccgactctatatccttttaacaccgtgactacttggctgtgttcttttggaggggtttccaacccctcctctccgcacggaaaacatagtgatagattaacacatgattaagagcaagtttaatagtatagctaactactagctccaattcatctatagccaatctaatagctcattcatacaatagttacatactacactattaatgcatagtcccacctgtcatacacacgctgcgtcttggagtacgtgctacagctggctacaaatctgtagcccgctgctcttctctctcctcatttatctctttaaaatatatttacagctggcttatagcctactattgtacctgctctaattaagtattagctataaaaactttgaaaaatgaattaatatgatttttaaagcaacttttctatataaacttttcacaaaacatataatgtttagcagtttgaaaagtgcgtacatgtaaaaaacgagagagatgggttgggaactcatgtgaaagacatatataccaacgagtggataaaccccagcccacccgtcattgtacacagcatcatcaaagggggtggccacatgaatttctccttgtgcgttcatgcgaggatcgatatgcatgccatacgtggcaacgcccagcacatgctatcagttctttattttgaataaatcctgtccatgatctttgtcttcatgagattatgtaataaataaaaccttgtaaactgcgatatataatatacatggacaggaaaaaataaggcatgcagtggcaaaaggtttccagcgtgtagtcactaccattaaaaaaagaaagagcatgaagtcactaacagcagcacagtgtgcactttcaatattgcaaagagaacagcattattatccttggttagtactgtacctgtcttaatttatttatgcaacctaactttttcaaggaacctttgtttgttttggaactcggctagcgtgtgattattcctccaaattaacacacactgaacagtacacgtatatttgctgatgtacatttaaaattaatatttaatcagtgggattttcaccttatagttaagtagcaataacagcgagtccccttgcatatatatgatggtgcagatgctgggattttactggcaaaggaaacataacttttattagcctctacatcatttgaaaatacacacagtcaatatttatatttatcaacataaggagttaaacttttgtgggtccatgactttaccatctcaccaatggccaggaacatttatcctaattataccttaaaaaaaagccccagtaacatgagtgcccccacctatatataattaaaatatgtttgttgatacataatttatagataagaagagtggtgcacagccacctggtaaatgataataatctttatccgaaggtacaaaatctaggatgcacctgatcaacaacaaaagatgtttatctttcttacgaggacagggtatatcagagtggatgaaccacttattattattgttataactgtcttaaggtttgcgcaatactataggtcacacgtctcatcacaccattaggtcctaaaataattcaacatcagaaaaaagaactccaagtaaaggagtcgttctaatttgtgcctctcagcctctggttaattaaatgccaaatgagcatgtaactaactagctagcttattcttctaatattcaggaatataatcaagataatcctagttgaaaattaaattaggatggcaacggatccggtcaggcacgggtagagcaaaaccatgcccgacttgttggcccatgttgcccacccgaatcctaccccgctagggttagcaggcaagactctatgcatgtacccatactcgatgggcatgagcatgcccgatggctacccgcgggtttcatatgcataataatttaataaagaaaaacaaaacaaataatttgccaaattattagttgtcaacaataatttagattgcatatcaagttattaccagctagcatcacaaatgagctaaaagaaagagatatgagaattaagtgatgggccaaaatcgactaatacatatgtttcggatcaggcatgagttaccaacgggtaaaatataaaacctggctgcttcccactatgtctccgggtctcgaacgggtatgcctacgggtaaaaagttacaccacgcctgtgctcatcaggttgggtatccgcggatacctggacccatggatatccctaaaattaatcaaagggggtgccctgcatcgaccccctgcaaattaaggtacttatagtagtaagaaatggatcgtggtacatacatctgtaatatatattaatatttatatatatgtgtttatgaacattgattcttgatatataattaagaactctaaaatacacattactttattccggccacgagcttaagaaatcaataagacacacacacacactatggttcctgagccaaagaatggttcagggttcatattcttgagcaatgaaaagtaatggtccacacgtgcatatctagagatctgtccgtgttagcttcttcttcaacttctctgtgtttgcaagggattatgagattattggtagatcataaagctgctatctgcataacttccacattttctcgtaattactattacgtaaaatctattcagagagttctcgtttttgtcttaactgaatatagagaaaacgtggagtctactacatcatactcgtactgtatgcatgcattttcttaatagacatgcatgtattttttcctcttcaaacaaaatttttctctcaaattatttatccgatctacaatccgattataccattgtgttcgttacaattaaatcttcataacaagatcttacatgattatattacgatcaaaaaatatttatatttataaattgcttttattatatatgtaagttacttttatcatatatataagttacttttagatttaactaaattacttcttagacatactacctccgtattttaatagatgacatcgttgactttttctcacatgtttgaccattcgtcttattcaaaaattttatacaaatgtataagatataaatcacacttaaagtactatgagtgataaaacaactcataacaaaataaattataattatgtaaattttttgaataagacgaatggtcaaacatatgagaaaaagtcaacagcatcatctattaaaaacggagggagtataaaagtaaattcaataaagtctaaaagtaatttacatatattataaaagtaacttaacacaaaacggaagtaactttatcacgacattagaagtaaattcgtgtagggataaaatatgactttttagttaattccataatttgtgctgattaatttaatttccagatagagttatgtttttatctctacaacggatttacttcaaatgataccttcgttttgttctaatttacttctataacatatatatatatatatatatatatatatatatatatatatatatatattacttttagacttactgaatttacttttatattttaagaagtaacttaatgaaatctagaagtaatttagacacatcataaaagtaaatttgtgatttttcatcaaaatataatcatgtgagatcttgttgtaaagatttaattgcaacgaacacaacagcgtaattggattataaatcggataagtaatttaataaaaacttctctaagaaggaaaaaaatacatagatattgagtgtactagtagttttttttttttggaaagaatggtgtctctctttagcactatccagctagcattctcgctgtagtgtccttttctgcagtagtcgtgtccttttctgcagttgttgaatatatatggtgttgatcgtgtgtaaaaagttccaaagatttaaaacgggctgatagactttccatgtatgtatatacgctagtagctaactaaagcagggcatcaattttgttgggagtaaacttttttttccctaaactcgcttcagacaaattatatagttttattaaatacaagctataaatcgtgtctcatttgtaattcatgatcaatgcatgagtcacttcagttgcatgtcttataacagagctaacacctcactactgcagataagcctataggtacactactgaaaaaaccatctttgctgagttgaccaaaaactatattaatcccagtttgagtaggaacaaggactaaagaatatctttagtcctggttcaaaaggccaggggtacgttttgatctttaattccggttcaaaatatggtaggcggtgtcagaccccttcactatctttagtcacggttagtaacaccaaccgggattaaagatctatttttagtctcggttgttaaacaaccggggactaaaaatcggccccgagcgccgtccactataccaggccgcctcttcgatcctcctcgagcgctataatcccaaggacgctcctcacctagcttcctcgatcctttatccaccttatctcctttctcctcttctcctccccctcattcactcacccccatctccacccctcttctcccctcttctcctccggtcccctcccctctcctccccattctcccctcccctccggctcccttccggcgggcagcagcgcctaggcggcatgcggcggtggcacaaagagccggccacgtggcaggtggccgggcggcggcggcggtggcagcctgtgcgaggggcggcagcctgcggcggtggtggcgcggggacggcgcgaggggcgcgagggcggcggtgggctcccctccgccggatccgggaggggaggcggccgggcggtggcaccagagcgagccggccgggccgcaaccggtggaatgcgggaggccagtggcggctgtggagttgatttgtaatgaatgatttgtagattatttttttgattttgggatgattttgtgattgatttgtggactgtggatgattgtgtatgatgtgtggatgatttttgtggatgattgtgtatgatgtgtggggatttgggtgtgatggagattgtggtcgaggtgcaaacagcataaaaaacaatgaaaataaaaagaaagaaaatcctttattccccgtatcggttattttaaccgggattaaagatgaatatctttagtcccggatttatagtcccggtttgtaacccagaattaaggggagttacaaaccatgactaaaaacccctttcccagtggtggtatcgattctgaaggatctataggtaccggttctggtaccggcactaatggcccaagtctaatagcagaggtacatagaacacctaggtaccaatgagtggttatagattatagctactccctctgtttcacaatataagtcattctaaaattttctacattcatatggttgttaatgaatctagatatataaatatgtctagattcattaacaactatatgaatgtgggaaatgctaaaatgacttatattgtgaaatggaggaagtagttcataaaaaccgacagttatatgatgtccataagtatcagttgatataagaaccgacaattatgacttgggagctatatgggggcgtcttcgttggcactgagaatgaacagctgccaatcaggagcaacgacgcgagcatggccttgccatcctcgactttgtcgtctggccgccagagcaagggcaaggagcgtgaggagtattgaggagatgccaactcgtcgtctattatgtttggccaagggagtgcgggcgacgcgacgcgttgctagtgtcggaaaccggagtgggggcgacggtgaccatatccattggtggggaggccgagagcatcgattgggatgtcgttgatccggatttgacacctcaccgagcggagtggagagagcgagggagagggaagagatggcccacagtggcgtggagatgaaatccctctcatccgggtggccggatatgccagccaggagggcgatgcccggtgccgcaatgatagctggagactgcagcggcggcatatgcgaggggaggaggtgagcatggcggcgcgctgaggaaggagggcgagggcgagggcaagcgcgagtgtgagggtgggggcgacgaggctagggtttgaattggtatgggccggcgaaatcctcactgtccattccggatccaacgatttcacgggcgcggaagggccaccacagtgggacacgtggatgaccatatcgaccctagagagagatcggacggttcacgatggatagcagctgggaccaatgcgtaattaactggaagttcggggacattttgcaaaatatttgccaacgtggcactttaattctcaagcattcccactgacgtttagagaggttaatattagtatcaatgttataaattggtaccaatacatggttatatgtaccggttttcaattttatactgaaaaaggtggaacaagctttacagaggccactctctatggggtgttttgtagtagggcctgtatacatgtcggagaccatggataaattcgtgtacatcacaaaattactaattaataaagtgcactcgctgaatgtgtataactacaactatgaacacactgtactagtcctcaagtaattttattttttctaatttaaatcatggaatgtgcgtacgaacacaaccatttcacacgcacgccacacacatatgggaatgtgttcggctcccaaactcatgctcaaatatagatgataaagttttccggtcaagtataattaactaaagctgaatgtgctccatcagtggttgatctagtttcagattggttgttgctcctttatagcaatttttttgttagttaattacttttgcaaaccagatcagtttagatatagttgtctatctcaccttttttttcctttgtacctaaatggcgcatacataaatcacctgccggccggctcgttctgtgcaaattaacaacaaaataagtaagtttacgtggcaacattctacaagccgcacttaattttttccataccggcgtacaccaccagcaacacatcctactggcattctcgccttataaatatattaactgatcaatcttgtaaacaattccgtacgacgatctctgtgaagcactgaacaaataatccacaaattaattaaagttgaacacgatgaaacgcaatctcgtctaatcggattcccctctttcaaataaagcgcaaaagtgcaaaaagcgaacataaaatttgattaaatgtctgaactttttgtcacgtaaactatctgaacataatgggtgtgcattctctgtggctcacgcctgagcttggtgctgccactgattgcttgaaacaattaacagtaaccggccggcttaattcgtgttctgttcatcattaggtcatgataagtactgtggcattgtatgctttcatggttgcttttgtgcttaatatagtatatcctttctgttcttttggaggtttgaactttgaacaaattagataaagttcacaaagtgtgtactttggcatgttaactgtaacacactgacaagaaagctatgtgatcgataaactttggtacaagattgtaagtatacgtggatggtacagggcagtttgctacaatttttttttttgttgaggaaattaaccaatcttatcttgacgatgtaccagatgtgcctttcacttgacacatttttattcggtttgcttggagctttttggcatcttggtgggaagttctactaactttagctgccctaattaataatgtgtgttaattaacaacgtaacattatgaagagcaatacacagaagaatttattaatatgaacagatctgtgagatcccatactcatgtaataatatgtatgatgacattatcgaaccatacatttgcttgtgataagatttttagggttcttttttcctgttgggaagctgaaaagtttttgcctgattgaccactatgcatcagatgccctttttgttaaggcttttgagttttgagcccctagctggtaaggcttcattataagatgttatgagatatgagaggcatctagccgtataggttatacatccagttcggtcatggatacaaatttaattagaacccataacgggtggcagttcatatgatggtttgcttaggtataattactttaattagtacttccacagtctctttgtagcttattaatctattcataactggcactactacgcataattgacatttcacggacaagaccccctccaaactctaggtggaccataattgcatccacatgtaaaaatatttaggcgaggttcggttaagtgcgggtgggcctcttaagactccagtttgcaaaaatatcctatttttataatcgggaatcttaagagatctgcctataaaaatccattttttaggtgggggtgtctctcttctacctgcgctccactcattttttccccgtgcgcccgcacttccccgcttcccctttttaatcaccctcctctctcccggcttactctatctctctcccacttattcctcctcatcgcctctaccctcctctctctcccacgacatcatgcagtgacgtacgatggcgtccttgcgtggcgacaacaaccatggtagcggcggctacagcctcgggtgatgaggacatcacacctttggatacacacgttactcctcaagttgttttgcaagatccaatcactagagctcgcgcccaacaataaatttacaggtgagctcgttcctatatacttctttatgtactcttgagaatagattactacctaatgacttaattatgattagaaactacggagaggaccatggagcaattggagagtggctgagagatagacaagatcatcatgggcgttcaagtcatgtcgatgtccaactcatgtcaagttcgagtgcacttcgggctaccagagcagttcacactaaaatcatcgtcgggttgcattcggactccgatttcgacgttatacatatatatggaaagctaacgagaccaactttggatctggtcccacgccaaattccttctgagtcaacgggaatcttcgaaataagaaggcattcagaatttgtccgggtgctgtgtcacatctttgagcctgttgggccgtgcgtcgtgtcggggtttaatagggacgtgtccaggggtctaaggtcgaccctagaacctatatattcggtagtcgtcattgtgttagggttgggttttgcttagattatttctgccattgcagtttcgtcgctagtttggtatatgtaaccccaaattcaagtgcttaatcatttatatgcaattgagttgggatctaccttgttcatacttgtgtactttgattcgcatgcagggattagccttcttgtgaggtcaaccatgcagcgcagggttgataaccagatgagacgtggtgttgcgattgtaaggttcagatcgtgttgatcggaagttggatcacgtgtgtcaagttttcaccaaatcgagagttatcgatacctatcggaagatcgggacctagtttccttatcatcgggaccgacggatccaccgttggtgggctcgggaagggcggatccacctccaatagtctcgggagcagcagatccaccctcgtgcgttgtggagatgaggtagaagggcagcacggcgaccaaggaactgggagtgaaggccacaaccacggcagtgaccggcgggctcgataatggcggatccaccctcgtgtgcagcggagatgaggcagaagggcggcgcagtgaccacgacaccgggagcgaagaccatggccacggtggcgccgtgtggtctcaggaatggcagatccgccctcgcacgccgtatagaggatgtggaggactgggatcggcgaccacaaccattgcagtggcgggctcacaggctacgtttgcggtacctgatggcggcggccttacaatgatctacggttttggatttcttttctttttttatttttttaaatcgttgtagtcaggggtccttaattgaccgcttacaatgatccggtctttgcaagcggcttccttaggatgcccgtctgcgaaaatagtttttttgcatgtggttgtggtgcctgcatgataaaatgcggattttcacatacacctgactccagacacaggtgctccactagcctacaaaaactagttttggctgcatgtgaagatcatttatgtagtagtgtggagttgaaagttgtggtacgtagaatccaaatatgagggttagttttttaaaataaaaaaataaaatcagaaataataagggaacaattaaagttgtttggtagaatccagggtgtcatttatccaactaggggcccagttatacagagagtccttctgaagcccaattactacagagaatcctgctcaagcccaattaggtctacccagcttggtctgaagcaaaacaaaataagtccaattagactccctcaaatatactccaatccaattcatatccctaaacaacaatacctgatattttgacccctcaactatgaaaacgggtgtaatttgactccttcagtagttttggtgagtggttttgctgatgtggcactttgacttgatctaacatgttgagtcatcgtacgggacccacatgtcatcgtccccctatttcccttatttctatctccttcctcttcctctttgtcccccttggctcggctcgttcctcttctacacaatggcggtgacgggacaacgaggggagcggtgcggtggcagctgggtggtggtagaggggcggcggccggcgggaccatggaatgcatgaagctcaagctcgacaaggtctgtgttctctcccccaccgttgcgccgatgccgtgtaggagctcggcggaatcggccaacccaccgcccctgaggagggggagatcgaggacgacgacgatggggtccgtgaaatcatctattcatgaaagagagggacaaaaaggcagacgacggagggtggcagaatgtcacgccccgaactagccccgaatggaactagcccgtgacgctccaaattaacctattaatcgataccagtcccaggaaacagtgctggtatcacaggaagacataatatcacaacaacagcggtctctttattgcagagtaggagtacagtcatgttgggctgcggacagatcccgagctcacaactgcattacaaaaggggaaagcggaagccaagacttggaccaatcatcacaggcgcgacttgggaactaggcccaaaccctaaaactcatcgtagccgacttgctcctggaagaactcctcgtcagcgggatccacatcatcttcttcagcaactgggggggattatttatatagagtaagggtgagtacaggagtattcagcaagccatgggaaataagtgtttaatgcaggcttcaacgggaaggctgttgtttttgcaattgattttatttaaactcttttctgaaacaactaagtgagtgcttctcaaacgatgcggatgagacagtgcgtctcgtctggtcggagtatgtgcaatgtatcagtcttttgatttgatcaaggttggcacccggccaacagctttcaaacggccacccgggcctggctgatcccatcagccgcaaattttccaaacatcgaacccaatccacagcagcaaatttcacaaagcagtagtcaaacaaaactacgctaggaatcacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacggggcaaacagattaagtgtaatcctatcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaataaagccctattattgacctctaggcgtgccattagatagatctcgagatttgaggagttttggaagttaaacggagtcaaacggtctttcggttgggaagatattgaatttccaagtttattggatttttggtctaaaggaaaaggatttatttaaattcctttttgaaaaagaaaagaaaagaaaagaaggagggagggaaattagactttcctcgggcggctagggcgcagcccgagagaaaggggctgctcggccaaacttaacgggccggccggccagagaaggcggcccaaagcgcgcgcgcgggcggggaggagagaggaagccggtgggccgggtccatctcgcgtggtcccgggtgggacccgcttgtcggcggctcggctcaccgtgagcgaggtgcacacggggcgtgctagggtttggggaggggaggcgcggcgcatgcgcgcggtttgcgtaggacgcggtgcggcgggcccacgcgcagcctcacggctcgcggtggaccgcgcgcgcgagcagggccggagggagcggccgaccggggtcggctcgacccggtcgcggccgaggtggcaccgacgtggcgccttcgtggtagccacgtgggccggcgagaggaagacaaaggcgtcggccgcgaatggacggcgggcggcggcggtttctccgggacgccgtgcgacgacgaggggcgacggggtgtacaccggaatgacgagggagaacgagagggagcgagccaacggcttggattcgccggagggagttcgtcggcggcggattgcggcggcggcaaccggcggcgagaaaagggggaaacggcgacgaggtcacgaggggctgatttccggcggtgagagcatctacgcggctacgggaatccatcccttgcgccggattaggaggaaacacaccgagggagaccggcgacgagatacgcttccgagctcgggcggcgacggcggcgagcacgcggcgagtgacggcagcagtcggggcggtgccagctagctactggggtactacacatgctgctaaccgagtctaaggggaggagatgaatcgaggagggagaacggggagttgcactaccgagacgaggcggagcgctgtgacgagaggccgacggcacgggagtgatctctccggcctcgggccggggaagaggaagaaggcgagcgcccggagtccccttctgtgtcctagcgcgcaccggctccttcggcacacgtggcagcggcggtcagcgagacagaggggacggcaatggcgcggtggagcaagggcaaaagggagagggaaaggaaggggggagcttgggtttatatgggcgacaatgtcggtttgggagaggggaaccgacattggacggtcaagccagcgagctggcgctttggctagcggccaaaacggcgacagggaggaggggaattacgccggcgggagagaaaagggaaaaaggaggagagaaagggggcttgccccttgcctctttgggaaaagaaggagggagagagggcgacgcggcagagggaggaggagctctgcctccgtcccttggaggctagcgcgcggagtggcggggccgggttgtgacgacggcgatgacggcggaggcggtgtggagcggagcggcgatatgggcagcaggcgcggacaggcgcggcagaggctgacggcggcggcgaccaggcggtcggccaccacggcgtgcgcgcgggggaagcaacgggcggcgcggcgatttgggcggcgtcggcgggaagcggcagcgagggcggagggcgctcggctcggcgcggctcacgcgcgcgcgcgcggcgcacgggtagagcgggggagagagggagagagagagatggggagggagggagagatgggccgagaggaattcggcccatcgaacctgaggggtgcaaaatagacttttgtggagggatttgaactcgggatttgaacttgacgatagatcagggatttgagatccggaatggcacggagactgactgcaagcgaagaaacaattttcgcaattagggtttttagaaattacatttttccgctaggcgccacgacggaatgggcgctacacagaagaaaatgcaaaggtgaaaaaaacggcgcaaggaagaagccggcgagagactgccgccaccgctgggtcatggtgtccacctccctgctccccatgtgggcgcacctttgctccatgccgccgcagtagctcggagccagtgccgcctgggagaattaggtgagggccagcctctgcgtgcctcaggcggtgctatcccccgcggaagtcgcggcggtgatgaaatccgcttttgctgctccagatctgctgctatttgcttcttgcttgaaagccttgaaaaggacgaacgagcttgctgttgctagctcaaccctacaacaagctgctgctgctgcttgtttgcttgaggatgaagtgatgaactgaaccaaaagaatagaacgtcacccgctgcttcttgatacaacgctacagatcgatgaggcttgccctgggaagctgagaatggaggctcgaaagcttcagatatgtggagagcaaccacgatgatgacgaggctgcggcctcccctcacggcacgggtggtggagtcatcgtccctcagcccactgtattgaagtcgaatggggaagatgaaggagagagagaaatgggaaaaaagggaaggagtgtgagaatgacatgtgggtcccacaggatgacccagcgagatagacccggtcaaagcgccatgtcagcggacccatcctccaaaactgctgagggagttaaattataccagttgtaatatttgagggggtcaagatatccggtattgttgttacgggatatgaattagattagagatatatttaagatagtcaaagtggacttattccaagcaaaaacatccaaaacctgaacgtttcctctctagaaaaattatagaaaaccaaacctgcacattttctttctgaagaaaagagagaaaattgaagacctgcgaaaataacatcagcagtgttcaagagcatagtgttaggagaaattaatgcgaataataaataatcatgtgaaaactcacgaggttcgataaaccgaaggaaaataattacaagttggagggttttcatggtgagaacgcagaactcaacctcaactgctgtcacgaaacatcaattcacatgcaattacgatcattttgagagtgaaaagttcatgtttgctagctcaactattggcctaatataatgcatatccctcaacccaaaaccagattcaaagggtttcccaacgatcaaagctagatcattttgcctcacaacgtactcaccgtagccacgtgtgctcggcgaggaaggatgagagagctcagggcagcggtagaggcggcactaggtggggtgacaatagtggtagagaaggacagcatggagatggggtaaccatgagggcctgggttgcgggaacggtattgatgatcgattcacccttgccttgtcgaaatcagagtccaccacaacgttactgtttgcttgaccgtctttgggtctgacgatacagttgcagaagcacattgacaaggagcaatggaagaggatcggaggattcaccaacagcttgttgccgatgcacgatgtgttggtggcaccatgacacgaataacaccggcaggtggtcggagtttgcttgttcgagtttccctccggcgctgtcacacatgccgccaacttcctctttggaatagcctccttgccaggatctacaggccgctacctgacggctgatcatgggtgaaagaagagggaaatgagccactagttccctctacggctccgccatgtgctaccaccgcaactgtcaccctcccgctgaaggtgggagcgggagaagaggggagagagtagagagagagagaaggcgtgatgaagaagatgagatgggggaattacgtgtgtatcacatttttgttttatttatttatgagtgaactgcactttgtactagctgacttacgtttgttgcactttgaaccaccgactcatttctctagccatgcctatcctttactccagaaaatgtatggcctgctcataggtggacgatttcgctagcgtgctggagcca

SEQ ID NO: 64315 - DNA, 41566 bp, Oryza sativa
  unsure (1)..(41566): unsure at all n locations
gccgccgccgccgcctagcctcgcctactccgccgcaccccgccgccgctcgccgcctcatcccccgccgctcgcctccaccgccgccgccgctccctgtcgcccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgcgccgccatgtcgacgtacgcgtacgccaccacgtagcactccggctccagcccggcgtaccggtgcacgcgctccagatactgcgccacgccgatgcgcggcgccggcgcgcccctcgccgcctcgaacgccgccatccctgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataacaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactaagacaccacagtgggcatgcacactgatggaatatctcatctgtcggtgtctatccgaaagacagagggcaccactaagcnaacgngtccaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtctccaaatttttcatcgggggtttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtgagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcgaccatcctcaagctgcttgccagcgaagatgaggcgctgctggtctggtggaataccctccttgtcctggatcttggccttcacattgtcgatcgtgtcagacgactcaacctccagggtgatggtcttgccggtgagggtcttcacgaagatctgcatacctccacgaaggcggaggaccaagtgcaaggtggactccttctggatgttatagtcagcaagggtgcggccgtcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccgacgaggaggaggaggccgtcgccgtcgccgtcgccgtcgtcccagcgccgccgccgccgcagccggcgagcaagaagggaaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcggtgcggccaaacgccggcgcctgcttgtcgacatgcgtccaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctc

SEQ ID NO: 64316 - DNA, 540 bp, Oryza sativa
gatatccaggtcatcgtggtgactgcccacgtcgcggatgaaggtgttgaggctctgtggaggctgtcatcggtggtgggtgaggaggaaggcgcggtcggaggtgacgtcccgccaggccttgcagacggcacggcactgtgggatggattttggcggcagcaggagcagaatctccgacataatttcttcagggaggctggcaatggtgagaggcctgcgacgctgctgttcgggcagcctcaccgtctccgccattgccattgatcccccagctgacaatttggactaggaccctagtgctgctgcatccttggctccttgccgctctgaaactgaaatgcccaaaaattttccatggaaagagaacacattaggattccagaccgtcaagaactctaaagaaaatacagctcaagatgggtgcttggatctcacatgaatcaatcatctcgttttgtgatccgctattcatcctccctccgaatcgtcagagcaagtgactgatcataactgataaacaaacaagcaattaggact

SEQ ID NO: 64317 - DNA, 3749 bp, Oryza sativa
cccatgcatgacatactcatatttgtcagccagagttttcctgccagcctgaaaaggagatacttcagtgttaacttgcctaccgggagttttatctatgtgcctcacttttgtaattctacaagcaacagtggatacaaattatgcatccataactagcagcattcgatattacacagaatttcaaggcctacttgtactattgagtgtcgtacatgaaattactagcaaggggaaccacctgtgtaaagaaggcgctatctggggtaccatctaagttcaaagtaggaaccaagaccatggtaaatctgtcacctggatgcataggatagacatctgtggcaacatctaactgcatgtacatatcgaactggtcactgcgagcttcgatacgagaaactgtacccacaaaagaggacaaagaagcatgaagttatatttgaaataaatagcaacacattctaggaaaggttgtcatatataatttacagcatgtactgactgaaacatcagcgaacgcatatacaaatgatatggtgcggcaatcctagagtacagaacccctttttttaccttaattaaccacatgattctgcaagaacatgatttggttgacaacatagtaagtttgaaaggggaaaaaatatgaagtggttctttcttttcagttaggtatgcatcaataggtaaataagcttacaatatctaaatcatgagctgcaaagatacaattacaaagctcctcgattgccagataaacaactacgtgacgataccgcggtgcatcaattcatcgaagaaataaaaagaaaatcgtttaggggcatcctagcatctaacacagcatttatcgcacataacaagcagcgcaaggttttgaaaccattctcccgaaagtgagaaaaaaagagaatccagggattagtcacctctgtcaaacttcttgccatcagggtcgagcctggtgacagtgaagatgtcctcgaagagaaactcggccatcccaccctgacgtccctacatcagaggaagtgatcagtcagtgtaaaccctacgccatcgatccccccacaaaccactactaccgaagtgaccggaaaagaaaattcgattcgctccggcggagcaggcggactacttcgcagagatgggtggattgaatatcaaccggagatagcggaggaggttttatatgctgcgagctcaccggaagagcgggattcttcgtcagttcgtccgccctaggtcagggctatcgcaggcaggacggcggcgagacggcgaaggcggagcagtgctactcgggttgggtataaagccagaaaaggcaaggcccaattgggatttggctagcaggtccagcccaacttctgagtccccgcgaattttaggaggaataagttcatccgagatccctaaacttatcaacgaatccgattttttcgtccttcaaccgaaaaaacagatacaagacacaataggtccctcaactatcgaaaccggtgcaacataagtctcaaggctgtttggatgacgtggtgcctacacataactttaaaaatgtcatgttagaaaaaaaaatatttcaataatgtgtaattgagctttaattcaattaatgttgtacatcaaatccatctgagctctgcacagagcatttgttttttccattgtataataaaaaaagataggacatataaaccatttaaagtatattcatactacacatcgaacaaattaaatttaaaccaatatatatgcttgtcgtgccaattgaaaaaacaattgtactccaaaaatccattgtataaatatatattcttttccatcaaaacaagaacattgattgtttgcttcatgaacagtgattatttgatcaaataaaacacatatttccaaaagggataaatttgttttttttttacaaaagtggctatgtttaaattgccgatatcttaaattgtacgtcattgcagtgcgatttgttcagagtgaatgaaaagtgcattcataagccattccatttatcttgtttccaaaagtccatgatatgttagaaatcaatagggcataatatgtaagatattcctacaaactggccactggaattaacctgaaaaaggggggaaaaagaagcattggattatgctatcaggatgtgcaaatccgttcagaagaaaattgagaaccagtaaggcttgccaagtgcatcctacatggtcaagctcttatcttatactaccatttcagcacactttgtttttcagatcgatcattgaggatattatgataaacttttgctgccattgcgctgctgcatgcgccgcacatctacataatcctttgctctagggccagtgctccctcagcaaaaagatctatcagaataaacaaaatatcatcagaaaacacataggatatcattagaaaacagtcaggaatttcagtacagctcatcgcatatgcaatgtaagttgcagattgtttaaaacaaagatgaccctctttgcaatgcacaataatttacatttggtaacataataaatcgacaaacaaccatgtagttacctgaaacagatcaatacaaacatgatcaacaaagcaacatgatttataatacgaacccctagggaacatatcaaccatcgacaaactgctcttgatcaaatcaaagaacaacaaattggaacgcaacaaacacatatacacaggtaaaaagaaaagtagatcgagcgatgcttaggccttgctgtcaggcgggatcgatggcctgcgggagcagggatgaggagtcttgcgtttgacataagagaactttctttccagtctatataattaacaattggatagaattaatatactccaacaagcaggtatatagggtcattgatacactgcaaactcatttttattaaaaaaccaaagacattcctttgatcgcaggatgtgcattataccttcttggaacttgactctgtaaactgagcaatgagacgagggtatgtcgtgtcgaggcctcggatgatcccgcagcaattccaaccttgacaaatgatctgaaattgagcaatgatctgaaatccgagtattggaattgattcgggttaaaatactgtgatcatccgaggcaccaatttcaggttaaataccactaaccgctaagcaattccatcatatatattcagccaagtaaaagtaataggagaaattattgtaatgtcctaattttccaacccaaattaaactatttttaagtggagcatatcatcatgaaatttttgtgcctgagcttcaaagatatcatcaccatgcagtttattttaccaaaattagcagctgagctctatctcatcacgatcaaggaaaagggagaaatataattcaatgttctatcaataaaaactaaccttgccctggcaagttgcagcccaactgctcacgctgcacacatgtgctcgcaagtcacaattgatccaatatttgatgggatctatgatgtacaactataatgcagtgacaaccaatgattctcaagtatgctatatacactccacgttgcagaacagcaaattcaaggatccagtaaaactgttttattgactatatagacagaaggtttacgattgcatctgtgtaccatccgctgtcataatgagaacctggaaacaaaattcatataaatagatgtaaacagtagttgcatgatggaatcccaaaaatatttggtgaaatatcagtttttaataact

SEQ ID NO: 64318 - DNA, 533 bp, Oryza sativa
tttggcccggtcccaagcacagcccggaccgtgcctgggctgccccctcggcccggtgggccggcccggcaaggcccggtcaaataaaataaaagaattttgctgatttatttattgctatatccaatttatggaattgataccccgtttaattgatactatcatttagcaaaatgaaacatagcatatgcatccatctttcggctcgagaatttcacgggatagagatatggtataagaaataggctattaagtaactctaaatgaattgttttagctccggttcgtgaagaaccagagaagctttctagttatgaatcgggtatagaaccccctttatagcttcatgctgtttgaatagttccaattaatggaatcgaagtcattacacgagtgagtttagcaagtggaatatctgactttgaaggagctgctgcaagttctcgaattgtagttgtcaattctggaatactttaattaactatttgattgaattttcccttccttttatcctcccgtcttatatgggggat

SEQ ID NO: 64319 - DNA, 2806 bp, Oryza sativa
  unsure (1)..(2806): unsure at all n locations
atagcattttagtgaacaccccttagttaaggatagtattttaatgaatcactttgaagggatagtattctagcgaaaccatccgtttgagatagcaaaatcacaaatttctcgccggcgctgcgtgcgagagaaagagaggagaggggtcgtgcgcggggtgggggtgggtggggagcgtgcgtggggagagaggggagggtaagggatccgtgccgttggattgtatgactatgatttgagaatccttggatttgatgaatgaagtatgaaggatgtaagcagtagttgatgaatctatctatctattattatattattaaatgaatagaaaaagaagcctccacgtttgttctcatggcctataaattctcacattaatcggagaaaaagaaaattagagtccatatagaaatacaatttagaaatagctgaaattcggaattaaaaaataaggaatattagaataggggactagagtccatatagaaatacaatttagaaataattgaaattcagaattaaaaaataagaaatattagaagaggagactagagtccatatagaaatacaattaggaaataactgaaattcggaattaaaaataaggaatattagaagtagggtatagagtccatatagaaatacaattagtaaataactgaaattcggaattaaaaataaggaatattagaagtagagtatagagtccatatcgaaatacaattaagaaaaaaatataaattcggaattaaaaaataaggaatattagaagtagagtatagagtccatataggatttttaaaactaactaaaattgggaataaccataataaaattaaaagtagagtttagagtccgtataaaaatacaatttacaaataactaaaattcgaaattaagaaaaacatgggaagaagagtttaaaatcaatataggaatacaatttagaagtaactgaaattcgaaattaaaaattaaagaatattgaaagatgagtttagagtccacatagaaatacaattagaaataataaaaattcagaaataaaaataaataatattggaagaagagcaaagagtatatagaaatacaatttacagaaaattcagaattaaaaaaagaaaatattaaaatacgagtctagagtccatataggaatatatataatttacaaataactaaaatttgatattaaaaataattaataactaacacgtatataaaatacaatatggatattacacattagtagttttgtaaagttattgcaaaattttaaattatgttgtcattttaatatattcgaataatataatgagaaaacatatatacttttatatgagagataatataacgatgctatccgcataatctgtgcgggccaccatgctagttatagggtagaagaagaataatcacctatttaatctcatctctcctagctaaggaagagcaaggaccatcggcgagtggccgcgagcccgacctagctgaccgtcgcgccggcgccgcacgtcctgctcatgcagctcatcccgtacccagcgcgaggccacatgcagcctctgctccacctcgccaccgccgccctccacatgcccgccgcactccacgtgtgcgggcgcgctccggcggcaacggcagggtggtggccgtgctgtcggatttcttcagtggacgcagtcgctcgccgccgaggcgggcgccccgcggttcgtctttgcgccgtccggcgtgttcgccacggccgccacgcactccctcttttgtcgcatgccaaggctgccgtcgccaacggcggatgcccggtcatgcgaaggagggatcgcagcacgagctgccacggcacggcagggaaggggtgccacgacgcggtcgtgcagctctcggcaccgcgccgcgcgagctccagctcatcggagacgggtggcgccgcggccccgaactcctccacgagccaccgcgcggggtccgcgtcgacgccacgggcgaagacgaggagcgctcctgccgccaacgccgtgtcgttctcccgcgtcgccgccggacctcctcgtgacccctggaggatggagagaggagagggaagagagatggagagaggagtaagaagggtgagaatgacatgtgggcccacgtgggccgcaccattttttaattcattcttttggtgtaactgacatgtggggtcaaagtttttattattttctaaatcaaattgccacgtcaatgccacatcaatgccacgtcagatgaagaccgaatcaatttagccacgtaggcgccacgtcagctaaaaccaccgtgcaaaccgccatgggacctatattgcattggtttgacagttgagggactcgttatatctggttttctggttgaaggacaaaaatcggattcgttgacaaattattccagaataagttcactagaggttcctcaannnnnnnnnnnnnnnnnnnnnnnncccttcaacgcaaaaccagaaatgtgtacccctaaactcacacaaaacgttcaaaagaagtcccatggcagtatcgactcaatttttgcccggttttactgacttggcgctctatgggccccacatgtgcgccgttgaggcgttaatagacgggggcgacggtgggcgagcgcggcgggctgtgagcagagcagcggtgcacgagtgcggtagcggagcggcgacgggctgcactcttcttcaacgagcttgggaggccggcgacaggcgagcgcatcaacggtcgggagcagcggatggagtagtggttaccgattccctttcatgggcccaccaact

SEQ ID NO: 64320 - DNA, 9757 bp, Oryza sativa
atcctggcacattgagtggggttccccatcgatctcctcggctgtgcctccctatgtcgcctctggctcggtctctgccagttcctagacacagtcggccttcctccagcctttgttaacctacaggagatcgttgttgtccactcctccatgcaggaccacgagcttcacgccgtgctcccccgctaccccgggctcgagagtctcgcacttgtgctaacacatgactacccgagatgcgtccatatctggtcggggaaggatggctcggacgacgacgcgacgggcggagtaggccggccgtgctcacccaccgccgccacgctctttgtctagccacctccgccggtgcggcccccttctccgcccaccacctgttccgcccaccacctgtttgtcgcgttcgcccagcaccactccgctaccgtgctcacccaccaacgctccatccgccgccggcctcccaggctcgctgaagaagagcactgcccgctgccagcctcccaggcccactaccgcgctcacccgccgccgctccgtccccgtctattaacgcctcaatggcgcatatgtggggcccatagagcgccacgtcagcaaaaccaaacaaaatttgagtcggtattgccatgggacctcattcgaacgatttgtttgagtttagggtacatattttttgttttgtagttaagggatctcagaaaatctcataagttgagggacctccagtgaacttatccgaagcaaaatgggctattaatagtagagtatatgattttttttaaaaaaaacagtaaatttcataaaaccacgccaattgtttggaatgcttttgaattatggaggagttatttttttggagtactccatatgaaatgttgcgcattgtccaacaaatagtatgaaatgttgccaacaagttccctatgaaaacatgttgaatcatttctttggaattttttttgaattatggaagaaaacaaataatgaacaataaaaagacaaaagtgaaaaactctatatataaaaatggagataatttaggtgactaaatatttgatacaaagtttcatatctatttttataaaatctcgtgcctatgattcaaaacgacctcccatagagataaagttgtagagctcaatagaatctactactttatagaatttatatttgaaattatttgaagcgtaaaacaaatattatgaattttaaagaggtgacaaaaaatgaataacaacttcaacatagacaaactgcgcaggtgctgggaggaaggtatgacgccatgagacgctaattttggactatttatcaagaaatgtccacaaacatagttgtactaatatattttaggctgcatagatcctgagttacgcgtaacgcatcaatggttaagaatcctaatacatgtaggagtaagttcactcagagacagatacacacaaactaagtcaacagcacgagcactgattagacaggcagacagatatagataggtggagtgtactgctaactagcagagtaacccatcccgaacaccacctaaactagcaataatatgagatacactgtcgttgtttcaatccgccaaatactcccgagtcatccatcttgcggtgaaagcgtatgcgactctagagcctgttgcttcgtagatgttgcaaggcatgctggactccctatcatccgataagataaagtgaggaaccttatgacttactgcaaaatactgaattgagctcatcagacaatgcatcacctgaaactgtcttccctgggttcgctcaattgcgcgtgcaattgagatactgcttatagcagtaaggtacagccttccgtaaccagtagacatgccaatcaattcgaaactgttgttaagaagaggagccccaaattcggagtcctcagatatacaaggattacactgaaatgctatatcgctggtagttccgctgattaaaagaaaacgacagaaatgaattagaatatattcaattaacataataaaaacgaagggattggaaaagcaatcaattgccttgacttacataatgttcccagaagtaaccctgcaatattcaggactgaagagatggatattctcatgcaggctgggaagcgtttcacacagaggaatctcttctacatcggtaatatcaaaaccttccggtatggaaacagggatcatggcgatatcagcattaaatagaatgtgatctgtgtcaacaagaattttttcatactcaaaagtcaccccgatccctaaaacttcctcataaaagtaatgcccgcatgttattacgatggcattttttgaactcaggccaataactatgccgaatatgtctttatcgccaggtgggtatgtgacggtaacacaaacaacacttctgctaatgctgcgtggaatctgggattgaacctgtgcataacgcaaaaggaggtttttggattcgaaaagaacccaaaaaaaaaattgtaagactaaaaaatgctacaagtaatatgagaaattcgcaccggctctgccatatagggcagctctggatggcggggagtgtcgtcttctaggactaggaggccggagtagagatggcaacgggcttgtacgaaaccacccccgatggccaccgtagccgttcactgatccgatgggatcttttcaccaagacggggaagagctccagggcccaggcaatgcgagcaagacggcggccggcggcgttgctcccagatctggatgaaaaagcgaaggagcggtgagcgctggcagatctggagagagcggctctgggagatgagatctggagagcaaggaatagaagagagcgagaaaacgtacccgcttgcgctgccgccgctgctgttgcctgctcgcgccgtcgcctgctcgcgccagcccgcgccgccgccacccgcttgcgctgccgccgccgttgtgtgattggggtaggagaagggagcggggaattagagtagggtttctagttggatatataatggcctgtttggcacagctccagctccaaccacacctctcctgaagctagagctcagccaaacagtttcagctccacctaaaatgggagcagagctgggtggagctctctctcaaaatgaagggcctgtttggcacagctccagctccacccctcctggagctggagctcagccaaacagtctcagctccaccaaaactgggaatggagctctctcacaaaatgaactagagttgtggagctgggtttaggcagctctacaactccactccagactcaactcctggagttaaatttaggagttggagttctaccaaatagacccgaactagagaggtggagctgggtttaggcaactccacaactccactacatacccaactcctggagctaaatttaggagctggagctctaccaaacaggccctatatatacaaaggcggctccatgaatttttcactgggtgctcctactccacgatccaaaactttttgacaccacgaactcaatttatacatatccaaattttgctcagacacaaatatgacaataatatctctaacatcataagtccgataaaataggcatttgagtcaaaaaaattgcaaaaatataacagtaatagtccaaatataaaaaatattacataagtagaggattacagtactacttcttttctactctatgagctctcgtacccatggaagtgttaattatgtcatctctttcaatgaaagtattaaacaatcattcaacaatttgtcacacgtacaatttctcggcttattcttcactagacataatgcagaaaacaatctctcaacacttgttgttgccaccggtaggatcaataccaatttaaggagcaaataggccaaatcatagaggacattgtttgtctcgacaagtttaacagagagctcaccaagattttgtaggcttttgaatctttcattttgtctcatgtcttcaataaaattcgctgcttggaattattgtcttattatatccatgcttgaaatgtccttaggataaaacttggcaagcttaagtactttttgtgcatcataagaagcaaatgaattagaagggtttaatgcagccatgcaaatcaacaactccatattaacctcatcaaacctattgttaagctcttggctaatcttgtcaataacaccaatataaacttctcttctgaaatgatcatcatttgtttggtccagataaaatcttggagatctcccatgaggcacatatttctcatctaagagtggaactttaatgctatgcttagtgcaaaatgaaagaacagtcccttcatagaattcttcccaaccatcatttcttaatttttgcattcttccctttgccaaagttactagtgtcattgcattcacaatatcttggtctctcttttgcaaagacatagacaactcatttgtatatccaagaatggcaagcatcaaatgagcactaaaaacaaagtcaaatgattcaaaagccccaaccatagcatgtttttttggccaatcgtctctttgtgtgagatctttaccaagagttataagtacatcctgaattgtgctatacataccaataatatgcaatatagttttaaaatgagaaccccatcgagtgtcaccaggcctagctaatcccatatcttgatttaatccaatcccactttctatttcacccaattcaagtgcttccacaagtttttgagctctaacatctctaagcatgtcatgacacttacaagaggagccaataatattcagcaagtgagagacttgagtgaaaaaccatacacaatcatcatttcccttggcaaaagaaacaagaaccaattgaagttgatgtgcaaatcaatggatgtaataggcagaaggagactctttcaaaatcaatgtcttcagcccattaatctttcctttcatgttgctagccccatcatatccttgaccacggatttgagtaagagtcaagtggtgatcagttagttaagtctgaattgctttcttaagtgaagcggaggtggtactagctacatgaactactccaaaaaaccgctcgcatacccttccaaatttgtcaacataatgcaaacaaagagctagctgttctttatgtgaaatatcactacattcattagctagaattgaataatgatcatcaccaagttcttcaatgagccgcctagtagtttccccgtcacaacattagataatttgcctttgtatgctagaacaagtcaagatgcaatttctaggagcatttttcaagaccaaccgatcaacttcttcattatttttagcaagccatttcaaaagttcaataaaattccctctattgttagactcttcactttcatcatgcccacgaaatgccaacccttggttcaaaagaaatctcagtcatctaagtgaataagttagcctagccttataacaaatgatcaattaatatagtagctcaattagagagcagattttcatggatgccaaattttgtggactgaaagtaaagttgtaatcaactaaacatctataagcattgctgaagtgtaaacaataacttcaggactgatcattttaggagcatagtgacaaagtgaacttaataactaggttagaaacaacttctataataagagagaagcatcttcatggcttattgaactatgctgccttgcatgtgaataaacctcaagatacaaaagggtgataatttccttacacctaggaattttaattttaatttacaacatgtatacttatcgccttgaaattgtatgctgccggagacctgcgcaactaggggcaaattgtcaaattatagaatttgagtgtttgtcaattgcaaaaaaaaatttaatattaattgttcccgttgcagcgcacgtgcacccaactagttgctaaaagaggagcatgccattttttcccctactttcgaaatgaattcatgtctgaaatgtgtttcatgggggctgcttacgtccttctatcgtggatgaggactgagaacagtgaaacaagcttttgaattttcttcttgttgagattataggcatataatgatttaatctattccataaataaatcatgacattacagatgaaaactagcatgaacgcatcattagatctacacatataaactacacagtataacatgaacagatcaaatatgcgcaacatattgaacacgtaccgaggtggtagaaagaccggctactcggcaggaacttttcgcgattgcaagcgtctacgaaggcacgcagcacgcgagcgaagaggaagacgagccgtcgcggacgaacagggagcagtcgcgcaaagcgcttcccaaaaaacttattgccgccttctcccggtgcagaacgtcgaaggcagaggttccagagacctgctctcccgatcgcaggtgcacgccgacgagcgggatggagtaatctacgagcgacggcgcagcacagagtcggaggcaaaccctagattgatttcgcgtgtgttgcgtgaagacggcgggtcgatttatatagagaagggtcacttgatcagggcgcccgcacgatctccactgcgcgtaaccgaactggataagtcgcgcgtaacttatccggactccacgtcgttttgcacgcaacggatttttcggaacgtttccaaaacaaaaatgaatccaaatttgcggcaaaacaaaactgcaaaaggaggctgcatctgcgcaagggtgaggagccaattttgcggaccattcgacgcgtatgtcgtgcacgcgcgccgcctgccctgccctgccaggcaagcgagcgcgcgcgtgtttcccctcttctctccactacacatgcttcaagtggctaggagggcatcctcccttttaaggaggtccccctctcctagaataagcaaggtggtactaaactccacattcatgccatcccatgaggtgggctccacgcatttaacaggtcaagaagcttcaatcaggttgaaggcagctagctggctgaagctaggaacatgttaggatttgtttgacagcaaagaggttcttatgaaccgttgataaccacatgataaagttcttatgaaccattgataaacatgtcggggagaagattagcttgacagcaaaaaggttcttatgaactgttgataaacatgttactttgtttcgctgtttatgaacttttggccctttttccctccctacatttcatgtgtttgtttgttcttgtgtctagagatggagagagaaaaagccagataattgtcatggatttctttttctcttttcttttaagtccgaattgtcatcatcatgaatttcattgataagttccttttcttgtttcaagtggctcttttgatagaaacgctagtgaacactcatgaagcaataagcatgttctgaacttttttttgtctagatttgttaagatcttgttcatgtttatttggaatatatacatgcaagttttcattggatcaagatgagacaagaaatgttcttttcgttcccctctttgcctccacggtcagataattaaaagttcagttcttgtggcatcactatttccccttttttttttcacagttgcttcctgtatgtatttttccacttttctggctagctccaaatgtgatgggttagtcggcctggattcgaagcttcacctcttctatttatttgatattaggtcattccctaatatttacgttttttaatcaccattgtaacttgtaactgcatttgttcaatgattcgtttgtaagtgaaacaataatgtaagtgacctcctgcttacatgtacaaaaacatgaactggaatatcttacgatatgatatttgatgaggacagcagcacacaccttgtccaatgtccattaattgctcactaatttttagataatggaatataacatccagaaaagtgtgtagttcagataaaataaaacacaccaaacaaaagcagaggaaaccaagccaaaataaggagaactcatttattcaagtctatttgtgaatctcaatccataattagtaaaaagttacataaccactgtctccaacttgtgacatgcaacttttagtaatggaaatacttactacttattaatggaaattcaatagagtccaaggaaagtaattaaggaaaaagggagaaacaaatggtgtatccactatccagaatattgatgcttcaacacagccaccatctaaagccgtacaaaagcaagttatttttttgaacgaaacaaaagcaagttattgtcctagtcaaattcaactaagttcaaatccatcatctctctctactcaaaccagcaaaaacaacttttgatacattttcatatgcaactttcgagtttttaaatgaaccaagaaatgtgaagcacttgttttggtaagcctttgaacaactttcaactgtgcacatctattgtttcctatccccgaataaaatgtaccccactcatagaaatgttttttacacacaagtgcctttacagcagccacagtgtgtccaacgcactttacaaaagtacggagtagtagttcacgctataattagaagtttgattgaaattggaacaatgtgatagaaaagttagaagtttgtgtatgtatgaaagttttgatgtgacagaaaaggtaaaagtttgaaaaaaaagttgggaactaaaccaggccgtactactactacgaagtgaaaggaaagggtttactgcgtgctgaccctcaagagctatgtaagtatgcaaccaagaaaacactccagactgcaagtttaagcaaagcaacagtagctgtttgcaattgcttgttcaatcatcataactatcgctaaacaaaagaatttatttcactgtattatccaccaatgcgcaagccgcaagcaccaatttttacaaaatgcaacagaagttatcaaacaaaacaaaataaatgctttagacaagatcagccaagcacaaaagagaactcaatttattcctctttttccgtccctcttctgtgactgactgactgctcgagtgctcggggatcaatcttctagagaagggaataaatagaaacagctttgatagaatttatttcaaataaaatcaaaattagcaattagtaaagggcggctaaaattattttattgcaaacttaatagattggtatatactacgtactgtgcctgtcgaggtggacgataatgatgaattgggagaggcttaattaggtggagattggagatcaataagtggaattaaggatgacctctgatcttcacattagtgattagtgatgacgtttttttgtgcgcaattcctcttttaagtggctttcatgatgcgactggatttagtaacgggccgacgacggaaacctgtttatttgggcctgattggcacagatggtagtgccatgtgcactcttgaaacgttgatttaagatctaacggtttcagctaattggggtgatgtggctaattctcaaagcagttttatagctagtggataccaactataccaactatacagaaagaagggattcctccgtccaaaaaactggacgtttcactgccccggcgctgtaaaaaaaagtgttattttagcaatttacattcatggaaccagaacgtgccgagttttgatttttttccctaccgtgatggcatctcgcgcagggttccccttaccttttatggcgcgattaccgccaccccctccccccccccccgcggtaaggcgg

SEQ ID NO: 64321 - DNA, 5729 bp, Oryza sativa
aaaccgcgtggtaaccacgagacatacccgtggttttaaaaactgaaaaggttaccgtgcatggtaaccgcgcggttttgtaaaccctggtctctcgtcaatttagtcggtatggatggataagagccacatgcgtccgttctctctctctctctatctctttcttctcctcttctcccctcctccccttggctctctctctccatctccaccgcgcaggagagcgcaaccctagctacagcgcatgcaggggcttgtcgtctcctctctttcttcttctcttctcccctcggctctctcgcaccctcccctcgcctttctcgcgcgtcggcggcggcaccctccataggaagggaggcgggggcggcagcggcggcgtctgcgcctcccctccgccagatttggccgggagcggcggcccggcaggaggggaggcggggacggagggaaggcgacggcccggcggcggcgaacgggagcagaagcaaaaatcttgtgttcatgttgggttcttgaagtgaaagtgaaattgctcgatgcatcggctcgatgcgtaatggatttgtgtgaattttattccttttctttttctggggttatcagtcggtgtagttcttatatttgaaagtgatgattgctcgattgggcttttaatccatctttgattttgtgatttgcccgccgtaagcgattaggattttgaatcgatctctgattcttttgtgaattggccagcgtacgcaatgaactcatacggatacggacacaatcagtgacgacgcgcaaaatttgtggcaaaaacatcttaaacttttataatagataaagaataatggtataaaataatagatccaccaatttaaatgaaaatcgacggtaagattatagaatgccacgtggcaatctgggagtgcttgtagaaacgccacatgacggcttagaaacatttatagaaagattaatggacttttagtagataatagatatgattaagtggagccaggtcttatatatttctagtttcttgatccaatagttataattctagttccagatattggctccaggatggctacggttcttgccgtgatgctgtcggcctgtcgcaggccgctgccctcctcatccacgcacaagcagtcaagcacctctcgtagaagctaaacctgacctggtgcagtagcatgcagagcatgcgtggactaagctacgatttgctgcacagttgaagcatgaataaagggctattatgtcttttcaaaagaactaacggtgcagtagctgatggcagtgataaatcgtaaccataacaaacttagggcgtgtttggatagtgccctgacctgatcgctctcattcagacgggtgcatccaaccacagaccaccaaaatcggacgcctgagaatcgtgcctgacttaggcgtgattctcagggtgtgaagcaaacaaacccttaatgacatataatatattttctccacaaaagcaaccaacgaccagtcgttgctgaaacttcaacaatagttgcaaatagataatatccaaaggcgccaaaataagagcggcagatattaaaatgtcaatagttccaagcatgtaggagtacttgagttgatcctaaaggataggctaacaccgctctaaagaatagtgctgcatctcgatgcttacagataatacagacgcatgtgtagaaatgcttaagttgatcttatctccatgctaacagattagcctaagtacggtactgatataacatctggatcaagtcttcaacagggatcgtaccttcgtccacctgaaaaagattaaaataaataaacaatttactttagcctacaattaaacaaatagttcttttagcctacaatttagagaaggataactcacaccaagcctcgtttccaaaaaggtgatcaaattttcagtgcaaactgcaagtgatgcttggtatgcgccacgccctagtattccaataaccttttcttcatgcaggaggggacttccagagtaacctgctttgtttgggcatgtaaattgaatctctcttcttgttatatgaggaccatattccactttgcatggtgcactgcagatcaattaaagaaaaaaaacacgatttttttgtttattagtacacagctcaacgaagataagtttaattctcctaacaaaataactgaggtacaaaatataccttattccacctggggatacagtaggtattgttggcataattgcagtttgaatattgcagcctgggagttgctccagaaagcagtttcctaggaggaagacaggagtgccgactggcaaatccactcccggggcaaaacgcaacgccggcagcataattggcatgttactaactaagatgaaggcaatgtctaaaaatggatcttctaatattaattgaccttgcatgtcctcttcaacaccctgcagaaacctaatacgcagcaaatccgtagctgggtcaaagcccttgcttcctttgaccacatggcgacatgtgagtacaatgcacttgccatctgctgtagaactgatgataaatccagagcccgcaccatgcataacgactcgacggccatcaatcactttgacagggtaaacgataacaatgctgggccgatgttgacgagcacgctccacatcgacttgaggtggattggtattcaaattgagacctaaaaagaaaatgaactactaatttggttaaaataaggaacccaagagtaatcgaaagggaactgacacattggatggaactgaggaaactgcgatcgagcggcacacgcccgcaacccgcgcaatgtcgccgaccagaggtacttccctctcgcgcggcacctagctagtccacgcgatagatcgatcgaggcgcgcggctgctacaagtcggggtcgggcgcgaggcagacgtcgccacgaccaccaagcatatgctgcggccgcagtgaggaaaaaaaaacatatgtatagtagagagagagaaaaaatacattaagcaaagaaaaatctttcttgaaaagaaaaaaacaatgcgaaatatatactctgttgctcatacgaatcaaaccaggtaagaaaaacatacactattgctcatacgaatcaagccagcaagatataatatacaaagatgatgtatgcggagagggagaggtggcgtaccacggcggcgatgcctttgacggtctgcgcccctccgccctcgagtacgtagacatagcaggcgtgccaggtgtttcatgaatggtttcatggttgatgagaggagtggaaatgagaggagaggggaggaagaacaagctagaggaaggggaagctaaagtggagtagaactgcattaaaaactgtgagagttctcttccgtcaccatggtcacgagctgctcagctctgctctctcctctctgcgtggtttccacttacgttcataacattcatatgcagcagattttgaaaaaggtgttgacctcccttttttcctatttggtgaagaagctccgctgtggcgctggagttctttcttttcgtttgcacaaaacccctcctacttgtttagaaatattatgttctatagttcacaagtgcactttttggcccaaggtactctaaaaacatccttttcatatgacaaatgtcttcggatcttttacatgcatttcatagatttttgttcttgcaaattgagcagatccaaccttgacgaaccagattgagttcttggcgtccgtgtttgttccattgccgccgcacttcacttctcaacttcggtactcggtagctgctgctactacttactggactacctctgtatataaaaaatggcttcatcatattcaaagctaatttccttttgggaccgaggtagtaactattactaaacggcataccaatactctacaacatacttctttcataccaaaataaacatatgtaatggtatacaaatactctacaacatacttcttccatcccataataaatatatctaacggtatacagcaaataccgtattccttccatatcaaaataaacatatctagaattagatggaatattatctggtgcaaagaatctggacatgtttttatctagattcgttatactaggtaatattctattatatcttaggttgacttattctgaaacgggggagtaagtaattaggcaaattttacaataagacaatgcgactttacgattttagctcctaaacacgtaaaagacaatctttggaaaaaaaaatacactgtcaaaacactgatgcttgctgctagaaatcgcatccattaaaatatacctttttatcaataggaaagaaaaacaacgtggtaggtcaaaaaaaaaaactcatgtcagtccttccatctctctttctccctatccccatgcatcgctccctcaccacgcctagtgtcagttaggcagcaccattagcagcgcgtcgtgcatgtcctgccggtcatgcccgcgccgcacgtccctcctctctatctcaatctctctccctctcttcctccctaaattaatgtggattcttctcaatacattcaattttgccataattttatctttacatttgatacctcaaacaaatcaaccaaagcagtcaaacaatggattatttctaaaaccctaattggcaaaaacattgcatcactcaaatatgtattaactcacatgaatgtgtacaggtaacataatttattcaaatattagtttatttatcatacaacaatatatttttccagaatttatttcatcagtttaaaccttaaaataaattcaaacagtgctccaacaagcctcttttctttattttcctgagaataatataccctgaatttttttagtgcaacttggaaaaatggaaactagacacttaactatcatcacaaaaatccacactattttatcagccccctaacttaaactattgaattacaaagaagtgaggacgaaaataaatgaagaaaatcctgaaaatcactcaaacagtatgttcagtgatttgcttacccatccttctcacgccctggacccacttggcagtcaccttggtccttgggtcgtttcccttgtgtgcaccatctccagccgaccaaaagacacagaaagaaagatagtagagcgagaaggaagcggtgccgacgcgtagcctcatcgtgcccaacgccgaacacgtggcctggtttagttcgcgaaaaaaaattttttggtgtcatatcggatatttgatcggatatcggaaagagtttttggacatgaatgaaaaaactaatttcataactcccctgaaaatatcgagactaatattttgagcataattaatccattattagcacatgtgggttactatagcacttatggctaatcatgaaacaattagactcaaaatattcgtcttgggaattcccttttaactgtgcaattagtttttatttttatctatattttatgctgcatgtatgtgtccaaaattcgatgtgacttttttggagaaaaaatttgggaactaaaccggtcctttatatcctcctagctgcctcgccttccctttcatgttcgctcctgagttgaagaaactgagggggagaacttcagcccccctcttccatctcaacctcgtcgccggccgtgaagacgacgaccgtcaccagcgccgatgagccacgattgccctctcttttcttgtgttcctcaatctactctcaatg

SEQ ID NO: 64322 - DNA, 662 bp, Oryza sativa
gtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattcttactgaccgaaaatacccttctcagaaaaaaaaaggtttttcttactgaccgtgcaaaatccgattatagctgatattatgatgactcatgtgttataccttatgcagcagacaacaattttggaaaatcaatttgggttaccttcacttgttgataaggccacagctaacacaacaaatcttgtggcatctgcgtcatcttccatgacacccgatgaaataggagaggggaaaaacaatccagatgaggtaatgccattggcatccatcgcttgtttattttagaaatcctatgtaatgtgagtgctttgtgttatctgctgcttgcatagcttgaatgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggaga

SEQ ID NO: 64323 - DNA, 1759 bp, Oryza sativa
  unsure (1)..(1759): unsure at all n locations
aattccattgtattttgtgttggtatcattaaggtttttattttggctgcagaaatagtataaccatactttcatctatatattcaagctcttatagcagctgatggcaatgtgtatcattttgtactgcttttctctatgatgatatttgtatggataaattccttctgtgctactggaaggaaatcaattcctttgcacatttcgttgagagaatagttaccgctccctctattggtcagaccgtgctcatcatgactggtcagactgcgccctacctcggccagatcatgcctcttgtggccggtctaaccatctcactaactgtcggtcagaccaagtaccaggctggttagatcgggctacctatagccgtcggtcagaccaagtacctggctggttagatcgggctacctatagccggtcagaccaacaccctggagccttttcctgattttgtatgccacaactaatggtaccgatgttaattgttatttgattttgtatgccacaactaatggtaccgatgttaattgttatttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaactttgtaaagcttgactgcatgcacgcattagtcaattttataaagatgtgcattaaggggacataaatgtttaacaattagccgggtcctataaccttatttcttaaaaaaaagaactatttagacttcattaatatgtcaaccattgtattacaataaggaccaatgtttacttgtataagtatagagttcgtattaatgcaatcaaaatcagctagtaaattaatttcgaatggaagttcccacaaccagattaaaatagggcttttaaattttttttacttacatattgtagtgtgattntgaacatnnttcatatttngtgcatcacatagcattttgaacgagcaagatataatcgtctttttgtttcatttcatccatcatattgaattgggacnattttattcttgctgctactttgattccgatattgtttttccctattttttggttttcattatttcttttcaaatattttttatagaagttagtgggtccaggattgctaaactaaaaagtaacaaaacaagaaataatattatttcaacttaacagttaacctttctacccgtggagattttgccatatgcaaacaatacccttgagtcattttcctatcccaaatccaaattcatgcccccaaacctaaggcaatagcagctcagccaggcggcgaagaggaggtgatgacagcggcagttccgtgtaggaaggaggcccagccaggcagctgctccttgtagggaggaggcgacagtggtggcccaaccaggcaatggcagtggcagctcctcacagggaggaggaatcggtgatagcctggctaggcggcggcggctccttgtagggaggggtgacggtggtgacgactctgcataaggaggagtcagtggcctagctagagttcaacgcaggaagacggcaggtcagtgcgatgagatggcggcggcttggtgtggggagg

SEQ ID NO: 64324 - DNA, 16041 bp, Oryza sativa
  unsure (1)..(16041): unsure at all n locations
gttacacgcacgatcngcacaaatattgcaggtctcaaaaatgcaccactcaattctctttggggtgtattggttgtatcgtactacgacacgacctccccngcggctcccnnnncnnnnncngtggggtttgaancccngtttgattgactnccctgcaagnagnncatcagtcttacattgttacattgcgttcacataactttgcacagagagatggatatttgtatgaataatgaagaaaacaacattcttacatacttgcattacatccatatctataccccttacaaaagggagtagtcgtgggggttgttctgcccccccaccccccacccccccaaaaaaaaaaccaccaccaccaccaactcccaactttcttttagagtaaaaatgacatgcggggctagaggacccacatgtcaaccactcccactaaccctctactctttatagcaaggaaaaagaatagtgtgggaccaaagggcccacatgtctgtaacaaacatatacaacaattaagagatggtaataataggttaaagataattttctttaattaattaaaatcccgttgcaacgcacgtaaaatatgctagtaacctataaattctttagctaagccttagcagcattgtgtacctacattttcatgcatcttttttctgtgattgttggttgccaacccaaccatgaaaagagaggaaggtgtcttgtgcagcccatcagggccccaagagtagtccacctctctagggccgccggtactgtacatgaacagtaccatgtggttactgtccatgcgtggtactgttcaaattgggtgttgcaacagagataagattacatttatttgttatctatttccttaatctgagacataggtttcctaagggtcaagttctcccatctatgtaagggtgggtatgtatcttatttgataagtttgttatgggctttgattaatggatagggtaaaaggtccaaagaccgcgataaaggtgggattgcactggttggcgtcatgtttgcctgttgtgccaggagcccaggacctcaggagactctgatcaagttagccgaactttatggttttttgcttaattcccgatggggtacatactagccacatagggcctgtagggagaacactttacatccaaggaattaatgtctactatcagagaaaccaatccgatctctatctctaatttgctaacaaatctcatccattggctaactagataatctcctatctttatttcatttattcttaatttgctaattgacctgctaagtatccgtaaggggttaccacaagcccattacagggttactgtaatcttgttggcccattggaaagattggcttgtttcaagctgacaagtgctagtgccattcaaatgataaccccgtactatctgcaaaaaaagagaaacttgcatgatctctagggtcaaatgcactatctgtagcttacaggtagattagatgggtgcatgtagatgataatacctgagagcgtcaattagagtgagtacacgtgagaggtgtctgcatgtgttttcaagccacagatgatgggatttgacctagagctagcacaccacttcaacaagattagctgttaaaatgagcagttacattcattcacccagttagaagttttttagacccagtgatgatatatttataatacatcgttagggcttatgttttagatcaaactgattgttgaaggcaaagggaacatcctgtaagtaaaatgccctagccaaaaaaaaaactgtgaaaatgaaggattcctgcatttcaatgtccctttccatcaatagatttttcttattacttttatatggacctttttcggtgcttattgtatcttgttcatgtttatacaggttttagtttcgagcagaggaaataggctcgttgattgttgagaattgtgcccctgaatctggcgccacgaagctgctggcttccacgtctgtctatcaagatcatgggtagagtgacattcttaggaactagtagtagtagaatgagcagcctgacttgcttgttgggactagtatgtttcgtgtgaatatctgatggcacatggcatgtttcttgtgcttccttctgattaaactcattcatgtttggtaatgcctggagaaattgtgttaatatgtgctgttcttgagtagaagctgaaactgcagcctgaactgaaacactgctgaaacttgtgtgtccaacagagctctatgttgccttaattttggactttattcggaattactatatggctaagcagagcattaaatttgacccttataatatcgtctaaaattacccagctgttaacaccataataatacttatacgaaccacacttaagctaaatccttctcataaaatcttcagataaagctgcacctcagagagtccaaaacgactgtagtaaatcattattcccccatatccatatggaatcaaaccgagagtatacactaacgcactacggcgaggtcgaatcaggacctggtcttgaagggcacgtaggtcttgagcgagtcgaggacgccctggatggaggcggcgcaggcggcgacggtgacgaggaagcagacgaggctcaggctctgcagcgccacccacttggcgctgaaccgcggcagctgccgctgccggatgtacatctcgacggggaagaagacggtgagcggccagaacgcgatgctccccaggattcccaggatgctgttgaagaagggcatcaggatggccagcagcgtgatcaccggcacgaacgccgtcctccacacaagccggaacacgttcacgccggtgggcccgcccgcgccgccgccgagcagccccgggcaccggcgcgccacgccggccttcacgggggcgaacagcggctggcagaacacctggaacccgccgacgaggtgcaccacgatgcaggcgttggccacgtccaccagccagtatggctcgtagaagccgaagccggtgaggatgttgcccggcgccgcgttcccgaacgccgagtagcccaggcagccgcacagcaggtagaaccccgtggtcgtcgagatccccgccgccgtggcgcgccgcatcgtcgcgttctccggcggcggcgaccgcagcgtgtcctggatctcgatgaggatgatggcgtaggagtaggcgaaggcgacgttccccagcgcctggaacgtgagccacaccttctgcgtggcgtcgacgtcgacgccgaccaccgtgcccgtcagcgtcgtcctccccagcgggtccatgatggtctgcgccagcgacaagccgacggcgatggcggcgtacgagaaggacatgacggcggcgatgatggacagccaccagagctggtggaagtttgggagctggcagaagagggcctgcaggacgccgaagccgatgatgtaggcgctcgtgttctggctgcagtccgtgccatggccgcgccagtggtagcagttggacttgttgatagccctgcacacgcgcgccacgccatgacattgtacgttaattaagctcgatgcaaagaacatgacgtcatcaatggcgggaaggaagggaatttttttgtttgaactttttaaattttcttttattttaaaaaataaaccttataaaaacttatttccaaaatctggcatggcgtggcaactgtcagatacccgtagtgagcgtgatagttttgtccttaccacgtcagccagaccggcataatcaaataatgagggttattttgtcacgttaatccggctagcatgatcaaaaggtttagatcttaaaaataagtcttgaaaagatatatttttaaaattattcttttaaaaaaataagaagaaattgaaaaaaaaaagagagtggctaagcttacgcggcggagatggaggcggtgatggtgtagccgatgccggtgccgaacatgttgacgtactggcagaagccgcagaaccagacgtgccagccaccgaggtaggacttgacggcgtcggtgtaggtgtagttgcgcttgccggtggccgggtcgccgacgcggtagcagtcggagaggaggccgcaggtgtagaaggtgatggcggcgaagaggaggagggtgatggggccagccacccaccccagctgcgccatcgcccacgccagcgacagcacgccggacccgatcaccgccgtgattatgtgcgccgtcgccgtccacaccgtccctgcaaattgcatttcatatgcgcccaaaacacatcacttgaaatcgatcgaatattttgcactgtccgttcaaaattcagaagaatttaaaacgaacaaattattcatcagaaaacaatgcgattgaattgcaggccaggtttgcaatttctagaatttcaggctaccggcacgaaactattacgcctggaaattttattttcgttctttctttcacaacctaagttagctctgttaatatataactagtttttagttttcacaatctacaattcattgcctgacctatcatctaccagtagctggttcataagttaagagctagtatgttaattgtgcatatcatatcagattcctgctctatcaatagaactttgcaccgtcgtttaaaaaaattgtgcataccagataatcagattcctcgtttttgattttaggggaattttcgaattctcaaaggcaaacaagcattcaaacagcagctagcttaacacaacaatgtcgccaaccttttctttctccctttttgtaaacagaatgtcctgaaacattgattaagaaaacagatgatcaatgatgccaaaagaattcgatgcagacaaaacagtcgcagttcttgacttggacatcaaacggccggctgcatatataacagaatcaccacaggacaaaacctagaacagcaaagatcaatggaatatcggattggagttgaacacggaaggaccttcccatccggtatctccttttgttttcccatgcacttatatatatactacttttactcgcagcgcgtgtttaagataattttttttaaaaaaagaaaactgtataatagcatcctacaaatacgcgagttataaaataccatcatatttttataaaagggcagtatataaaagggtaagtttagtatttttaaaaatttaataaagggctgtcaaatcatttgaagttgagatttatttccattgggagtaaattattttggatctcgtcgtccgtttgtgctagcgctttatttttggacagaccgagtacgtagctagcgtacatgccgacctatcaacgacgagacgagcaagagactaagactagagtggatttcatctgagccactctctctcgagcgggttctggaaacgcaaaaatacaaaaataccctcacgcaaaaagatggaaagacaaatataccctttccgatttatactgcaaaactaatatgaaggaagatcaaatgaatctacaccatctatactgttagatcattacttgtagtatactgtaccataaaaatcctcttcgactaagcataagcacaatctgattgtcatgcatccataactctactactatatcaataatgtttttcaaagttctcaagtgcaatgtatctgaagtcaggagtatgtctttctacgagaaaggtacaggaaaccagcacaaaagatctcaaaggctagctagctagctagagcagctgctaactgaactagctagactgctatatgatcatgtatgagcaggagtcaatgcatggtgcagccgccgccgccgccggattcggtgacatcgccggcgtcggcttccatggagaccgttctttttcctgctgatcatgatctcctgtacacctaggaggctatggctaggagtggagtatatgcctatccctgcaagaggcaactttagggagatgtgccagtttttatgggcaaaaaacccaacccaatcacaaggacctctattgcatagcataggcggcgatgctctgtggcatggtgtccaaatatctgaacttgcaatgacatcctcaataatcaaggtcaatagcctcactacaatgcatatagcctcaataatcaagatcaaagaatacacattcttgtattctttgatctcactacaatgcatatagcctcttcttggtctttaagttggagcccacaaaggaaataaagaccctattcatccaggattcaaataacaacatgtatgttgcataggaataaaatgttttagccttaagcttaagattggccatagcaatattctctcctttactcatctcccaagacaaaaagatagagcaaatacactattttatttttggctctctcatttgttgcaaaataagtttatttttaagcaattatcgtatcggagcttgtgaaactaggaaataaaattgtgtgagtaaataatgcggagaataattgtattaaaatttaatagagtagaagtattctagtctgtttgattttgtattggcatgtgtgggacatgtgaaaaatgaacttattttgggatagagggagtacaatactacatctacagtgaattattttttgtgataacttcaattatgctagagagatttgaactctaaaattatattttttgtgataacttcaattatggtaaatctataatatagttttgtggcaaatttattgctaaatgcatagttttctgatataatgcgttgtattgttcaatcaaagtatgtgtaaactcttataatgccttgtattgttcatccaactatggacaggggacaagtaagtgtaatttaacaaattccatctgttctaataacagggtcaattaaaccaacactaatatttcctcacagacaattagacaaacatcaataggttaaaaaaagtagtaataaataagtgaaaaacgtgaaattttgttcctatttttgtcatcggtccaaaattaattctgaaccaattcatgcatgcgggggcataagcaaggcaacaaatagccagaaattctttgttttttttccttagctagcaaaagattcaaaatagaatcattaattctctctaaatccaaaggatcatggtgagcacagctacagttggaggcaatcaatactagccaattcgactgatcgtgcaacaaagtaaaactaggatcaaaccatatgcatgacctggacacagagattattacatgcagataatgcaaggttggtgcaattaacgtagcattaattattatttgatcatctacatctacgcaaagcaagctttgataatccaccaatctgttgcgagaaatacatagaggaaggagtagcagtagctcggatatcgtagggaggaagagggggcccgagtttaattcccatggggaatctgcatctgcttttaatgacccccgtttcacgaagcctgacggcctcagtcccaacaatttcaattcaggttttcaccaattattactggatatatatcagatgcagaatgaatctccaatcaacatcgaccagaaagaggatcgattaccatgcatgataaaaacaaaaaggatcttttccattgcatggccggtgatcatcatcagcaagaggaggaagaagaagaagattgaagtcttgaagagaagagtatgtacctgtcctcctctccttgccgtcgtcgtcgacgtcgccttgggtccggggaaggtagacgtccatagctgacgccgctccgccgccgttgccgttggtccctcctcccatgcgaagagagaggcttctttgtctctctctctccccgagctagagagctagctagctattcgatcgatcgtacgtctctccggttgatgcgcggggtggtatattgatcccctctccctagctagctcggcgcagggtagcgaagcaaagctgcctccgacgaaggcggtgggttgggggagtggtggtggtggtcgggagagggaataggagaggccagtgaatgcccccatatatatagcgaggagggacaccatgcatcagcgctctctcgctagctactcatagagagtatagtaggctacgcgtggaaacaggggataccccggcgccagtgcgttcaaattaaattaaatccaatccccgtttttatatccatataaacagcttaatgaagtagtagcatgggttatctaaaaaggtaaaagaaaaaaagtatccataaagagcacaactcgtgttttgctgttttcatcttatctgcgattaattgtataaatgtgtcaattcgctttgatttaactcgctgggtttctgtcagatatttttgttcaaaattatttgaaattttaatgaaatttggtcaaaatttaaacaaattatgctaacttcaaaaaaaaatggaaaatttggacgaagtagtttcaggtggggtccgatggactgttattaaagcatgacttttgctattgtttcgtgcggtttctgataatatacggtacggatggattaaacaaaaattaaatagccattatatgtccaaatttgccatgatcattgaattctatatgtggtgtaggatgccatgttacaagggggtacacgggccatggtcaatttcatacagagccccttaggatccaaatcctcttcacaatcaccaagacagaactaggacaaaacaaaaatatcaaacgaagtttcatacccctccgtcctccgccgcaatcttgatgatgatgagctgaattcactattcatgccactcattttgggaatgttgtgtgcatagtataagcagatacaaggatatgttatgtgtggtagcttcaaggaagagaagcaactttagacaactgcaaagtattgtgggtgacgaatggcaacatggaactttagtgtgttggattcacaggaaagagagacggctgcgaacaaaagaaaagggaaaccgtcgacggtgactagggggacaaggtaccttcgaggaagatcaacagatgtggtgaaaagcacaacagcatggtggcatgaaatgaggcacacgtagatcaccaatacaagggatttgggaatattaacaattgtgaataagatttcgatcaagagagattttttgcgaaattggctatgcccaaggaccccttgcaatgagaatacacctggcatgccacatctctagactctaggatacaatcatggcaaacttggaccttcaatggtacatttaataaaattagaacgactaaatttgcaattttaaagattagagattgggatgagaccaccaaacatgtgttgtagcagggaccccgcacctcctccgatctagggaaagccgaaactaccatgtatgtcctatttgatttgaatatatattcaggagtcaagctagccatcacacacactcgaatcaagaagttttcgaatatcatttggaaacctagtcattcgagaaagccaatagggcacagttttgaaggaggtacttcgaggagccaagcctaagtctggggaatcaagccggctcaaacatgtgtttccagggaccacgacaaaaggagcggcaccagcttgtaggtgtggccctgagctcgacaattggataaatgggtcccctcataaaggccagaatatacatctgtaccctttgcatgtgacgtcctttctaggcactaatgtaacttcctaaagggggttggatggcctgtaaaagggcagcttgtcctatcaggaggcagatgcattctgaacttaaaaaaaaggctagcagcgatatactaaatatacccatatacctttcggatacattcattactcaagataggtaaggtcaccttatttcctcctctatcttctacttgttaacgaaattttgtcacggcatatattggcatcgttcgttgggagcgtgagtggcctcgaaaggtagatgaaaccaagacctcaacgaagataagtggtaatagcgagatatgctgaagtgttcggaaaatcaccttagtcacctgaattcaatgttgtagaagcagaggagccgaatttgagaacatgaatgatttcgagtaaggtgcaactgtcaaagatgaagagcagaaagctgaggaagcaagagtcacaactgaagtggcaagtggagtgctagcattgagaatggaagcattagttagtatggtgcaagaacaaagggctctaatgataaacacgacatggtacaaagcaacgcaacaagaatacaaagacttcttacgacaaaacatgatttgtgcaagtgcagatgttgatgtggctacacattcttgaccaatcgacatcaagcctttgatctcttagcagaatgaaaaatggtctactaagttcaatttagtttgttcagttgaaccttctgaactcaaacatgaatagtgcttcggctcctgatttgaatacaacaacctaataacaaccattcactgtaaacccaaaccattctattccatttcaacccacccaacaacattcaaaccacaataactcaatgagccaaaatccaaacatagtcagcaaagcagtctttcatgcacatcaaaagaacatcagcccaataccttatacaaccaacctaataccccaaatacaaatactagtcaatatacctcaaccaacccaagctataccaatacaaaaccaaacatcacaatagaacatacaaaatatcatcgctcagttaatccatcaacaagacaaatcgagcttcacaatacaacccatcccacaacaaaacccacaactagtctcacatcaaacgtataaaacattgaactttgcaaaacaactttatcaccaatagtatcagtacacattgttccaaccttgtgtgccaacatttttgaaatagcaacagtttgtacaatcacgaggagttcgatcaatcaatgaaaaatactctctaagtccagcattgcaaatgaaaccctagccaatgaaattcaaactttcaaacataagaaagctcaacagcaacacaggcgcaaatgaattcttgagagtatatgagacaacaataaaagccaccggtgaagatggcaacacaaatgcaaaagtcttgcgcacggtgctcaaagagatagttttgtcctagctcttcacaataccaacattattgctacactcatgggaacaattgagggagatgtttgaaaatggatttcaaagaacttgtgaggagttgaaaggggcagaagatttgatgcaatgaagtaattaacatggcaaatgattagagaatacatcacaatattcttaagggttcgatgatagattcgaggggcttgtcatagtagggaccccacacctcctctgatccgatgaagccaaaactaacatgtctatctaatttgatttgaatagattttcaagagtcaagcaggcagagccaggctcccatggctggtcgatggcggatccgcgctcccgcagtcggccagcggcagacccgcacacccgaggccgaccaacggcggatccaagcaccattgaagttgtccagccgctgtagtcgttagcggctgactacaaatccaggtgtcgtcgttgtcatgacctgcatgaagctcgaaggtggaggaaggctggaggaaatgagaagaagagatggatggggacctgtgggacttagccaaactttaatagcgcctccacattttgcaggcggaccactgaaggtcccacctttgaaaatcgtatttttccaagcggaccacttaaggctccgaccatagttgattttcataggcggggcaaaaatctagggggtctctagatatttttgcaaatggttatatgagggggtttttttttggttctagaaaaataagaaccagagttagtaaaaatcattttctagtagtgcctactacccccgttgcctcccctccaccgcgttgttccgttccaccaattgttgcacggctttggaggcggcggagccgacactgtcgccgtcttctgctacgacatcttgccgcccactgccgtagcggcgtcgacagtcatccacggcatcgacaagtagtatgccagttcgaggggtaggcgcgaagctgccagtgaggtgtggggcgggggacaaagcaacggcacagcgaggtcgtcactgcggtcgggcaggatgtggatcgaccgatttgatttttttccttgagagaagcagtctatctctcttcctatcctgacatgtgggcctatggataaatccgtctggccaagttgggaagaggaaagaaaatatgagaaatttgagaaactcgggaaatagataaaagtggcatggaacgaaggaattcacgcttctgattgcatattataaaagcagtcaaattgagtggcatatcctgaaatagtgcgaattatatggccttttttacccactaatgtaactttctaaaggaccacacttattacagtacaacattcttgcacttttgtcagggcatctgtcacgcccagaaattcacgaaccagaatttctaagctgaatgtgcattaaacccctgtctaggaccagccagggtacacaaacgataattgttgacatacaaatcaacgtcttacaaaaatagaaaagattacaaatgcagcggaaaaagataaaacgagctagacttggaagcttgaattctgcagcggggcgactccactccacaggcatcccttgatggcagcgacgaaaccaacctcaacaagacgactccaactatgaagatcttcagctctggtgtgggggaaaagagagcaagactgagtattacccactgtactcagcaagtcataccggaagaggaggtatgatgcaggatatatccaaaggaggctaaggggttcctttgcaataaagtagtcatttaaaagaagtagttgaaagcagtaaaacaattgtagtaattaagcagtattaaccaatcactgtccaacgctacaccacgttgcaacaggcccaaccaaccacctgaactacaccagttcattaagctaagctagagttgagactaatcacggtgaatctggttgatcgcccataaccgcgggcacggctattcgaatagttttactctggccagaggtgtacaactgtacccacaagacacgattccatacatgtcgccatgccccgaagtatcaccatgatactgcaaagggggggaaatcgtgacaagaccctccgcataaccctcccctaaccatccacaccacgctaaggtttcacccctacccctcaaaaggcagtgggcggtcccctcttgcgccgcggtgaatccggcagctggacaaccggacaccccgaccgacccaactccatcacgcccaccctcgccaccggtgcctaggaaagggtcgagctatacttcagatcaagcagttacccactcccgcttgtggtaagcacggtaagtctcccagggtttcccatgaaccggtccttaattgccatgggtgcgaccagcgaaaccatgcacccacagcccaccattcagtgtattttaattaacaaacaccatttcggtggcactaatctaaagctatgctaatagtcaaagtctatgtaataatgtgatccccatttgtgtactagttgagataggcatggctaagcatttcctaaaccaacatctagtcattttgatacctagtcatcaatggcataaggtaaacaatatatggctgagtattaggacccatcccacatgacattataaaagaatgtaacatttaatagaaatgcgggatatttgtaaattgggtacaatatgatcaattgtaatgcatgacttgccttactctagcactgatgagaccacagcaacgtcttcgagaaaccgcggatcaacgaaatagccgaaatctacgcgacaaacaaagcacacaagcaaaacatgctataagactactgaaacagagaacaaaaccatttttaatagattctatggatttttatgaatttactgagacttgaatggacttaaacggagctcggatgaattacttatgaattttagaagataaactatgtttttactaataaagaaaaaggcctttattaattattgcgcaataaatccccagggctgacgtcagcgaaagggggggggtggctcggtaggcggggcccatgagtcagcggctcaaagggggtggtccaccgtggactgggtccacggggccggggtggtggtgtaccacgtggcaccacgtggctggccacgccagcaatgggatgaacggccacgatcggccgagggccgatcgggcggctggggacgggcggcaccaaggccagcccgggcatggcgcacggtggcgaccggccggcgacgcggacggcggcgcagtgcgacgacacgcatgcggggagaagcggcgcgcacgagagaggagaggaaggggaagaaaaaggggtcctcaccggaggggcgacggcgaccggcgcgggaagagacaagcggcggcggcgcttcggacaatggcagatggcgtcaggcacaacctgtgaaaggcgatgaccgggttaggaaaaggggaggatgaccacggcgactagagcggccgcccggagtcaggcggaaatggagagctcaccggcgtgcgagggaagcggcgctttggcgacgtttggcggcaagcgagcgacggccgaggtagctctcgcggcggcggaggtagcggcggtggttgcgcagcgcggcggcgagcctagcagcgacggcgcaccgccggaggtcggcggcgggcggcggagctcggtgtgacggcgcaggcgcggttgggggcgtgggagaggacggcgaatgggggaaacgagagaggggactcgggggagtgattttatgggcgcggaaggagcggaaacgggcggggtggccctctatttggccggcgacgtgggggtggagagagagagggggtgggattcaaaatcgaatcccgcccattatcgggcgcgcgtgcgcgggagatgccggggaggggagagggcggtgacgtgggcgcgaaatgcatgcggagtgggggcgcggagaaaggccggaaacggcggtggcgtgggcggtttcggcagcagtggcggttgccgccggttggaggaggaagacgggtccgacaggtgggccccacatgtcggtgacccggggagaggagggaggcggcttgggccggcccagcaagaaggatgggagcacgagagagagatgggccgacggcccatcaagagaaaaaaggaaggaaaagaaaaaggaaaaaggaaaaggatttttctaggattaaaattgcacctcgatgattttaaatggttaaaaattatttatagggctctgaaaattccgctaaaatcctgttaatgcattgcgacatgtggaacccaagaaaaatctcacaatgccaattccaattattaattgcatttattaattagggaattagctctaggttaattcaaaccatttcttcggatgatttatttaacaaattttaaggaaagaagaaggggaaaacttcagggcgtgacaaacctacccatcttaaacggaatctcgaccccgagattcggaagagctggcgaagaggtgcggatgggcggccttcaactcatcttctctttcccaagtggcctcttcttccgagtggtggctccactaaactttgcagaatctgattactttgttcttggtccttctctcactagtttcgaggatacgagtcggcttctccacatacgtcagatcttcctgaatttcaatgtgatccggacttgcctgttcctcaagaactctcaaacattttttcaactgagagacgtggaacacattatgaatgctaagcatgttggagggaagcttaagctggtaagcgacttcacctctacgttccaaaatccgatatggtcgcacaaagcacggtgccacctttctttggtttagaagcggtgtacttccccgtgtggagtgacgcgaaggtacacatagtcccctgctttgaaagcaagctccctttggcggtgtctacatatctcttctgtcgagattgcg

SEQ ID NO: 64325 - DNA, 910 bp, Oryza sativa
aagtactcagttggcgccggcgatccaatcaggatttataccaaactaaacgaaattgaagttatacaaaaaaaaaataaagtcaatcgaaatggttggcgacatagcaaggattagccgtaccttctgatgtgctcccatatttcaaaattagtgtgcaatcaatttgacaatggagacgggattcgacggcggcgcaacgcggtcggagcgagggggcaccggcagtgtcggaacgcggtcgaggaggaggggcgctttcgtgccggcggagtcgatttggatgaggggaggaggggagttggcggggaggggcgccggcggcgtcgcgcgcgaaggcgggccgtcagaatcgtctgtggcggcggcgggggagggaaggatcggagcggcgatggttagggttaggcggcagccggcgctgagaaatttgtgatcttgctatcgcaatttaaaatgttatcctaaactaacggaggttcactaaagcgcccttcactgaaatgctattttggatttttttgttgctagaaatgatttcgctctattttaatttttgttctgactaaaatacccttgtctcttttatctgttttaccggatcgaatcgatctcatccagcgtcatcccgtggcttcggcgttgtgaggaggagcctgggagcggcatcggcagcggcgacacccgtcgcgcctgcgcattggctccggctccagcgccggcgccggcccccaccactccttcacctgctcggctgctcctccttgttcaagatctcctgcatctgctttctggaatggagagggcaagggtacatgcactgatgcacacgaactccagctgaccatccctgatagagtcgaacaatccaatggacgggccgacgccatgcacaggggcgcaacacacg

SEQ ID NO: 64326 - DNA, 5922 bp, Oryza sativa
  unsure (1)..(5922): unsure at all n locations
ccgccttgagtgactcgtctgctatgcaagnagcncatcacttcttaggtacaccatgtaaacacatgattcttgccagataaagctctgctaacttcttccctgagtaggtagtgtgcactggaatgaagtgagccactttggtgagtcggtcaacaactacccaaatagaatcatgccccgatgacgtcctgggcaaaccggtgataaagtccattgctatttcttcccacttacattctgaaatctgaaggggctgtagcaaacctgctggcctttggtgttctgccttcacacgctgacagacgtcacagagtgcgacgaattcagctatttcccttctcacgctgacccaccagaatttttctttgaggtcttggtacattttggtactgccaggatgaatggaatactgagtttgatgagcttctgtcagtatcaagtcttttaattccttgttttcaggtacacacaatctttctcccatccagattgttccgtgttcatccttagtgaaacctcgggcttttccaactctcatgttctttttgagctctgctattccaggatcacttgcttgagctatgcgaacctgctccactagtgtgggttgtgcctctagggcagccacgaatccgtgctcaactataccaaggttcagctgttcgaaatcgcgttgaacctcacaacatagtttttctacccatgcaacattgtagtagctcttcctgctcaaggcatctgctaccacattagccttgccgggatggtagtgtattcccatatcataatctttgattagctccaaccatcttcgctgtcggagattcagatcaggttgggtgaagatgtacttcagacttttgtggtctgtatatacctcacaacggttaccgatgagatagtgccgccagatctttaaagcatgaacaaccgcggccaattccagatcatgggtcgggtagttgccttcatgaggacgcaactgtcgtgaagcataagaaaccactttgccatcttgcatcaacacacaaactagcccctagcgagatgcatcacaataaacctggaaatctttcgtctgatcaggcagaattaaaattggtgcagacaccaaccgtcgtttgagttcttcaaaactcctattgcattcagcagaccagataaacttttcttccttcttcaatagttgtgtcattggcttggcaattttagagaagttctcaatgaaccggcggtaatagcccacaagtcccagaaaactccgaatctgagtgactgtctttggtggggtccacttggtaactgactccacatttgctggatcaacggccactccttgagcatttacgacgtgaccgagaaactgaacttcctttagccagaagtcacacttgctgaacttggcatatagctggtgctcttttagcttttcaagtaccaaccgaagatgctgctcatgttcttcctcggacttggagtagataagtatgtcatcgatgaaaaccacgacaaacttgtccagaaattccataaacaccttgttcatcaaattcatgaagaaggcaggtgcattagtgagtccgaaagacataactgtgcattcgaacaacccataatgagtaatgaatgctgtctttggaatatcctcttcatggatcctcaacttgcgatagcctaatcgcaggtctatcttagagaacacagtagctcctttcaactgatcaaacagatcatcaatccttggcaaagggtacttgttcttaatagtaacctcgttgagtgcgcggtagtcagtgcacatcctcttggttttatctttcttttccacaaagataaccggagcaccccaaggcgacgtgctcgggcggatgtatcccttctgtaactgctcatcaacttgcttcttgacttccgccaactcgttggctcccattctgtaaggccacttgtggatcggtgcagttccaggtaccaagtcaattcggaactcgatatccctttttggtgacattgttgtcagatcgtccggaaaaacctatggatactctctaactacgggaatatcctccaacttcttagtggttttctccattgctacctcttgttcttcaccagcaacctggtttaaactgatcccttgcttctgcagcactggagactggaaggttaccacttctcctttcgcattggtcaacttgatggtgcggctagcacaatcaatcactcctctgtgccttgtcagccaatccattccaagaataacatctagatccttggattcgagaagaatgaggttggctggaaaaatcaacccttgaatttcaactgtcactgatgggcagtagtgagttgtggtcatgccacctccaggagtatgaactcgcattggtatcttaagcttcactaaagataacccatgtgcaccagcaaaacgcttggaaatgaaggaatgagttgcaccataatcaaataatattattgccggtgtcgagttgacgggaaatgtgcccaatatgacctctggagctgactgcgcctcctctgcagatgcatgattgacacgggcctgaacgaacttgagtccggcacgtcttggcttcaggcacgtacgtaccatgtgtccgggctcgttacaattgaagcagagttcgggcttttctccaaacttcttgggctgtcctagctaagctggcagagctgactgagctggaataattagtggacttggagtagggttgaggctgtgttgctcactgttgctgtgactgccactgttgtagttcttgctatagctacccgggtggtaaggacggtgctgccagataatcatgctggaaggtccaccctgatgtcccatcgtgaaaggaagcttctgactgatcccctgggaagtcctgagctgagctggcttcctcttacgattcatcttgttgcactgctcttcctgacggatagccttgtccacaagcttctcaaggtcctcataatccttggagatcagttggttggtcaattcatcatcaagaccagacaaaaacttctcttgcctctcggcatcagtgcgcacgtcctcaggagcgtagtgtgcgaggcggttgaactcatgcagatactctataactgtcctagttccttgctgcaaagaacggaactctctcttcttttgtgccacaattccctcgggaacctatgccttattgaaactctgacaaaactctgaccaagtaacctctgtcccagctggacgggtcaccatgtagttgtcccaccaaacagaagcaggaccttgcagctggtgtgtagtaaaagcaacattctcttggtcgttgcattgcaaaagattcaacttcttctaaagtcgcatggagccaatcgttggcctcgattgggttggtggtgcttgagaaagtgggcggcttgacacggagaaactccaacagtttggactgggcaggtggaagaccaaactgcaggttctgctgctgctgctgtgcttgctactgcacctactgttgctgcatctgttgcatcatcattgtcatcatctgagtctaattgtccaacacctgagcgattgttgggttctcgggcggtggagacagactgttgtcagacgtatcgctggcacgtgctccactgatatgctcttcgctgccactggtgttgttggattcacgggaaccattccttgtcttcaccatctgaagggggataggtagaaatatgaggaaaggaagaaaaacagggggcttagaaactaatctttcttataaatttaagtgcaattatcttaatctttattaaaacactgaaaaagaggcacgcaactcctaattaaggcagccataccactgacacatgatatcgaccgccgactaacccacaagcaacaaacctaaaacatggaaactagcaagcaaatagactaagcagacgataaagctaagggcggcgactctgaagctcggagcggcgcttgcgatcgaggaacaggtctaacacctaagatggacaagggataggaaccaatgcatgctcaaatccaaataaacaaagcaacaaatgactcaaacaaataactgagcatggtgatttttatgcatggaacatttttcatgaacccagatgaagatactaatgcaactgactaaacaataaattaatgcataaaatagatgcatagttataatgatacgcacaaaattgccccatcgaacatagacacgacttagtgcatatcacccgatatattcccgactgactgttgaataaactccaaataaaatttttctaaaaccctagactgagctaattttaaagatccgatctgaacgaccaagatttttcccacaaaccaaagaggcaaaaccccaaattttcccgaaacaaatccaagtgcaaagagcatatgcagatgaaaaaggggttcagagggctcttaggtttccagttggcttgtcctacggtcaaggtcggctctgataccaacttatcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaacgagctagacttggaagcttgaattctgcagcgaggcgactccactccacaggcatcccttgacggcagcgacgaaaccaacctcaacaagacggctccaactatgaagatcttcagctctggtgtgggggaaaagagagcaagactgagtactacccactgtactcagcaagtcataccggaagaggaggtatgatgcaggatatatccaaaggaggctaaggggttcctttgcaataaagtagtcatttaaaagaagtagttgaaagcagtaaaacaattgtagtaattaagcagtattaaccaatcactgtccaacgctacaccacgttgcaataggcccaaccaaccacctgaactacaccagttcattaagctaagctaggggtgagactaatcacggtgaatctggttgatcgcccataaccgcgggcacggctattcgaatagttttacgctggccagaggtgtacaactgtacccacaagacacgattccacacatgtcgcaatgccccgaagtatcaccatgatactgcaaaggggagaaatcgtgacaagaccctccgcataaccctcccctaaccatccacaccacgctaaggtttcaccctcacccctcaaaaggcagtgggtggtcccctcttgcgccgcggtgaatccggcagctggacaaccggacaccccggctgacccaactccatcacgcccaccctcgccaccggtgcctaggaaagggtcgagctatacttcagatcaagcagttgcccactcccgcttgtggtaagcacggtaagtctcccagggtttcccgtgaaccggtccttaattgccatgggtgcgaccagcgaaaccatgcacccacagcccaccattcagtgtattttaattaactaacaccatttcggtggcaccaatccaaagctatgctaatagtcaaagtctatgtaataatgtgatccccatttgtgtactagttgagctaggcatggctaagcatttcctaaaccaacatctagtcattttgatacctagtcatcaatggcataaggtaaacaatatatggctgagtattaggacccatcccacatgacattataaaagaatgcaacatttaatagaaatgcgggatatttgtaaatgggtacaatatgatcaaatgtatgcatgacttgcttactctacactgatgaaacacagncacgtcttcgagaaaccgcgggatttccaaaacccgggaaaaaaaaaaaaatacccgaatctacgcaccaa

SEQ ID NO: 64327 - DNA, 1770 bp, Oryza sativa
taagagaaaaaggaaacaatttccacttaagagtttcatgtgtcatgcctatgatggataggcaagaacacactagctcaaagtcctgaagatggaggtatgggttttcactaataccaccagagaaggtttgctctcaaaccatggctataaagccaggaccgatttcatagccatttgaaaggattggttttgaagaataggatgactcacaaagattagcccgaggagcagaaatgttttgaattgtgggttgctccatcaaggaaaggaataaaacaagaagaagtaaaaataaagatatgaggatgacctagactcggataaattagcaaccgttccccggcaacagcgccaaaaatgcttgttggtatttcttacgaccacagataaatccgcaagcgcacggaataccgttgtagcacttcaccttcaggtgaccccaaaaagatatcgaactcagggaatgtgtgtaatctacctaaggctgagactatccaaggacagcaactgatggtaggcacgctagagaggactctctatgtatttttaattatttaagctaagtaaaggtaattccctatctgttgcttcaggcaccgacccctgcttgtctgccagcgtggttccggctatagctctatgatgtatccgaacgtggaggattactaggacgggattcagggctatcaccacctgccaactacctctaacaaatccgtgggatacacaactaacaaaggtaatctctaaactagacaccacgtctaagttattaattactactctaatacttgcgcaagagcttccttctctatctggagtcctagtactagagcacttagtataaatactaaacaatgaacccgcaaagatggatatctatcttacttagacaaagtaattaaataacataagaaagaaacacgaatgcttactttatagaagaagttctccgaacccgaagcagagtgtaccgacggctccggtactcctccagaattcctcctaggaagctacactccttgaggtagaagtcggatgagcgccaaacttccgggcactcctccagaacttccccttactctctaccttattctaatgtacaaaagatacaataaagcctcttgtaattcaggtcaaagttgtgtgttggaaatgagagtgagctgcttcttttataggcaggtatgacggttacaacctatgcgaaatgaccaaactaccccagaaccgccattaggatgtgatcaggaccgtccacgtgaaatttggcgatcaacggctaccaaaatcgttcggccaaactggaggttcggccgaacccgggacggctccattcggcccatttttcgttgtggacactaattttgaggccctcagcccattggcatgatagttgggcccatttggagttgtttaattgacttatggggcctccaatccgtgtaaatgtgtcctgaatgcgcggaggtgcagtttgtcgcttgacggatgtgttttcttctcaaaatactcgcatacacatatttcaccaacactagtggaaatgattagtaataatacctaccactacgttggataccatgttttatttcgttatatgcaggtattgatggtcagatattatgatttaaggaccgtcaacaccaaacaaccgagtgatttcgataattgtagccaaccaagtgacttaatattaatatatagtatatgcggtgtgaatccccgatcaacatgatccgagtgatataccgactgctttgcaaa

SEQ ID NO: 64328 - DNA, 826 bp, Oryza sativa
tttcgctgctggctagaggacataatatggtccagtttagagactagccaaaagttattttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggccatgtgggttgctcggcacggcacggcccaagcccgacagtgcctaggccgaggcttgtcgggccggcacggcccaaccaacacaccaggccgagccgtgccagcccatgggtggcgtacacggcctaggtacggcccaatactactcgggccgtgctgggctggcctgaaggcacgatggctcatcgtgcttccttacagaaaaagtctatttttgattcctcaactccgtgggctgtgtttaaatggctggaaaataagtctattttgtatacctcttgtcttgggccttaccttatataattatttaagtctattttgcatctctatattttttttctttgatcgggccgggctggcacgggcatgatcccagtcgggccgtgctgttcttgggccgggccaaaattgtgagcttcgggccgggccgtgagcctcaggccatatcaccatctataatcttaagtagtcggtatggaagctccatcaataaatacctcagtgcagcggtggatctagaacctaggcaagcttaacgatgaacaacaaacacgagtagaaattgttctcgtaactaaggtttatgataggg

SEQ ID NO: 64329 - DNA, 1975 bp, Oryza sativa
accactgctgccacaggataaagaaatctaaaagaggaagtagctgtaaccggtggagtgttaaatgccgttttttttcggttttcttaaacttgtagggttgtgtcatataggtccctaaactctcaaaatgcatatccaagtcctagtacttgtcaaagtgtatcatttagatcccaaattgacacatcccctctaggatcctacgtggcgctgatgtggcaatgccacatagacgtgacgtgtcctttttttttcttcttttctttttcgttttcttctcattcttctttttttttctttttttctgcacgggtcacagagaaaggagaagaaagggaaaaaaagagaagaaaaaaagaaaaaggaaaaaaattaaatgggtcccatttatcagtcaaaataatgccatatcatgtccgtgtggcatgccacatcaacgccacataggatcctgaaggggttgtggcgatttgggacctagatgacacactatgataggttctgggacttggatatgtattttgagagtttagcgatctagatgacatacccatataagtttaaggaccgcgcgtacactttactcaagagaaaaaaaacagggaaacgctaggattgtgccacgtatacgggagcactgatcggagcacgccctgggagcaggcaagcagcgtccgtaagggcctgtttggcacaactccagctccagctccacccctcctggagctggagctcagccaaacagtttcagctccaccaaaaataagagtggagctgggtggagttctctcacaaaatgaactagagttgtagagctgggtttagacagctccacaatttcactttagatcaactcctgaagctaaatttaagatgtgaagctgtaacaaacaggccaagtatggtcgtatggatatcgctctatactgcgtggtgggccttcccgtcccaaggcaaacctggcccgtatgcgtccatcaagaggttgttctgtttgtttgtttcgatcgtatgacacatacagtcatcgatgcctcagccgatggatggccaggtacttcgctgagccggcaacagcacaacgctccattctgatcccccgctagttgcagcgctgatacaaatgcaagctagtgatttcgctgctggctagaggacataatatggtccagtttagagactagccaaaagttactttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggccatgtgggttgctcggcacggcacggcccaagcccgacagtgcctaggccgaggcttgtcgggccggcacggcccaaccaacacaccaggccgagccgtgccagcccatgggtggcgtacacggcctaggtacggcccaatactactcgggccgtgctgggctggcctgaaggcacgatggctcatcgtgcttccttacagaaaagtctatttttgattcctcaactccgtgggctgtgtttaaatggctggaaaataagtctattttgtatacctcttgtcttgggccttaccttatataattatttaagtctattttgcatctctatattttttttctttgatcgggccgggctggcacgggcatgatcccagtcgggccgtgctgttcttgggccgggccaaaattgtgagcttcgggccgggccgtgagcctcaggccatatcaccatctataatcttaagtagtcggtatggaagctccatcaataaatacctcagtgcagcggtggatctagaacctaggcaagcttaacgatgaacaacaaacacgagtagaaattgttctcgtaactaaggtttatgataggtaaaagacaaa

SEQ ID NO: 64330 - DNA, 835 bp, Oryza sativa
gtgctagtcggtgttcgtcctggttcaagagaggttcgagggtgttcgagcaattagattgcaagttttaggtgattaattagcgttcaatcgttcgtccagttcatagcgcagctccctaccccccccatcttgctcaacctaagcttcggccggaggcgagctgaggcgaagcaagcggagcggcggtagcccaagcgcaaggagtgatagtggagaagaacgagagctagaggagacagagatagagatggattggggcgcatggcgcggagaggtatttatagagcatgggcatgtgccgagcggatgatggcgcattgaatatggcctccgagtgctgggctgtcgccgttgcagaggaatgttggggaggcggtggcaatgggatggcctccctgtgcagcagggcacgtggcggcgaggtgcttgaccgcgcggggacaaagcgacgcgattcacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagagggga

SEQ ID NO: 64331 - DNA, 752 bp, Oryza sativa
tctgtattgaaaatactattatattttgctataagcttggtcaaacttaagataaatttaactaagaaaaaagtcaaacgacttataatatgaaacggagggagtatttgaactagaagtcccctatgcagtacggtaatgcttaaacataataaattaaggaaaaagtacgaattaccccccccccccccgaactatcgcggtcgtctgaattacccccctgaaccacaaaaccggacattcttcaccccgaactatgcaaaccggacgaattacccccctcgacctaatccgcggtggttttggtctacgtggcatacgcgtggcagtccagtcagcattttatttattaaaaaaatgtgggacccacctgtcatactcccatccaactattcctctctctcttatctctctctctctcttctctcactctcttctcactcacgcgcatggaggcaggcgggcaacagggagcggcggcggtggaggcgagcggcgggggatgaggcggcaagcggcggaggggtgcggcggaggaggtgaggcgaggcggcaacggcggaggaggaggcgagcggcggcgggagctcgcgctgctcgaggcgaggcgaggcgaggcggcggcggaggaggcgagcagcggcggggtgcggcggaggaggcgagcgcggcggcggggtgcggcgaaggagacgaccggcggcaggggcagcggaggaggcgggggagacggcgtcgcgggccacgtggag

SEQ ID NO: 64332 - DNA, 514 bp, Oryza sativa
tgacaccgagggatgttatattataacaatgattctggtgatgaagatgatggcggcacaatttgtactatactgatgaatttatgctgtgcttgatatttcgaacttactcctaatttcttaaaagcttttgtcaaaccttattgagcctaaaacccacaaaagttattaaaaaactttcaattctcattgactaagccaaaaaaatcaagcaaggcaatgataaatcaagtaagcaaattgaattgataaaaatcacactccattattattatagtagcccccgactgataactcaagggaaaacttgatgttagcagtcaaaatagggaaatacaaaggtaatggctaagcataaaaacgaccaagatgttcaatattccaagaattgtcgataggagtaccgtcttcatgtttaagtcggtaggaacctggccgagtgacttcggagattatgaatggtacttcctataagggggataacttgtgcttatctcgtgtagtttgaattttt

SEQ ID NO: 64333 - DNA, 676 bp, Oryza sativa
ccctagcgccgtgtgccctagctttgccgtctccgccgccgctccagccgtgcgccgccgtcgtttcagccgtcgccgtcgctcgggaagaccaccgtcgtgctcgccaagtcgtcgccgtcctcgtctgccccttcgccgtcgccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcgcgccgccgttcgccggcgagcgtgcgccgttcgagccgtctcctccgccgagccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgcccgtgcgcccggttcaccaaaccctagcccgctgacgcaataaaccctcttttccttttcaaaaataattcattattgcgtcataattcaattttaaccgatataagtgttttaatccgatttaatctttaaaaattcataactaattcatcttagctccgatttagttggttcaagtctctaaatttt

SEQ ID NO: 64334 - DNA, 656 bp, Oryza sativa
tattcacctatttgtaagtagtaaccatgccatcacaattcattagaaatatgagatatgtcgttccctatactgtaaacgtcattggacacatgtatatgccactatatttttataacccaaaatgcccctatgtacatttatgtgggcctcatgtgtcataacctttatcaatcttcgagcgaggagtaaccttgctggcgatgtcatcggtctactccttagcatgtgactctcatagcttgtcgtacaccgttcgcagctggttttctttcatgattcagaggcgagtgagcaatcaaactgcgtcgcaacaaaagctggagaactgaaaaaaatgagggaaatcggcaaatggtagcgtgacataagaacatggggttagaaaagaagagccgccactgccaccgttggggacgactaccgccatcgagcgtccatcatgcgcttatcatcgacaggttcttctcgtttctgtctcgtacgtgcatgggtcgatgatgaccagatctgctcctatccctgaccaccacccagatctgtctcgtctctgttcttgccttcgctagccagatctaacgcactccaaaatgataaaagaaaaataaaaatagcctgataacgctagaaggagcatatggggcatatgattagaa

SEQ ID NO: 64335 - DNA, 5530 bp, Oryza sativa
  unsure (1)..(5530): unsure at all n locations
ccttatttgatctttgatgcaaccaatctccaaacaagctttccttaccgatctttcatgcaaccatctaggggcaaaaaagaaacttgtccaatacaaaaatgtaatacaatttgacaaagtttgagttgaaaccatctcacgatctacccataaatataacggtgaactcaaccagagactcacaaacgagccttgtgtgctgtgatcccagctgccttcattgcgtcaggattgtccaaggaattcgccagtgctcggaatttacaatcaaccactgaaaaataaagatgatgacatttcagttttttttctctccactggcaatgttagatgttcgcaaccattaaattattattacaagcatttaacaggttttgcagccttgataacatataatctctctacgaaggttgcgctagaatgtatctttgttgaacaccaagctaatcagaaatatggtataatatgtgaacatactgatactgaatcttcacaatcaacagggtaattgcaataaaatggaaccaatatccgacatggtttacaaacagcggtttctaaaagttaaggatgaactagaaccgattttgtagacattatgatcgaagggaaggttgctctttggacaaaccttactgtatctttgtcagaacaatatcacgcatcaagctatctggagctgtatgacgaggcatatgaaaaataatgtaagacatactactatagaggagagcttgtgtgctggcataaagaaaaggaagaaacaaatgtaaatacctggcatgcctgtaaaatgctcaaattgacccattgcttgccttatgaacatctccaaaccgctaactactgtggctccacactctgcggcctctcggagaagtctggtctcttttggtgtatacaccgcgtcgaagacaacggcataagatttaagtgcttgctgcaaaattatgatttgtcattacatgtagctatgaaggcagaaggtactgaatacaaatgtcatcaagtaagtctaattcagaaccttggataaaggagtttcattgacatttggatgcattccaattgcagttgtgtttgcaagaatcatttcttcctctggatggtaattttccaactccgccaaagtcagagcaggcgcaccaagtaagttgccaagttcttgagcacgcgctggaaaatagaaggcataaatatatgttgagttcagaacatcatgctcattgtcctatcacacctttatcttaacaaaccatttggcggaaaatacaaatttaagaaaaagaaacactaacaaacttaagtacacaataaatatcaattaaaagcccgtagtgcaaaggtatcaactgttccgtggagcaccccaactagattgctccaaaccaaccaacacatgaatataggcatgggagcttttgaagaaaaaaaaactagtgtaaaatcatatgttctccatcagttataaaattcaaatttgaattggatctacatatccagaaacaaaatcaagtgtgttcgaggaaaaaaaaatccagaaacaaaagggacaaacctcagtgaacaatttccctttttatttttcagcagaatttttcctttttatttcctgatgtgtaattttaaattttgtggagtgatggagtacatcaaactctatgctaccatttttattttcaaatcctcattatgactatttgcgcgtgttttggttggtatggagccccaactaacgtgttcaatggagcgctagatatcttgtcagcatgtactagttatagccagggtagtaattttggacccaaaaggtctgagcatttttacatgaccttgctacgaaaggttctcaatagtgaatacttctcagaaacaacacactttttttttgccgggacagaaacaacacactcaaaattattcaaatggaatggcactgtttatggttaaatttaaatcagtataaaatgaagttatggaaaatgtgcataccaaaagtacggtttgctattacaactcgtgctcccttctcttttgcaccataagctagtgctttccctgcaccaccagctccaataacaacaaaaagcctcccagccaatggtgaagtggtagtatccgttggttgcgaagctaaaaattgatttagcacacacttcaatgaatactaatcagcaagatactggaatataaagtattatgcgtgtagagacctcttattccatcctcaatagcagaaattgcaccaacatagtcagtattgtagcctacaagttttccattaggttttctgatgattgtattgacagctccaatgtcctggacaaaattattgcttacaaatgttactctggatttattgaagggttcaagaatatcctaaatggaaaagcaaaaaagcagataaaatcaccttggcgataggatcaacttcatcacagcacctaacagcagcttccttatggggaattgtgcaactgcagtccaaataattagatgaaatggataatggttatacacatggagtattagagcatggggtcaagaaataaaactgaaacagaaattgtgtacctaaaaccagcaaactctggtgaagagtatgtattaagaaagttagccaggtcgtccaccaaaaagggcacatatacagcattgagacccactgatctgaaagcttcattatgcaaaattgggcttttactgtggccaacaggttttccgataataccatacaccttagtatctggaccaatctgtttaatattgtacacattaatcaagtctgttactgtgggctgagcaggcgcagattcttttcctttttcaagagagccaaaagtaaggtatcctccaaatttggggcagagcactcgagagataaaacctctatcattcatcaccagtccaatgattggcacctgcttttcctaattcattattcaaataaaacatattgtgaattaggaatcatattaaagaacttgagaaatgaagcatgggcatcggcatatagcataatatttttctcaaatgtgagaactcctgaatcaacaagctgtgcattttaagtccattatcctaactagctactctactctatcatgtcttaaaagttatattactgtatacttttgctaacaaaaataaaagaaagatgccttaggggatacactagagtcgacctgcaggcatgcaatcacccgtgatgatttatgtttcttatgtatgggaaattacaccttcattacagtccaactgtgcactaataatctgtgtgtagaagtagcaactattctaaccctggatactggcacaccttattaccgagagagccattttaccgacctgcttttgaatgaagaaatccttagaatgttagcatgttcattaccaattattgtagtgaggatatgctgataatagtgcagatttaactaaagtataattctcatcgacaacttagcgtttataaagctaacggccaacgagagactgcaagctagcgaggcaacagaaaacagataagtggattatattctcaatacaagaaataaataccaagacactaacacctatggatataaaacttgaatagaatcagatggtaaactcacttggcaatgtacaagtatttgaaacatttttgccacatcaacaatttcggtggcggtggttgcaattttcactatgtcagctcctgttgcttgtatctgagccaccaaattttcgagctcctctgttgaaggagtgttctcaaagttatgggatgaaacaataagcttacatgtttcaggtttctttccagaaatgagtttcataaatttgtcagcgacctgcgtaacaagagggttactatcaattgatttgttggtttggaatacacagctaacaagtacagctttttcaatactgatcattttacataagagtttatttcagtgatttaggaacttgacattgtaagcttaaactggcagataaataagtatcagtattgcaaccaaatgaaaaggaacttttgatctgggtaagaaactagacagacttacattgttcattccatttagcttaaagtaatgacaaatactaaatcaaatcgcaaatatctctttgagaagtttgcgcacatgaatatacataatcttatggttcacagagaaaatggagtgagggtaaacccaaccttaagctcaatatcaacatattcagcccccatttccattgccaatagaagcgcctcgaatcgtggctcgtcatcgccttcatattcacctccttcccacttcggcctacacaagaaaaatcaaaaaaaattgcttagctttttaaatgctgcaaacaatccgaaatgtccacaggagtaataaccagatgatacaattcccaagtgcctgtcttatgatgacagattcttccttctccattcagttctggtgaataaaacctattaatatctaaattcccaagatgcaattccgaattgnnnnnnnnnnnnnnnnnnccaccgagaagttctctaacatgtgcagtgcaattccccaccacaccacaccaacctcgagcgagggaggagggggctcacctgtaggtgacgagggcggggagcgggcgcggctgcgcgaggaggacggggaggtcccggcggggcgcgaagccggcgaggcggtcgagccggagctccgccacgtcggcgccgagcgccgcggcggccgccaactccgccgccatctcccgcggcgcccgcgccgtcgccggcacgcagagcagcgtcctggcccgtgccaccgccgccgcgccgacgggggcaccatcgccgacgccgacatcgccggagcagcaggaggaggaggagggacggccgcgtcgtgtggcggctatagtacggtggttggtggagtggtgggaatgggggttttatactctctcgattttggatggttttagacatttttttaagctggttttcattagcgtttttttttcaaactgctaaacggggtattgatatcgtaaaaaactcaattaattatgtactaatagctttcttgtttttgtgtaccgtatttaacaattatattcatcactaccggtgtggcacgaattcgatgtggcatgtgacaacaaagcacaccagatccaacgtgggataggagaggttgacacgtcagatgatgacattgtgagagcatgtttaccatagtaccataataggctcatgtatcatagaggtgtgaaaaccattacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatcccaattaaccccaacagccaagctaagctattttt

SEQ ID NO: 64336 - DNA, 22404 bp, Oryza sativa
ttacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatcatgcatccaaatcttatcaccgtcatagccatcgaagccaatctgataaagactacgccacactagtaagggaatattcaatatggggcatccacgaaggttgtgacatctaggatgatgtcattgcattccatcctgaactaggttttacgtggagagctcaccttgagacacaaaggtgatagagagggtgaacaacatctgaaagaaaagtatgtgccatctatagacgtcacgattttggtgcttccactagcgttggcacccttgacctagatcgtagcatgtgcaagtgcaacctcctccaccctctctcgtgtgtgattattatgacgctaaaccaaacgtaccatgacaccatctagcgatttttcttatgcgacttccacttagtatattttttttcttatgtgagttacacttgtacataaatgttacttgtttgtaaacttaaaaaatacatgctacaagtccaaaaaaaatagcaagggaaaatccctacatccattaatagaaaatgaatggttgctcttttcatgccgtcgggaatggaagaggctcacgtccctctgactttacgtcagaggagctccgtctgccgggaatagccctttgtaccccattcttttcctttgtttctcttttgtatttggttgtgagttggctttgtgaggcaatatcctttaatcttaatacaaaaatacgtaaatcatttgcgtattttgtaaaaaagaaatagaggttaccagatccagctaatgagagataaaactaagcacaatttctttttttttcctcatcctaacaaccgatcaagagggtgctagattgggatgaaaacggagcggatagtttccgtccgatccggacaaaaacggatacggatacctttcggatcggataattctcggatagttcagatatggatacgaatacggatattttctcccggatacgaatacaaatatggtatcagggattccgtcggatacggataataattcggatatccggtgaacagtgctattcggatatccgcaggacccatgagacataccccatttttttctaactctataaccttcaatatacctttatagatttttaatagtagtttatctcttaacactagtccatactattaatattatttaaattttaaaaaatatttataaattatacctcattttatataaaatgagctaattatatatgttgatatttgtttctattagaagttgagttggttttcgtgttccgagaaaaaaatgtttccgtattcgtgtccgatcatattcgattcttattcgtattcgagataatccgtatttgtttccgtattcgagctatccatattcgttttcctatccggtaaaaaatatgaaaacgaatatggtatgagcattatccgttcgtatccgctccgttttcatccctagcgctagagactcgaagcatcccagagatagagaagcagagcaacaacttgtgaagcagaagttctccctgaagacctctagcatggcatccatcaacactgcaaaactaaaaaatagattcaacctaatttttttttacggggagattcaacctaatttgatttaaggttcaacccatcccatctatcaaaccaaacacacgattacatctcactaatttcttttacttttttccctcttttttcccctcttatcattttcccattcttttcttgtgccccaccccgagttttcatcatgaagggtgtctggctaggagcaagaagggggacatacaagggcagaataaaaaggacaggaccagacacgtggatgaaagggagagaagaggactggcttgacaaggataaaaggaaaaagaaggagaaaaaggaggaaaaaggagacaaagaggtgatgccatattgcatttagaaatggtgcataggggtgtgttcgatagcacaggttaccaaccggggcaacagtacgcgcggaaaacggagcggtctattaacgtgtgattaattaagtattagctattttttcaaaaatggattattttgatttttttaagcaactttcgtatataaacttttttttaaaaaaacgcaccgtttagtagtttgaaaaacgtgcgcgtgaaaaacgaggtagatgggttgaaaaaagaggtgccgaacacacccgggcgtgttctatacttctcctttttcaaattttactttctcatttttcacatgcacgctttctgactaaacgatgcgttttttttccaaatatgttctataagaaagttgttttaaaaattcatattaatcactttaaagttttttaagttaatacttaattaattaggcgcaaatgaatcgctccattttccgtgtgcaggggagaaatttccaaacggtacattcaaacacagctttagggttaacacagtctaaaaatgcattttttgagtttatcgatcaaatgtcacccgtaaaataagtttaagaaccattagcgtattttactcaaaatcgcatgtgactgttgcaagtacttacaagttacaattacatgatcacatcatctttcaattttctcaaccaagcgcccgcccaggcacacaaagaaacctgatgaactcaattcagtagacaaagatctgagatgccaattccctgctaggatggttcaaaagcaaaacccatctagcaattgcttggcaatgatcagtcatcagatgatgactccatcctctgcgatatcaaactcaccgcggcattggcagccgagaacgcgccgtggaagctctccttgtatgacagcttctgcagatctcccaccatcttcagcaagatctctcccaggtcagactctttcgccgtcagggactcgtagaatgaccgcgcagcggtgttgctgatgtccacattggctggctccgggcagtactcgtcgtcgagccacttgtgcagtgtttccctcagccattcggattcctgttgagaagtagaagttaatctcacatatggtaaacaccaagatttcataactgcaatggagttgtcatataggcacaagggacaaatcatctgtataattcggtatagggcaagcaagctgtggaatcaaacaacagggtttcagctaagaataaatgccatttgtgttaatatgatctactttcctattcaaatcataatataaaggttattcacaagcatcgttatttatgcatacaatgcaaagtttccaattaagcatcgatttcttcggaacaggccataggacatcatagcttgaatcagagaccacagagtgacaggaaaaaaaatgcattgttgcattcaaacagaagataaatgtaagcaaccagatgctcacaaagcgcatacattaacacattgtgatttcaggactagcataacacattcatgtgcacatttgttcactgaaataccataacatttcaagttgaactgcaagtaatctgacagggcactacaactacattatgttaaggttccttcagaaagcatgaatttgcaattcaaaattaaacctactaccgattactgaaccctagattagcagcagcgatatccaagaaaaggatgaaaaccacactaatcacccacaaagtcagctacagaatcgaggagatgggttcttggactggacctgcgctgctcctgcaggggtgagccaagaaccgggcaccctcagctcctgcacgcggctgtcctcctcctccccgccgccgccgccgccgctcgcgcgaggtgccgggagaatccgtcgtggagaggaggccgagaatccggcgaggttgagccgggaagcgatgagaggttgcgcccttgaggtgggagaggcgcggccatgagcgtgagcgaggagaggggaaaggacggaggtggaagatgacattttttttcccttttcttttcgcaggtttgtgttgttcagatattctgcctctgatattttctccttttttttcaattttcattttcagatgttctggcttaggttttggctgtagttttccaaacttttctattcattctggttttatttgcttgaatttgtatgattcaaatggaaattatgtggattcccgcatttaggccatgcacttttctgttttcgtttgcacgtttcctaagctactatacgttttctaagctactacacgtcgcgtttcgtgcaaaagatactaccatataaatttttcacggaatacctctctaaagcaaatttttaactttgtagtagttaatttattcgcgtataccctcaaataactatctagattatccaaatccatcaatttcagctatctagccctcaaaaaagccaattttgtttcctccaacataatatttttctaattttcattcaatcagatgtgtggtggataggtggttgcttaccacaagattgtcatccacatcaaacacaaacccatgagttcaggagctgcatttcctgtccacaaatctaccattacatcatctcattcagattttcatagtttcagaccatgaaaacgctgtagcctgtaagcctcctcagagacccaagagggatgaaccagtgactcttgacaagttattagtattaatttttcttcagcagtatacagtacatgaaatggaagtggcacagaacaagtggtctcaattaatttccctcatgtagcctttggagtacaaaaccctaccttcaatgatcaaggaaagaataaatggggtagcaggaatgactgaacatacaatacagatagaatgcaaagttggccataaattttagaagaacgtattctctcccgaaacgcaattgcgagatcaaaacatagcagcagccctttggcgtttccgaaagggctgatgaattgaggtgcatggtttttatgcagccttctccagcacgagcttctcgatcaggtttgctgcatcttgaacagttgcgatgtcctgcgcacttgtttcgtcgacagtgatgttgaattcctcctcgaggcccatcacaatctcaacctacaaaggagatttggcatcactgtaattgcgccgtattatcggaaatgctgcttttgtttggctgacagggattaccgtatccagtgaatcagcaccgagttcagagaattttgattcaccagtgacagcagttccctcagggagtgccagctgtgtcttaactatgttgcaaaccttgtcgactgtctctttcttagcctgctcaacataatggtgaatatcaacagtattccaaattggttctcactgttttagtgttgtctaacctagcaaattattactagtttccaggaaaaatggtagaagatttgcgctctttatctgactaactagataacacacattgtccatgaaaactttagctacgtcaaagtgtctggttcgtatttatagagtggggttagccttgatgaatctaggcatcaagaaagcacttgatcaagtgcaaatgaactaggcgcctatgcatcaatagaacaataaaagaaccatgccaagaactcaagatgaactcctatttaattatctatttactgctgattcactagatattccaaaatctaaactagtttggaataggtaaacaattgctccagacacctatgaaggttcttgaagaacacatgtgcataacagaaaaatgtgcaaataaactcaatacattggtagaacaattgctaataggagaaaaccttagcataccgagcagcaaatcttaaaacgaagctgacttggccttgaacgaatggacataaaacttattctctggctgttgaaggaaactgagctccgtctcgaaattacattagtcacctgaaatgcacatcaacaaattgctggtgtaactggaatattcatatgcacagaagatgatgagggtactacagtggaaactggaaagtatgaacatatgacatcaaactaacaatttttactttgctcaaacaaatgctagttcgctcaaaacttttgagtgcttgaacacaagattgcaatgcgacaaatatacattcagaccctttggtaaacagattacttcaagttttttttctactggatgctcccactgtcctcacaaaaaaaaagtgctcctactggatgagcaataaaaaaggagagtagattggcaactaggctcatttgtgaatctaaatgctcgctaacctcactgacaagaagctggaaaacaataaaaaaattaacataattaagctctcaaagccaatatatctacagcacaaaacatgaattatcactgacttttgacattagccccctaggaagcaaccagcacttgtaaatctctggtgaacagaacttatctggtctacggttagaaataacttaacatggacaatacacaaggatgccaaacttttcaatcacctctggtttcacgtgttgaaacctaggtatacatgtggaatcccatgaagcaggacactccaggtccaccaagatgcacatgaaaatattagtctacacttgtaacaagaaaggaccgacttttctattcaactgatgcatcaacattgatgtggagaagccaagtgttgataaagaatattttttaaatttcagcaagatctaaagcatgtgctgccatttgctgtccttaagtggtttctcagagcttttacagtgtcttcccaactaggctgcattagaattcataaattttgtcttaaaataagtccaacgggggatccaatccagttacagtgcccgtgttactttaactatgacaatttcggaatctttgcagtttgcactaaaataaagaggaaatgtgagcaattgagctttttttccatgacgcttaacttccatcaatctcaatccaaggctaattaaccttgtagcttatgtaaagcatttgaacctgcacaattgtaaattgtaatcacacttgcgcgataacctactactaagcactgcctatgctatactgtttttgacatgtactaatcatagacagattccccacaataggaataatatatgacatgaaggataatactacaagttttgcaatctgcatcaagcagggaaggaacctatcaagaaatcgagtaatgctacccagagaaactaatccaatcggaagctgccactaaatcatcatcatccatacatcaagccaatccaagccaagaaccaatccaaaagaatgaaaccagttcaccacccctcaaaccctcatgaatcacagcctaaaactcaacaaatctgcagaacaaattgcaaacccccccccccccgggcaaaaaaaaaaaatcaagaaacagggcatacatatgatacaccaggcaagctgaagtactgaacgaaccccaagaaatcaaaaagcagctacaactaaaagaagtggtgggcttagcgcagggcacaaacctgtccgggcagtcgccggcgtgcggcgggcggcgagaaggacgaggcggcggcggcgagggagtgcgccatgggaggctgggctggcagcttagctgaggtaggggctttcttggctcgcgagctagctaccacgcagacgcagtagtggcattatagctcaggtaaggagataaatagattgaatagataataggatagaggagagaacacagtccaagaaagcggtagatgcagcttgcgttgcgttgcctccatcaacgaaaatggcaaaagatgaaaggaaattatgctattactagaacaggggtgaatagtcaaagtggtcctccaaatttcatctgaggctcagtttagttcttaatgtttcaatctatccatattaatccttcaagttttcattttagttcaaatttatccttgaattaacaactctatttataagagaacacttatacccataatcattcacatatataagagaaaaattacatgcttgattttttatagataatacatagtatattatgtaaaacaaaaaaaaattatgtactagcaagtgtacacgataacaattgcttaagtttcatgtgcacatgttgaaataatgagaagtacatctgtaatgtatttattcatgttgactttctcttttatagtatatagttgtatacaaattaagggcaaaaatgatattctttaatagaaatattgactaaaaatagccatatgacatattaaatgggcccaaggatgatttcaagccaaaacaaatatttggaggagctatgtggacaaaatgaaacgtgaaggaccaaattgagcctgaaagggtcaattaggcctagaaggggggtgaataggctaatttaaaacttaagaaatgtggaagcagtaattttcggagctaggctgggaattttcggaacttccgaaaatgcacagagcagcgcacacacaaaatgaaaactctagatctacaagactataacaggaaatacaaggcacaatcagcaactagaccaatagcggcacaagcaagcaaagttagaggagagggatgaagaaatttcaccaagatgtagctcccaaagttgttccccggagttcaaatccttgaggggattctactctctgttgaggagctcactaagagccgggtcttagctaaccctttcctcaagaggttgtattaagcactcctcctttcactaagaggtatctcttcccttgcgaaggcgagatccggccttcacaaacttctcccggccaaccacaagtagatcggtggctcgggagtgacacctagccgtctaggagtcctcaacctccaaaagtaaaagatgatgcaaagaactcccggagatgatgcaagtgctcacaaatcttcacaaagaccacaagaagcacccacacaagctcgaatccacactctcacacacacaccaaatccaaatcaaacacgggtggagagatgaatcgaggaagcaaggctcaaatgaacgagagagagagagagcaagccaagggcataaataattggaatggaaccagcagccctcacaagtaaggggaggtgggtatttatacccacagcacaaatctgcccgttggagtgcaacaaaagggattttcggaacttccgaaacaattttcggaacttccgaaaattccagatttgagaaaaattgaagtcaacgcccattttcggaacttccgaaaatacttctgaaagtacttccgaaaatttccagaacgcttctgtgtattttcggaacttccaaaaatttccagaacactccaaaagagaaaagcttcgaagaaaaattgattttgagcacacgcatcactccttatatgtctatgcatcatcccccttaatagtatggctttcctacgacacaatgcgaggaaaaagatacaatataccatttgatcattgccgcattgcatcgcgatgtcgcattcacgggatatgcattgtattacaacgtgttgaggacttaacaaccttcacatttgcttgaataaaaatgttagtcctctctaatcgcattgtaatcaatcatcaaaatcattaggagcctagatgcacttttagagccttcggtgaaacttgagggactaaattagctattcaccctactagaatactactagtagcttgttgctgccaggcaccgttcttttcggcaacttacataagtacaactattcattaggagaggtcacatcccacatttttttcagagagagactagaggacaagatcctgttaggacgggatacttaaagtgactcctcccctttctttcctctgtatagctgagcttgcacgtcttttctccttgtcttgctagccagatcaacagaaggaaagggaggaaacacattgaggaggggaaggaatgagaggatagaagatggcaacaagaggttcgttggccgggcacgacgacgatggcatgcgctccctcctcacacctggtacctatgggtgttctggctggtacctggtaccttggataccggctggtctctaggtatcagaccttggtacctgggtaccatgcctaatacttgtgggtatgagccatgattcctccctccttacacctggcacctataagtgttctggctggtacctgataccttgggtactagctagtacctaggtatcagaccttggtacctgggtaccaggcctgatacttgtgggtattagccatgatacctccctccttacacctggtacctatgagtgttctggctggtacctggtacattgggtattagctggtacctaggtatcagaccttggtacctgggtaccaggcctgatacttgtgggtatcagccatgattccctaaggtaccaggcatgatacttggtatcagccatgatacctcctgataccagtcaagaatgacttatttccatggtggccgcctcgtctccaacgtcgttgtcgctcccttctccctcttcacaaccttggctcccttctcctcttcctcctcctcctcctccgccaccacccccataaccggacgcttctctagggcgcccacgagaccaccacaaccacctccgtctcccccaccttcgccgggagagaccctcatgaccggggagtagggaggaaggtggaagatggagagaaagaatcggagagaaaggaggaggagaaacggatctgtggagaagaaatggatctcgggtgtatcccgtccccacgagattccgtccactagtttttctcttttttctaggttgttttttttaacggagggagtagttttcttgtttttattatcaaattactataccgtacattctatgtaatatatatatatatatatatatatatatatatatatattgcaaaaaattaaaatcatataaatataaaaatagaatgctctcgatatgtaggttccgtttttgtaaacatatctccaatccgcctagaggagagatgtcttttattttcagatttgctaaaaaaatccgcctagaggagaggtgccttttattttcagattttttgtcaaaaaaatagtcgattttgtgacagtacgatttacattaaggcgccgttacggagagtcgaatggagaccttcgaagtcgcagacagagctcctaaccaaccgagcacggtattggcattcactttattgccaaaacaaattaatattgaattttgaagtacttatacactaaccacacccccacttacattcacttacacaacacttacactataattacatatgtaatttattcacttacacggcacttatacaacacttacactataattacatatgtaatttaggaacttataatgtaaatacatgctgactattttttggtgaaaaatatggtgccataaatatagctactccctttattttttgtttttaagggggaatcggatatagagttggatttttttagagacagaatcggacatattcttttttttttattttcttcctttttacccggtgtcggattcgtacagatccgatttttttttcctttttttcgcccatttttttggtcggacaggtttaggttttttttttcatccgaatttttctggatcggatagatttggttttttcgccctttttaatcggacaggtttgttttttttcttttattccgcctggttttttttttgataattttggtttttttttcatcaggttttttttgacgatggaagcacctcttattttttaatagtgtatatatatatatatatgtatatatatatatatatatgtatatatatatatatatacacactatactacaccctgatacattataactaaaatactccccctcacatcctacccccaccccacccctaccctaccctatacctcggcggcaacgaggaggagaggcaatggcgtgaggcgcccggcgacggcgacgacgtgctatagggatctaatgggtcaggcggcaagaacgggcatgtccgtgttcgtgcgaggaggcggggacggtttcgctcccgttcacgcggttgtcgccggcattcgtccttccccgccggtactcccgttccgctcagccacggcttcgacctccaccgcccccaccgggcctccacctccggcgtcagcttcctttgcgcgccccaaggagctccaccgccactggttagccccgtatcccgtcacccatttcctcctcctattcctccgctctaggtggcgacggtcgccgccgccgccccccgtgcttccggcgccgtcactcgtttccgcttctgtcgtccacgctggtcgtcttcttcgactccgttacctgacccgcgaaatccagggagctctcgacgttggtggacgaaggaagccgatggtacccctccctgacaccggtggctgcgtgaagccgttgtcgtggctctccggcaccggatctggtggctcggtgtagaaactgaacggcggcggtgtcaagaatcggcagcggcgaggaggcgcttccaatggtgtggaatgaaatcctccaaatcgatcctggaagcggcgatggcaaaatcaatcttgctgtgcgctgttctatttcttttttgcctaagggaatatataaggttaacctcttctcttggtcaccgtgaatcagatttgctttgcatcagcagttagaaccgattaaatttgttttttccttcatttgagttgctatggttcttgtggtgttgaatcattcccatcgccaagatgtgaacctgcagggtaaagaaggatgagatctacagataacccacttaattaggtattagcctgaactgaaaattactactcctcatctgatgtatatggcgaacttactagacaatcaggcttttgaatgttacctgaccacacattgttactaacatgtgctaattttagtcagaaataaatattgaatgttcagctgttgctccctgattggtaccccaaggagagcccaagcctgtggggatggccggatgggcgctgcccacgccgccaaccttcctcacacatccacaggagcaggtacgcattgacctggtctttttttcccatgtattattgcctgcgggttgatgagttttcttattgactttgagccatacagacgcatgttatagattttgttaagactatttgaaatgctcgatgagctagttattagtattctggggttttggagctcccagactcatcatataatagaaagatgtgagctttgttcaacagagcaattttcctaagaagatttatcgcttcgggatgttggatagttctagttttcttattttgcatcttactttttgccaacgaacggtacacatcttcctcaaactatggagaattcattggatagctgtacgctgaaatttcctggttcaacataacaacagagtgatgatggggacataatgcattagttcccaacccatatatatttttggtgcctgcattgtcaggtttcaggcttggagatttgtccttctatttatatttttggtgcctgcaaacaaatataatgttacatggtagccgatttgttagcaatttacttatctgtcactgaatcagaaccatgagcttcttgagattgctaaacctgttacaatgaaagttctttttggttagatatgtagtgcacacgttaccggtgtccgcatccattgtctgctggaggtccttgtatatgctcttcatcgttggatccattcgcttcttgggtttcttcgtgccggttcttgttttcttggcattgctttgctcatggaggttcatgttttgttgatgcattgtcatggtggtggatgctgcatctcagccttttgcatgattaatttcagattgtgctttcctttctagtgcagtgctgctgctagcatcttacaaggtcattaaactgtatgatggggggattggttcaattaagtatctcgttgattctcagagttattttctatatggaaaaaaatatgtttgctttcttttatggcaaagcaattcacaacagcaatcttatggctatgaaatactaggtttaagtgaaatcatatttattttgctgatttgtgatacttagaagtaaccttcatttttttttttatccagatggctatgagaatgcctctccagagccgtggtgacagatatctgtcgacagggaggacttgagaatctgcagcacttcgtcggctcaacgttgatttgttttattggcgttgtcttgcttgttggattcgtgcatgcgtagatggatcattggccttgatctatattgtcgtattagtcttggcatcaatcttcatcaccgtatccttcagtggtgttgctgttgtgatttttttactggagctgttgtgatctttaattagttctgtttattctaccgatgtaccacattgcatgtgtgatcacatcattgatgtaataccgaaattaatttactcgatcaaaattttttaaatctaacttgtgagtaattaatttactgataggaggcgggctataagttatgtctacgcatagagtaattcatctactgacataagaccaccagaatcggaacggaattcttgctagattcaatatgttatgtctatagtaatttctttacataaaagccaaaaccaaagaggggaatggatcaatatgtttcgtcgacagtaatttctatacttagaagccaaaaccaccaaggaggggaataaaataaaccgggagtaatttctttacctagaagccaacacaaaggaggggaacaaaataaaccagaagtaatttattttactgaagaaaatttcgtggcagccaacaaaataaaaataaccatcaaaaataatttatttaccgaagaaaaattcatggcaatattaatatgttgattataagtaacagaaaattcgtggcaagattaatatgttgattagtaatttatttactaaaagggaagagaagcagtgggaataaaaaaaaaggtgggaacggaaggggtgggtggcggttggcggacgagagggaagtgggggtgggagcagacgagagggaggtggggtgggagtgccgaccgggggtggggtggggtaggttgtgaggggagcattttagttattacgcagcctgggtgcggtttagcgctgccccacatatatatatacatatatatatacatatatatatatatatacacacatatatatatacacatatatacatatacacatatatacatatacacatatacacatatatacatatacacatatatacatatatacatatatatatttatttatttatttcctcacgaaatcaaataattccacttcctaaatttataataactaatacccaattaatcattagtcatgtgttaattacctgtcttattttacatgcattaaaaactactctctccgtctcaatggttcatgtatccaacgtttcaccgtttgtattactttaaaaaaaatatgaaaaaaatttaaaaggtaaaatttgctacaggacatccaaaagatatgtaattagctgtgggatgctgcaaagatgtgaatttgctcgaagccactctaaaagtgcggtaatttgttacaggacactggacacattaaaatataatatcaactgaattgatgagagaggaaccacgtaaatgacagtcttgcccttatcttcttccccatctctcgggccattttcggcctccaccgcctgcaggtcgtccctgttgctgccttcccccaccgatcggcgatcaccgccgccacgggtattggtggctattaaatgccaattctatgccgtcaatacctgcataaacataaagaataaagcatccaacatattgattaggtttaattctaatatattccacgagtgttggtgtatatgcgcatgcaggtaataaaccaccgaagttgggatgaaaatcagacttaagtggaggtgaaatcctatcatacaacgagtgggccaaaaactacacaaaacttcaacaaatgggccttccactcgaataaatagataagggagcatgaggaggagcaacaagcatgaggaggagcaacaggccaaaaagtgggactgttgggccaggcctgggttaggtcgaaccactcccacagcagtctgatctggggcttggcagggatggtccagatgactccctaatggcggttggagggtagaatggatatttcgccttctcccaaccgtcataactgccctatataaagacttcacctcttcacttcacacacacacttcaagcttgagttgaattataagaggctctattgtactttattgtatactagattagggagagagtagagtagaagaagccggaggagttccggagctgtcggtaatcctcttcttatttcttttgctctgttaattactctgattttaatagaaatatcttttgagtaatttagttttgtttggtgagaattatctcttaggttagttcctaatcagcgcgtgcgatcattgttcactgtaatccagtaaaatatagtgattgctttagtgtgtagctaacattaaagtaagttattactccctctatcccaaaatataagacataaccactcataacacaaagaccaagaaaatatttaatcaccttcttggttggatcaccttaatgcatgcaagcaatgtgattgagaggtttgatgatataagatttaaaacaaatcaatgttataagaccaagagatgctagttaatgtatgcatgcatgcacgccttatattatgagacatgagagaaaaatggctgtgccttatattttgggatggagggagtaattgcttagatgcggtgtctaggtagttgatctctggtgtttgctccgtatcccacagtaggtgtgagatgggtgtagaggtggtgacagccctcaagatcactaaagtcctctctgtccggatacatagtagagcgatatctgagagcggtgagctggccagtgtctgaagtatcacgttaggattaaagttaagctttccgtagacactgtttctcaccggtgaatcctctctatcctttgcctatccttagctttgtgtctttggaagaacctggtgaagagctgacacacacgttcactgtggaaatcgatacctgagactactcccgggtgaagtgttacatcaatatttttcgtgcgcttgcggattttatctgtaaggttaagaaataccaacaacgggcactcctctacgtgccctccaccactaccttccgcactccttggcgagctccagctccaccctcgccatctccgttacgcgctccacatacgcccgcctactgcatctgcgtcagtagtagtagtagcagcagcagcagcagtagcaacagcagcagcacgacgagcgtcgctcgccgctggtccacgttctcgctcgactcagtcgccacctccatgccctcctcctccccgtcgcgctcgcaccacgtggctggcgtcgcctgggcgcccatccgctctgccgccgcgccgcttggcctgcgggacttcaccctcgttcgctgcctgggcgccggggatatcggaccgtctacctcctccgccttgatggggaacatggcagcagctcgctgtcgctgtcgacctgtcgtcgtgcgagtatgccatgaaggtggtggaccgttgccacactcgccaagaagggcaagctggagttctaccctggtggcgacctccactcgctctgccaccgcatgctcgatagccgcttccccgtcgcgccctccaggttttacgccgccaaggttctcttcgcgctcgagtatctgcacatgacggccaggtttaggtccagaggtatacaagcagggatggcctgtaggtggtggaggccgcgaatggcccgagagaacggggaagaagataagggcaaaacaatcattttatgtggtttctctctcatcaatttaatggatattatattttaatgcgtccaatgtattgcagcaaagtaccacacttttagagtttcctcggtcaaattctcattttgcaatatcccacagctaattacatatatttttttaatatcctatagcaaaatttgcatattcttataggtccaccaaggcagttaacccacacaccaggacagaagttagagaagaagtcaacgaaaggggaggaagaacaggaagggagcccggcccaagcgcacaataatagcccatccacgaatcgtaaccccgacccaaaaaaaaaaaatttcctcgctccgagaaagttcaggctagggcaaaagccggagggggatggcggcgggggagggggaggcaacgacttgccacaagagatcggcggcggggcaggaggaggaggaggagtcgaagaggccacgcgatggcagcgaggaggaggaagagctgctcaccgacctctcccgctaccgccgctactggacggatctgtggtccgacgtttccggcgacatcgccaaaagaagtgaggaagcttcttttttttttgttttgttttacagatgattttatggtaaatacgaattcgctcatgctcttgttaggtttttagttttcatctcaaatcgacatgctcgctcgctgattatggtaggcgggagcctggggtgcacaattgtgggggatggaaacatgaacatggaaaatgttgggattgctatttttcacatgaatttctatcaatgatataatggctcatctctttggtatgttgcaaaggaaaaagaaatggtaatgcttgactgattgatgtggtttattggatggatgcagctgagtttggtcccatgcggtacacggaggaaccggtgcccccgttcgcaaagctccaagatttactagaggttttttcttttgaggtgactgagctgaaaggtattctaagctggccaatagatgtgtttggcctcatctctgtccgtgactcgctggaccggaatcgcaactatatctttgagcgcaccaggaactactgccagactctcactgcaaaggtacctctatgcttcatggaaataacagcgcaaagtcatcagtcttttgacttttatacaggcagctagttagttttgcaatttcacaattgtggtgcactagtgcagtactttttcactgcactgcaatctagagatgtctgctgcagttccgttaagaaattggatgttacttaaacagattagaacagtccaaacttatatgcacatcatggttccatttcacaaattatatgtgatagtctggtactagttgtatcacagaagcatattagtaaacaacttgaaatattcaaatgctcatgatttagaatcatgtaatggcatttcttttttaccaaaggcaaaacataaaacctgtgataacataatcaagcaaattttccaatctcaaactcccctacacaccagagcttagcaaattctcatgatatataaggggcaccacaaacatgtgtgttgctaacagaaacaactacagaaacattcggtgtgcaggcgctgaattagtacttcaaaataaaaggctaccaaatcatcaattgatagcacatgcaagggcacttccccactctgatttaattcatagaaactagcgttttgccccatatgaacttgcagaggctatcttttcttgcaacatctgtgctccttgcttcagtttgtctgcaagaactgtattcttttgccaatcattcaagtaggatatttaaacacacccctcatgaatgcgtgaatggtaaagtgagggtcaagaactttcctatggtcaaaagagatgctactctctcggtagtacaactgtcctaactgcagcaagacgaatcatgcatggattcatctccttgcagtacagcttgagcctaagggaaaacattttgcaaatatttaagggtaattaacactgcgagaacacacctgaaaggttgtaagcaggtcacagtaacagcaagtgatcaattgtgtttcaggtttggcagacatataatatttgttatctcatagccatcttcgtttctttattgcaatagccatcatgttttaatgggattgttgaatattgaacattattaatgccaatttccaagagcctaaggagatgcaatggtgatccaccattgatgatagaaaggaaattctttgagatgttttagggtagaggaaaaaaggtagcaccaagagtacagtttacccaacaataaactacaatttgttgtgatattttgacatactatgaatattctttatgaaaagctcctgaaaaaaagtgttaataaataatgattgtattaatactacacttctgtgacaacagtgcaatattaatttgtgagtgctggtcattaaagattcaagcaataaagatgaagttgtcaatacatatattaaatattaatcgtagatcatatatatgcttattttcctatgccgtatcaatgtgttcttgagcaaagggaaaatagaaattccaagttgagttatgcatagcatgctgtcaggctcacatatgtttttctattcataattatatgctcatgtttttattttgttttgacagttcaaatgtgccattcatattgttttgttgagtggaacttaggacacagaacgcaatagagttatgcacgtttgttcaccttcagtctagctagtttcatcttatccaataaatttggaaatatttgctatgttacatcgttgctaccattcctttccaattgttttcatgcagagctaagtggtggattgcgcatcattactattattcttatatttagtaatgtcatcagtgtgtgtaggattcatctctggttctcactggtccaagccgtgcagtccaattgattgaccctgttgaatttgaaattgagctaagagtcaaggggacaagtccctccaaagataagatcttgagcgctgaagcatttgggtataactgcattgctcagagactcagatgtggctcactccgcagtatgatgttatcaggagcacgcagcacattggagttcaagtatgcacacattcctttggcattggaggctacaatcaaggtcaggattactaggggttcaactgatttctgtggaaagttcattgcacatactgctagtatcaaggaagatgtcatattgctggactctggagaagaaatggtggctatctcccatgatggagccattaatttctcccgcagtgtagttgcagttgaaggaaatggcggagttctgactgttggtgttcatgcaaggcagagtggtggtgagaatatgagatgttcttataaagagtttatcccggtaagatgtggacggagtcatgacacacttgatgttggattttgccagatgagcgttgaagttgcttggtcgctcatcttttaatattgaaaaaagtctaggccctgataatatttttcttgcatatgacaatacttaatattcggtattagtagtggaagtaatagatgtgctccgtggcattgtaatacactaatatgacagtactgagtttggaccgggggcctcacgatccatgccattgtaaatttgctactctatatcataaaaatgctattattattcacctatttgtagatagtaaccatgtcattacaattcttttgaaatatgagacgacattttctacactctaaacgtagttggtctcaaatataggccactgcattttttttatatcatccaaaatgcccttatgtacattaggtgggccctacacgtcatcccctccatctctcttggagcaaggagtcgttgttcaccttgttggtgacgccgtcgttttgctccctcgcatgtcgctgactcgctcgtcttgcgccattggcggctagctttcttgattcaaaagcgagtaagcaatcaaacttcgccgcaacaaagagctactccctccgtcccaaaatattgtcctctaggcaaaggatagcgacaaccttagttggatgagggaggacgcgcgtaggggcgcagcgtccacagcaactggcgatatggggcgtgctccgggcggcaatggacgtcgctggtgaggggcggagtcaaattcaaatttgaatcgggtatgtaaactttgacttataaactttgggtctataaa

SEQ ID NO: 64337 - DNA, 12912 bp, Oryza sativa
tggatcccctttttcgaatgtgaactgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacttgaatattacgtttccttgtatattacggaacggcctaaagtcctggtttgataatagatttaggaaacccttaccgtatttgttaaggtttttgtcgtgtaatcctatccccccaccccggtgctatataaggcaggcaggaggccctctacggcatgatttcacaaccagatcgtcagatcaatactacaccaggtggattcaaatccccaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcaccacattatgggaagctaaaaaatgaatctacaaaacatagctaagtcgttctccagtcggggaaatcaatacaaccccagcacctgtgcctaatattctcttcgacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaacatggccctcttcctctcgctcaatgacaagcaccgaactcactacctaagatgttgccgacacgtattgaacgcgctgatgaagcctgaaggggggaggggtgaataggctgtccctgaaaacttaaaaacaaatcgcagcggtaaaattcaaatagacccggaacttcctggtaaggaactccagaacttccggcctaccaggcccggaacttccggtgttcttaggacaggaactttcgggttacagaaggaagatgaaattcaaattttgaaactggagactaagttaatcttcacaagatggtgaacatgtattctaagcagaggatagatcacagaatcatccacagaaacatcatagaaagagacaagagcgatttttttcccgaagttcggatcttgcgatcctactctcctttgaggagctccaaagagctgggtctcgattaaccccttgcctcacttgtgcaaaaaccccagagaaaatccacagccttcaaccccaaatacccctaggcaaatttctagaattgaatgaccaccaagatataactcaacctatttctagaaatccgccacaagtgtgggttgctctagttggaaagcctctagaatctcagcacaagaacttaattaacttacctcgttccctttcggaggagaggagatccttcacaaacttatccgggacatcgacaatatgcaatggattctcacgggcgacacctaactgtcacgcccagaaattcccgagtaggattccaagcagaatgtgcattaaaacccccgtccaggaccggccagggtacacaaacgacaaagttgacatatagatccacgtcttacaaacatcataaagtcttacataaatgcagcggaaaattaaaagataactggagctaagccttgacttggaccgcagcgggatcaccactccacaggcatcctcgacggcacggctaagcctactcctcggagaagccaccatctgacgcatactcaaactctggggtttggggaaaatagagcaagactgagtactacccactgtactcagcaagtcataccggaataggggtatgatgcagggaattatcaagggatagctacagaggttcgtttgcataaagcgagcatttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgtcgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcgcggcggctaagcggcacgggagagagggagaaaggggaggaggggcctcaccgacgacgatcgacgatggcgagcgatggagggcgatggcgacggcgagacgagctccgggaccacctaagggatcaaaagggatgagttagagagggagagggaaaccatggatggctagggcggtgaccgaaggcgccggccatggcgaagctcaccggcgcacggcgcgtgcggggttccggcggcggattactacggaggaggggtggatgggacggcccgcacgacggcgaacgcgacgacgtcgacgacgcggctcggcacggcggctagcggcggcggcggcggcggcggcggcggagaggaggtcgatgacggtagggtggtggagtgcacgggagcgggcgattgcaaaacgaaaaagagagaggaaggaacgggggtgctttatatagacacacgagggttgatcgtggccgggagaccgcgatttcgccggaggagtggggagaggtggggaggagaaagaggcgggattcaaaaattgaatcctggccgtgtcgagcgctggcgcgggttggagagagggggagtgggcgcggggacgtgggcgcgagggcgacatgggcgacgtggcccggaagacgtggttgcagggcgcggcggtgccggctggaggtgggagacgggcccgacaggtgggccccacctgttggcgacccggggagagaggaggggggctcgggcggctggctggtccgtgtcctgcggccggcccagcagggagggagagagaagagagaatgggcctgtggcccattcgaaagagaaaaagggaaaaagaaaaagaaaaagaaggaaatgaatttttcccgggattaaatattgcttgtgctcaattttaattggttaaaattatttctggagctctaaaaattccactaaaaatcttgttagcgtatttcgacatgtagaactcaagaaaaaaaattccacatgccaattctgattattatttgcattgatttattagggtttactcttgcttttacaccggtattttcttgagaccatttataacttgaatttaggcttgggaaagaacttcagggtgtgacaaacctacccccccttaaacggaatctcgaccccgagattcggaagagctggtgaagaggtgcagatgggcggcctttaactcatcttccctttcccaggttgcttcttcttctgagtggtggctccactgaaccctgcagaacctagtgaccttgtttctagtccttctttcactagtctcaaggatacaaactggcttctccacataagttagatcttcttggatgtcaatatgctccgaatcggcttgttcttcgggtaccctcaagcacttctttaactgggacatatggaacatgtcatggatgccgatcatgttggatggaagttctagctgataggcgacttctcctcttcgttccaagattttgtatggtcccacgaagcgtggtgtcaacttgcctttcgtctggaaacggtgcactccccggagtggagtaacatggaggtacacataatcccctgcttcaaaagtcgtccttgtgcttggtcttgattacaacattgtccatgtaagcttccacgttgcagctaatatggcttgaaaaacatctctgaatcatgcattgataagttgccccatcgttcttcaaaccaaacggcatagtgatatagaaataagcaccaaatggtgtgataaatgaagtcttcaagcagtcagactctttcaggctatctggtgatatcccgagtagtaaaccaaaaagctgagtagctcgcagccggctattgaatcaactacctagtcaatgtgaggcagcccaaaaggatctttagggcatgacttgttgagatccgtgaaatcaacacacatacgccattttcctgttttcttcagaactagaactgggttggccaaccagtcgggatgaaagacttctttcatgaagcctgctgctaatagcttggtcaattcttccttgattgcatccttcatgtcctgtgcgaattggcggagtcgttgcttggtatgattaccgtattatttaacatttaaggagtgctcaatcacctttctaggaataccaagcatatcagatggtttccacgtaaagaaatctttattagcttgtagaaaggtgatgagtatgctttcatatttacaatcaatctctgtgcctattacagcagttttggtaggatcagatggatcaagggggattttcattgtctttgcatcgccttctccagtcttgggtagcttggtagcaggttcttcaccctcagctgatgttgatgcaactagtcggatctcctaaggagcgagtgctgtctcacaggtttgggccatctcacagctctccttatcgaaggtgatggcttgcttgttgtcgcttcgcagagatatgactccgcgttgtactggcatcttcatcatcatgtaggtgtagtgtgggacagccataaatttagctaacgccgggtgtccaagtatagcgtgataagccgtttcgaaatcagcaacttcaaaactgacgttctctgtacggaagttttcccgagtgctgaaggtaaccggcaaagtaatctggccaagaggtgtggatgacaaccccgggatgactccatgaaagggcgcaatactcggcttcaactcagttcttgggatttgcatctcgtctagagtcttggcgaagaggatgttcagtgcatcgccaccatcaatgagagaacgcttgagcttgattgtcggcccctagttttacaacacaggaaatcggatgcattttgttgaaaccaactccctggatcggtaggttggtacacacatcatacatcacatggtacaacagagtctgcacgattaagtcttacaatacttattgatacacgggttgcccaagtgggtcccgaataggccttatatggccgagtacaataccaaaaagtagagaaggggaaaaaggtgagcgtaagagaagctgcggcggtcctacgtctccacaagcatcgactggggatcactcctatggcgcctcctggggttcactgtcttctgggatgctctcaaacagttccgcagcgtcggtcaggtctaggagggttttcagaaagcaagagtgagtaccaaccgtactcagcaagccactaccacaacatgcatttagtgcactcaggaatacaaggaaggctaggttcatttgcataaagttaatttgcacaactcttttcacaaacctatgacttagcatttttaactaaaaacaacattaggttggagttatcattcaatctacgagggttcatcccctttccccaaagcctcgcttggtccggctttaccctcgcatgcagttttccctattcccatcattatcatgaccttcccgcccatcgggcaaggtcacaccactttccttatctaagcaagattaaaaactatgaggctagtcaagcatagtacaagtcccgatgctcattaaccgcaagcacgtctattcgaatagatttgatttactcacactgtagtggatgtatgcttttaatcctgcactccgcggcttgccaaacacataagtctagtcccaacacatgagacttgccacggcccagtttttcagtcatcctagcgtttcggcacccgctccaaggactattcacccccattgcacccccggcacaaaacaacacctcgagccggcggtgaggagagtcctggcgctcccgatatctcaatgggttaaattacatataggttaggtgcgttttagttttcccgggtaccatacatcacatcccttcaccttaactcacaacatacttcagaaccaccatgacaggggtgccgccccacgaggatttcttagtccaccaggtctatacccactcgagaagtgcagtcatactcttattgtttcctgcccaacttcttgactcagtctttaattgaccagggacggcggctagccatttctaggaccaccaatattctatccatgccgccccagtcgaaaacattttgttccattaggtttttggtttttgcaaagctttttgtgctgcgggtggtgcacatgtctccacccgccttctggcaatcactctcgatgagtgaccaccaccaacacatccatatccaactactatggagtgtataatcgtctatgaataagcaatattaagcaatgtcaataattgaccacgcataaataatagactcaggcaacaaggatataataaaggtaacaatatcaaggatggttcatacacaaatttaggtacgcattttataattagcatgcaactttatttataaacaaaacatttataaaatgggttcaacatgctcaaggaggggagcgtagtgacttgccttgttcagtcagtagttcggcttcgacaaactcgtatccgtcctcacacacgtagcctgatttgatcgggaaacggagaatcacagtctattctaagactagcggaaaaaagaggaaaaacaaataaaatagcagaaaaagaaaatgctaacccaagctcattccgaagggtttgggataagaagaattttagcgaaaggttcttcaaaattcgacttgagatgaacaagtggtggcccctaaaagatttggaaaggaattacaaaccacaggagagacagaggacccacatgtcagcccatgtggtcttttaacagccctaggcccatctgtcagccttgctttagtggcgcagctaaaccggagtgaggtggtgcatgtgggtcccatggattagtattaaatcggtaattagggatgaaaggaatgggtggtccccacctatcggccgctcaggcacctcccccttcttcctccttcctcctcggccttgcgcacgcatgagcggcatcgccactagggctgaaccatgccggcaacgaggggtttggaagatagggcggacagtcagggcgggtcctatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaattatactctctggaattttctcggatttttcggagctcaattcctaattttaatcatacaaagagcatttcagtaattacccacatattaaattaatcattaaatggtctaattataattttgttaagtactttgagtgtccaagtattttcaggatttttcttggaattatttgagcattggaagtatttttaacaattgaaaggtcatctcattggttaatttatttggaaaagtaaataaaagtcctcttcatcagcttgggccgaattcagcccattccctcccttcctctcagccggctgaaaagtctagtttgcctcccttgcactacagtgctccttcttccagctctggacagagccagagccgtgccgtgcctgttgccgccgatccccttccaaaatccaacctctccgttgctcttatttccgaattggttgcgggaatggaatcctctcaatctcctcttcctagtccccaagaaatccccaaaagtttatatggaaatcctttccaatttcgcggttcaacctttcctttttccggcgaagatctaaactttcccgagtttttcccgtcgttgtgggctcgatcccggcctcccatggctatataaaggaccccctagtcgtcctctactcatcccctcaagtcccgtcttccgccgtcgccggaaacgctctccccacgctctccctctctctccacctccggccgccgctccagccgccattcgccgtcgccccggccgtcgccggtcagcgccaccacctctccgcaaagtcgagctctaccccagccacccgttcttttgcgccgaacccctccagaagtcgccgtcaccgtgaaggccgaaccgttgccatgttttgatctccggcgaagctttgccgtcgactccgtggtcgccggacctcgccgtatccactgtcggcatcgcagcagtgaggagaaacccggcagccacctccgcgaagacgcaagccatcggagcaccgtcgtcaccgtgaagccgatctgttccatcttcagtcgcgccgtttgtcgtcgtccgtcgtcgccctctgtcgccgtcgactccattgggttcgcaggagcaaggtgaagcccggccatcggttatttcttcgccgaagattgctgaaacgtcgccgccatcgctgacccgaccccgtcgccgcctctacctcgctgccggccgtctgccgtcatcttccatcgtcgcgccacccctcagtgagctttcctctctccgatgtcgttcaccggtgtagtttatccatagggtcttgatctaatctaatctatttcgcaggttgctttaatcttttatctcggttataaattatttgtaaattgtttaattaatttagaatagtcttttctttaataggtttaattggaattaaattttgtaaaattcgtaactaattcatatgaagtcagaatgaggctgttcaagtctcataattcatctaaaatcatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttcttatggccaatttgcattgcttaccctatttcttgattacctcgggttataatttgactagttggatttatatattggttcaactagatgttagatataattgcttagccatgcttagaaacattagcacactattgggataacttatgactcactattatttaatgatggcttaatgatagttcacgagggtcaatcgtgattggttaattaattaaattggtaattaaaatatgattaatggtgggttatgaggacatggttttgaaggtcgtgctcatagcaattaaggaccggttcgcgagctactgttgtgaaacattaaccatgccaaccacaagccagcgtgggcaacggctttaccttttgtatagcatggttcattgcggagcaccagactgagaagtggcggagataagcccacgggggtcgctgggtaatccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtgcagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggattcagaaggagaagacgtttggcttataccccagttgagctgcctgtgggagtggagctgaagccatcgctagaccattattccgctgctgttttcttttcttttgtaagtatgtaatgttattattatgatggatttgtatattaaattgtcagtttgtgtacctcggctgattcctggacgaagattttatgcacaaataagttcggaaattactagtgaatttccgggcgtgacactatggaacctccgccgtgtgtgggtggcggcgtgtgggttatggtgctccgaggcgaccgcaatgcttgggtgcggcggcggcctatgcacacgcatcctggacaccaactcggcgacgatggtggggtgcgtgggtgatggtctgggggtcgggggaggtggtcagggactcgacggagtgtgccgaggttgagaggggatagcggggacgcccggaacgagctcgcaccgttctcacgctcaatgcggcggtggtggaatccggctcgtcgacgataggttgcaagggtggagaggaggtggcggggggatttgtgtgagtttggtggaggttggtggatggttatcccggggtcgggatgaccggtaatgaagagcaggtgactagccacgacagcgcgcatggccgaccggcggcatggcgagggtgccggcgaggggttacattaggtgccaaatgctgaggggtttatcgacgacgcgtggtaagtgtcctctggcacgcttacgtggttcgggacagcttggacggcggtagccgtttggtccgggccacgcatgtcacgaacagagccatggagcgcggcgcgtgcacatgcgtgtcccagtggcacggtcgaaccgacgaccagggaaacgccatgggctcagagggtaaggcgctggggacctaatgtccagccgctacggccagcaaaatggcagccattgagagttgcgggggtggcgtttcacccactagtgg

SEQ ID NO: 64338 - DNA, 563 bp, Oryza sativa
tcaccatataagatatagattttataattattgcaccatgaaagttttgcttattagtaattcggctaatgtcaatgggcaatgtgatgatttattctagagttgttttctttagaaacattggcattattaatattttgcatacatgctcaagccgattacttacatttgtagtttattggaattcatgtgtgtgaggcatatgactttggtgattcattattcaattggctaagtgttttgatgccatgatgattattgtttcaaaagccatttgaattagtattcatctagacatgttagttggatgttatagtttttcatatgtctagagaggaggaattttggtccaataatttgatacaccaagcatctggctattatgtgaagaaaaattatatactaaaggccgatgcttgattttaaaagtttggacgaaattggcaaagtcatagaccaagggcggtctgaccggcattgcacggcccgtctgaccggtggtaccggcggtctgaccggctctgcataccggtctgaccgggcagacagggtggtctgaccgg

SEQ ID NO: 64339 - DNA, 524 bp, Oryza sativa
ggagccacatggttcacaagatcttgtgagttgggtgaaaaggatggcattttcctttgattccttcagatggaatcaaatggggagaagagtttgattaatcgcaccgagggagatggcagcagggcaggagtagttgattacttgattgcagtgtcatcaactcattatgatcaatatactatttagttaagccagatccagcctcttttgtagtacagggtaggaccaagattgttatggattaagaattaatgaggctacaagtacatccaagtcgcccttgataagatgacagcatctctaaacaagtactagtactactctagtcttagtttgcttagaaccaggtctttccaggctatgtaaatgaaaatatgcgtaccactgttctcaaactatttttttaataaaactctctacatcaatatttgcttagacaatttgttcatgatatatatatatatatatatatatatatatatatatatatatatatatatatatatatatatatatataaa

SEQ ID NO: 64340 - DNA, 659 bp, Oryza sativa
tcaaagtactcagctgaagatcgaaagttcatgattggtgtaggaagctgaatcgttcctatctttaacgttgctgccgcttccttctcgttattgtcggcacccgcccatggggtggagtcttgtgggcgttctgattcagatattttcccattcagtatcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaa

SEQ ID NO: 64341 - DNA, 598 bp, Oryza sativa
tgcaaaaaaaaccttaccaaattttggtaatgccaaattttggcaattatgccaaaattttgataagatttcttatatatttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcatcgacggggccggccgtcgccgtcgccgccgcggtggttctggacttctggtggtcttgacgtggctgtggacggcgctggtgcagctggtgtggaggccgtacgccgtggcgagggcgttcggcggcaggggatccgcgggccggcgtaccggctcttcgtcggcagcgacgccgaggcgaacgcgatgcgcgcggcgacgtgctcgacctgcgctgccacgacatcgtcccgcgcgtgctgccgcactaccgcgcgtggatgtggcgctacggcaaggtgttcgtctcgtggagcggcgccacgcccgcgctctgcgtcggcgactaagccatggtga

SEQ ID NO: 64342 - DNA, 4346 bp, Oryza sativa
ccaaaaaaggaaaccaggtggaggaggggggagggggcgcccaggggcgatcgatcgctccttagcatttccggagaccggtatggtatgtatgttaattagaggctatcacgttacaacagttaagacaatacggtctctaaccattaatataccaaaatactttattactagtcatctttcctttattagactcaatacaatgaaaaatttcctaataaatgctaagagttgactctatgccgttgttatgcgtaacaaccatatttctctttccttcttcctctctcttccacgtcaccaaatatgcttgcatgataataaagagagatcgctaataaagaccattgcacatgtcctaagaaatgtttgaatcaggttattttctaccattccattttttatttgcatgcattcatttctaaatgaagtacagtgaattacgttccatggatcatacaaaaaaaatcatgccccttaattatgttgaatcaattgctttccatgtacgcggatttagatgttttacctttttccgtgcgttgcaacgggaaagataagaaagtcgatgaaaaaatagagtgcagtcgacaaacggtgattggaacgaaagagggttagtcggctgatgacagtgagagacggtggcatgtcaaaccctagcgggatagaatgataggagggaacgcagattgtggaggcaagggttgcttaaatccatttgagattttgattatgtgtaatggtttatcgggacaaccatttgaaattacatcttagtagctgatggccatatttaatagttcatgacatatataaaaaataccattagagattctaccaggtaaagcttcggaaaatgtttcctcgactcattttctgggggtggctaatgggcgcgcgcgccggcaacgcgcgcaccagctggccccctcccccgagcgattttttttctttttctgttttcacgattttcttttttttttcgccttcccttttacgtattttctgattattttcttatcttcaacacacgtgttttcaaatgttttgacttgaaaatttttaaatctcgagttggaagtttttaaatctgaattgaaagttttcaaatctcgaattaaaattttcaaatctcgagttggaagttttcaaattctgagttggaagttttgaaattttgaattgaaagttttcaaatttaagttgaaagttttcaattctgggttgaaagtttttcaaatttgagatgaaaagttgaaagttttcaaaatttgactttaaaaagttcaaatttcgagttaaagtttttcaaaatttgactccacatatagatttcttttcaagatgttaaacaaaagctatccgaaaaaaaaatcttatgttaattgtcggtattatctctaactaacaggattagttggtacgtttctctgagaaaaaagtccggccgcgtgcgcgttggcagcgcatacgcgcggggtagcttttccgtcattttcttctatcggcgtgtgcccacatctcgtacctatatctgttgctccagtgtggttagtgtataggcggatctccgtttcgctagatctagtcaagctcaggtctacccgatccagctcgttgaggcagcggtagatttagtgatttaccgcacggctaccctaagcagctccccgggctcccaagcctacagctatcgagttgttcctttgtaagctggtgattttgcatgcaacgccacaccaaaccccaagccaggcaatgacggtcacgagtatcgccgggagtcatggaccttgcaatgcaacacacaagtacaccacatcagcacacctcttgacttggtgctagtttaaaaaaaatgtagacgagcgaagcagaggtgttcgactctagatgaggtctggttgtcaaatctctctctttttaattttttattctactaaaaaaatatctgtacgttgcaacgggtgaaatctattttaatattattattgttaaatggtttagttaagatgaaatttactgtgggagttcgcttggatatatatatattttttagaaaatcatgagctgcagttaggagtccgatcatctcaagttagtatgcgagtttttttaaacagatttcttatatgattccttctgtattatcaaaagtgaacgatattaaaaaccgattcaaatacggatatttatttccaaagcaaacgaacttaaaaactgactcatacacggatgacgtaccaaaataccggtaaaaacatatttaatttttataatagtagagatagagatataagtgacgagttccatggtatgcccgattgagattagtcatctgtgatgggtactataactaatctcgtttgactcatatgctgagccaaacctatctatgacgggccttatacttagtccgattgagataactatcatccgtgccggtcaaatgcccgattgagataacatctcacatcaatgatctttgcttagtgacggtagctcttcctggcactgattgagacctatcccatgctagtgaatccagtggctaacagaaggtcgcatcacaatcgaacctctgcgtcgtgactctgtggccgcgggataagcagcagtcagtcacctccccatcgcagaaggctgctattgatccgatctgatttatcaaaaaatcggagagaaagattttttttttctgaaacaagatggcatcgagtaatgaactgcaggggaaaagttgatgtttcacatgaactgtaccataaaaacagttttgcaaccaaacaagactaaaatttgctcaacaattaactcaccgtacaacaaaatcgcgatcagttccttcaagtaaacaagctcacagccattgcgtacaaggatgaagcagcatgctcaccggaggtcatggactcctaccagggccgatgcagccacctggcctcgtcctcctcatccaatcacgaaaagagaccgtgcgattaatgaagcaaatctgggcgttattatgtggaggcagtgagacgcaagagatccgttcgaatggagaaagaggagacgaagagatcgagtcggagaagcgtgggacgggacggacaggtcaggacgaggtgaagctgacggatcaacgtgcacgcctaccgaccggccgaaccgacgaaacaccaaactcctgaattctgatccgatttggacacacaatgactgacgaaaaactacgacaaaaacatcttaaacttttataatagataaagataaagatcttttatctatatatagatatttatttactatactaaaatgcatgctttcaatttgtcttttacctatcataaaccttagttacgagaacaatttctactcgtgtttgttgttcatcgttaagcttgcctaggttctagatccaccgctgcactgaggtatttattgatggagcttccataccgactacttaagattatagatggtgatatggcctgaggctcacgggccggcccgaagctcacaattttggcccggcccaagaacagcacggcccgactgggatcatgcccgtgccagcccggcccgatcaaagaaaaaaaatatagagatgcaaaatagacttaaataattatatagggaaaggcccaagacaagaagtatacaaaatagacttattttccagccatttaaacacagcccacggagttgaggaatcaaaaatagactttttctgtaaagaagcacgatgaaccatcgtgccttcaggccagcccagcacggcccgagtagtattgggccgtacctaggccgtgtacgccacccatgggctggcacggctcggcctggtgtgttggttgggccgtgccggcccgacaagcctcggcctaggcactgtcgggcttgggccgtgccgtgccgagcaacccacatggccatctatacgtaagatcagtcaatgcttccaactctatataaagcagttgtggcgaactctacatgggaaggtatattaaaaaccaaatagctctcaaacccctagttgggagtatccaaaagatatcgggctcaaaaatcatctccatctctaagaatatccaatacttgattaaaaaaactttaaaatctgtcatgtcatcactggttggccctactaaactgatttttctcgagtgcgtgcaggtgtccaaaactagctactatttggttggattttagatgtacctaaatattggggggcctcatttggaaacctgttggagggttgattttacccttaattcttaaaatttaacttttagggacaagattctcttggagatgctctttaccaatatcggctgtttatatcggttcaattt

SEQ ID NO: 64343 - DNA, 18562 bp, Oryza sativa
gcttgcttgctcccagggcgtgctcggatcagtgctcccgtatacgtggcacaatcctagcgtttccctgttttttttctcttgagtaaagtgtacgcgcggtccttaaacttatatgggtatgtcatctagatcgctaaactctcaaaatacatatccaagtcccagaacctatcatagtgtgtcatctaggtcccaaatcgccacaaccccttcaggatcctatgtggcgttgatgtggcatgccacacggacatgatatggcattattttgactgataaatgggacccatttaatttttttcctttttctttttttcttctctttttttccctttcttctcctttctctgtgacccgtgcagaaaaaaagaaaaaaaaagaagaatgagaagaaaacgaaaaagaaaagaagaaaaaaaaaggacacgtcacgtctatgtggcattgccacatcagcgccacgtaggatcctagaggggatgtgtcaatttgggatctaaatgatacactttgacaagtactaggacttggatatgcattttgagagtttagggacctatatgacacaaccctacaagtttaagaaaaccgaaaaaaaacggcatttaacactccaccgcttacagctacttcctcttttagatttctttatcctgtggcagcagtggtgaagggtagctggctgccggcgcccagaaaccggcgagcagagccggcgtggtggggcggcagcgagggatgagcaggaggaagctgcagagcgacgagtggtggcgcatccacgcgcggccgtgctggtacgggctgagcgatgggtatcgccgggtagtggctgaagacatcgttgctgataggtctgaaagggagcagtacaccaggatgtgcaagaacctatcaaacaacacttcgaagctctaaggtaacatctatgtattgtagaatttcctaagtaaatgaccgcaatcaagcaggggtccttagcagcatgatttgatctaaaacaactgagccttttcaattagcactatatattggtttctgacaataagatctgattgcattgcaggtttcaacttcagagtttacaacccacactctgctccacatttcatttctatcatgggagatgtcaaataattgttgtaatgatttgagaagacaagtagagaataaataaatgagtagccgaacattattcatgtactctgtagttgaatccatcaggagagaaagatatttttctcataaacagggttgatcggaagttaaaaatcaataatgacaaagaacatgagcatctatgtttaccttttgggtttctgctggatcatttatagtctcatccattgcttttaaattttggtgtggatattggtggcttgatggtgtataatcatgtggagatgtgcgggagaaatttgccgggggtgatgcttctgttggcgcgaactggaaataattttcccaccaaaacactgtgatatattgttaattacttgccgttaatgatgggattcacctgatatggttgtgggccaaggagaaaaagcagggaaacactaggattgtgccacgtatacgggagcaccgatgggagcacgacctgggagcaggcaagccgcgtcccatacgacacaagtactccgtatctgacaaggctggcgtgccgaaacgaaacaaaacaggttaaaggcgagtttatatataggaaaatactttacgtcgagcgaccggcgcgagggagccagatcggacgctcctccgcgcgcccctccccccacgtgtgtactgttgggccacccacttctctctccctttttttcacaaaagatgtttcacctagtgtacttataatgtttcactatttatagatctaatgttacagttaattaaaatactcttttgcaataaaaaacccacatattttggaaactctctataagggaatttggtttattttttgttccaccaaaaatgttttacctagtgtactcacaatgttttactatgtacagatctaatgttgcagtgaacgaaacatttcattgtaaaaaaaactcacatattttggaaaccctctattaagagaatttggtttattttttgttccaccgaaaaatatttcacctagtgtattcacaatgtttcactatgtatagatctaatgttgcagtgaactgaaacattctttcgctatttgctgaaacattgtttttatataaggtgaaacaatacccgatttaaacgagtgaaacattttcgatctacttagtgaaacaattccgatatatctggtggaacatcgtgcaacatttaaaaataattcaataataagctaattttttcgtcggaatatatccatatgtgatcttgttttgaagatttaattgcaacaaatttaatgatgcaatcggatcatgatttggataagtaatttaagagaaaaatcagtttaaagtagttttacatgtaaatcggacgctgacgtcagcgcccggttttaccccctccggattgggcgcccgaccgggagtcgtctccttttatatatatatatatatatatatatatatatatatatatatatatatatatatatatatatatatatatatatatatatatatatatatatatatatatatatatatatatatatagggaatcgtagatggattcggattgcgtaccaaaattcagacaaaaacatgtttaatttttataatagcaaagatagagatatagatatatataccatcggtcggttttctaaaatttagaattgagattagatgcttacgtacgtgccttgccgttagtcgttacaccgccggtagtgttgccggattccacccggacagaaaaacagcgatcaacccactattaaaaactagtaatttgcccgtgctaatgctacggtgatatttaatatgtctccccagacaaagtaattaaaaaattgtatatttttaaatttttgccaaagggagtagtaaatctagatggagcaattaatcgcatcttacgtatatgcaaaaaaggtaaattgtgaatatttgcaaatataccaatattataacgtgaattgtctcatttcttctccaaaaggaaacatctaatatatttttttatccacaaattgcatatacaaatacatcccgtcaatctcaaattcctctccataaatttatcatcataacttcaacgcttaacgacctacaactctctgtccatatctctatgtcacagacccccatataacccatcaacatattttcctggaggatatggacaactcccataactcattacccaagaagtgcacctaggtgacacgcatactgttatcctaggattgttgcagcaacatatttcataataacacagtaaatttcaatacatctatgcaacctcatttagcaggctcaccttttatactattataaaaaatattaatatttaacattacattacttattgacatgtttacacaattgtaaaataaatttaaaagcaaagtacaatacaaccatgcatttcacatcactgcacaaaattcttaatgagaaaatcgcacgagaaagcaattgtaataaaaaagcacaaaaaggcatattattcattattggaccatttgcttaggtgaacagtttggtgccatacaaatgtgctcccggcaatatgaaaaagtttggcacaatataattaaagagttacaactttttgaagagaatagaagaaaactcaaacaaccctcatggaatactgcctattcctcttttcgtccagtgccgcagttcctaattattcaattgaaccaccatccacgcaagagtactaatggcctcagcaaacaatgggagactgcaagcaaatcaagaagatagtacacctggtcactgcacaaatgctatttgctcaaaaacagagggctaaaagaatcagtcatatattcagtctaatttatatggtagcaccaaaaatgaaatatatagtacatagatatactgcttatagacgtgcaataatctagaccaaagctacatgacagatttggcactctcttggatctgatctaatatctctgcacaaaaaaattaatatgcaattgatgataattgatgtcaaaaagtggaaaactttcatcatacctctgatgcagtcccatttggcttgctcgatctggtttcagaaagactcaatttcatgattaaacaaaaaataatagctaacacttatgtctcttttcatcaccatgatgcatgggtgtttttatagtttattggagcaacttatctgttttacatggatgtagattgtattcttacttcaagttgcatttagttgcctagaacaaccgagtagctactgtagtgtttttcagaataatattaaacagttaaatagtaagaccatgtactttgtttttcgtggagtaagagcatgaactaacctatattgataatatgaccaggaaagaagagtaaatgagcagcttatgtgtaccattgacagttacttaaggcacattctttctcatacctaaatattgcttgctactaaacagatgaaaataagcatgtccagaaaaagaagcaaaaccacagggattacctcatacctgagttcataatctccctcactggtgaactggagaggcacaagcatttgtaaaagagaaggaaaggtcataggagccttctagcaaggtttgttgtacaggcctatcagtagatggcatcagattaatcaggccttcacacaattatgcagaaacatatagaaataattaaatgaaatggcaacctcgttacttccaagactccagccatttcttcttctccttacccagatcagatcagatcagctgaagagagcaaattaaagagaaaaagaagaaagtaggcagcctacctagatgacagttgtgttcaggaggagagggttgatatttgagaagcacaatccatcacaatatacattttaaaatcaattttctattcaactgaaactgatggttgaacttggacttgaacttgcaccacaaatatacaacagaattcagaaatatatacaatcttacccagctatgcacttggagttgaaacagatggttgtggtggtggttgtggggatcatgcgtcttggaattcaaattgcaatcgttttccttaaaataaatgtgataaaaatatttacactgcgacaattgcttacagattttcctgcaaaattgtagaaggatatgcaatcgggaaaagttaaagagacctacaaagctaacctaaagtaatgtaaatctttgttggtcatgagggaggcatcatgagggagacattgcaattaacattcctctagcagaaaatgcaagttaactgcactttttgtaaatcttctctaacgaagaaaataacttgagctattatcttccttcagaaaacttatcgcatatagcttgacctatgaacatcatatacatcaaaggctacatgtgtttctcatttctgtgtaaatctaatgacagatagtcaaacattcaagctagatctatccactgattccttcacatctgcacaaaaattcaaatatccaaaataaaaaaatacctgctggcgtgctgcagcctgcatagaggtctgctggtggcaattacttgaagggttgtgggcatacaggaggggaagaacactaaggaaacccagacgttcagattctgcatcaggttaagccaaaagaaagttaagttatgcacttctgttctgtttttctctagactttgctacaaatttagaaaggtattacattatttaacgacataaggacataagtgaatatctggatatgaataactgaatcagtttgtctaatgacatggagacatagttcagaaactcaggtaataacaccaagtagagtgcggtcctaggtggtcacacttaattgattcctccatagtatataaatggatctgagtttctaaattacaatcaagggtaggatgttggtaatttgaatagttcagctgcaagtgagactgtcagttctagtggcagtaacaaatggatctttgatccaagtattattgagctcaaatttactgaccatgaaatcgtcaataaccagatccttcatttggatattcataagcttccacaatccattgaatcctctagatccaggttctgtaaataaacatgatagagatatcaaatgggtgcatcacggcatctagtgctgtaagatgaactgatgcatattaacaaatgcaaaaaaaaaaaaaacatgcagagcagtccatctagttttgcgagaaagattcccaaggtaaaattgtactctgcacatattatgaagcaaatgtatcataaactatggcatacaaattttctttgcttatgcacatattgtgaagcaaatgtatcataaactatggcatataaatttttttttgctgaaattcttttgagtgcacgataatagaacattatatgactttcttttttcccagattcatttttaagagatttaattctagacatccagctgcagcactacagttaccacaaatcaccatgcgtaatagatgcatactgcaagctaactgagcgaggtacaatacaagttgatagagaaaatcattttggtgctctgaattcgctagcatgttcctttttaaagaaagaaccggttctgctctagttgacgaggatgagataaagaattaaccaactaaccacaacaattctcacagagattgaaatgatcagccaagcaaacgaagacgatctcaacccatgcctaaagatcaaacggaatacattggaatcagattagggtttctccccacaccaaatccctcaacgatcttgcccaagcaaaacaaaagatcaaacataatacattggcatcatattagggtttctccccgcaccaaatccctcaacgatcttgcccaccccgatctacaccggagttgccgcacgccgccgctggccggcgtacgggcggcggactggacggcggtggcgacaatggttgagcggcggaaggagaggggaggcgcatagtttgttggaggctaagggcggccgatctcgaccggcgtgcagcggcggactggacagcgatggcgacgatggtcgagcggccaaaggagaggggagcgcaacggcgtgagcggccgagacgacgcgcttgatgacgtctccatggtgttccggcgatgatggatcggcagcggcgccggcaggttgaggcggcggccgctgcggcgaaatagggttaggggagggggggagcggcgtgagaggaggaaaaaagcgtcgggggtgcggcggcggcgtgattagtgggcgcaggtgtgagggaacagggaggcgaaggcgacggcgcatgctatgcgggagcgattctggacgttggatatgagtgagataatcccaattccttctagatacacgattcccggcgcccgccgcacacggcctacaggtcccacacacggacgtcacgcgatgccgcgatctcatccgatgattttctctgatcacgcgatcacagagccgcgccgccgccggcccacgccacgcgcgagcgcctgcgcgacccggcgcccccatgccgcacgcccagtcccacgccgccacgcgcgacccggcgtcaccggtcatccacaagcttcatcgcaacaacatcatcatcggtcgcccatgagattcgttgttgctgctaccgcttgtctgcgaggttcttcgccgccaccggtggtcgtcggcgtggttcatgggtaatttagtgcaatctattcttatatatgactcgtactaattaagttttaccattttgcaggttaaaaaaagactaggcacatgagttctctgcttttagagacctttggtctataagcctcctgatgtcttgattcatctaatggtggttttcactgtcacatatgagcatgatgatccaatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcctaaggagctcctgatcattgtagtacagctaaaaacgtactgcagagaaaccgaaaacgggaggagaaaaaaacagcaagtacgagaagggaggttcccccacttgagtaagtgacattggattaggccgatccttctccctcacaagagacattgctgaaagtacaggaagtaaaagttcatcctctccctccaaagactgttctgatccatcaagctacgttgacagttagattgttcgggcttgcagaagtaagtgttgcctgtagatcttctttgtactggctagttgttgagtgcttacttgcagtcactgcagttgcggctccggcgcatgctgttgcaggccagcaaacgcctcttctctgtaaaggatgagcagcaactcaccatctggttcacccgcgacaagatttgcatcatagatgtcgatcgggtgaagcttgtcaagctcttcctgaagatatccttcaataccatcatgctcccgtctccagcagtgtaatgcgaatgcagatatcaggctccagctcgtgattctctttcttgtaatgaggcttgtgatggttccattcacatataggtccatttggtgatagacaagtgctctgactgatctcaggcgtgcggcttcacaaaacatcactgctaagcgcgcaattgctttcctttggacatgaataagtgggtggtcgcgcggaagaccattgttgaagttcagtagtctgtagtatgaatcaagtacagacggtggccccactgtaacctcatccctgcaaaattgcaatgtttcaagtcattactaacttcttatagatcagaaacaaagacattataacaattttcatgtacaaagtacaagtttttcttggggcggtagccgcggtattcccaagtcattcgaggccatctgttctagaagaaccaatggttgagtatagtaggtagtaatatatgtcatcacttactaaaggataattaaacgttttgacagaatatccgtaggaaataaatgctaaattattatttcatttattaactgcccttactacagaatattctgactgaccatatctttaggaagatgagctttgatcttttacagatattcccttaaaacaaatgtacgcatcaaacattaagaaccgaataatattttggagaattaaatgtagtagaacataaattttgtgaatcttaaacatccaaataatttagaatattagaatataaaaatcagaaagaccccaatgaacttaatgtcgaacctagaggaaaaattgataatgcaaacttgaattttcaacactctcagtgtaaatttaaaatcatgacgaatcaaattcaatatttgaaagcaaaggtttgtatttttctatttctgttatatcaatgcacatatatattcttaaacttcggtttgataattcgatatttgatcttgaatgtgctttattatcattacttgtgtcaatccaatcctgatgcaaaattaatagaatcatttgtggaacggtagagagctagtagaattggtccaatgcacacttttatttatcaggatacatgtacagtgactaactagagctacacacagagagggaacgtaccataagaattaataggacgatatgcacacacgttcacaggtttgctaacatcatttatcatgttgcttcttttttttagctcaaaccacagcccctgtgaataacacactaaacacgattacaattttgtttaccagttgtccgcccctatagagtgttaagattaacctaaagtattgcctcttgaagggtaaaaggagcaacttgaaacaacttaaaagtacagctaggaaagctacacttaccagtcctgcagaaggtgaccatagtctgctttcaggtataagataggttgggcatcgagaatgtctggaggggtttctgcgtcagagaagttgaaccactgaccagctccatctctgatggcactcaaatatgcgtttctttggtcaatgagtatctgaatgttagaatttcaatggttactctaattgagaagaggatggcactcagagtagggcaattttctagttttttttattcacaaactcaaaagccatacctacccgagggaggttggatacatatatatagccatagctggctgctagcctattgttgcaccctcctagtctaaaattcgaaatttgaatgggatgctgtcctagagggcatccaaactgaataaagcataaaggaggcataaaggaaatgctaactgctgctatcctactaaccgcagctgtcctagcaactgagaaatatgctaaaggggtagatgctgtcctgaaaaggtgaaactacccaaaagcaaaaagaagaatcacgaccaaggaccacaaagacttatccatcattctccccctaagtcttgtgcgtcgtcttgtggggaagttgggccatcccgatcctggagtagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagagccagagcggacttgctatccaccctgagctccaccgctccagtatctttgccgaggagatcactaagtagtcgagtaagccagagcgcctgggtcgaagcggcagaggctgccatgtactcggcctcgcagctgtacagggccaccacctgctgcttgaccgactgccagctaacgaggcactcgccgaggaagaagagaatcccgctcgtgctcttgctggtgtcgatgtcgccggcgtggtcgctgtcgctgtacccgacgaagtgtgccttgccaggacatctcgggtagtagagaccgtggtcgagagtccccgcaacgtagcggatgatcctcttcacagcctgctggtgctccgctgtcggtcgctgcatggaccaactgacgtagccgacggagaaggccaagtccggccgtgtgtgggtgaggtagcgaaggctccccacaagacgctggtactgtgtagcatccacttcctccgtcgtgctatcacggctcagcttcagtctctcctccaccggagtgagagctgggttgcaatcggtgagcccagccagctcaacgacgcgcttggtgtaggcggtctgtcgaagcgtgttcccggagacatccgggtgcacctcaatccctaggtagaaagagagaggccccagatcactcatctggaaggtagccttcatctcctccttgaacgccgcgacctccgtatccttggtgccggtgattaccaagtcgtcgacatagacacccaccagcaaggcatttcctccattgccccgccggtagatggccgcctcgtgcgggctttgctcaaagcccatccccttgagcgtggacaaccatgtgatggacgccccaaccttcctgagcagccagcgcaagaaggagtcgcacggactccatccgtgccacgggagcgaaggcatcgtcgtagtcgatccactcctgctgcacaaaaccgcgtgccaccaagcgagccttgtgcttgacaatggctccggcttcatccctctacagcttgaacacccacttaagggtgatcgtgcggtgaccacgagggaggtcagcaagctcccaggtgcggttctcctgaaccgcgtccatctccgactgcatcgcggcacgccatgccgcatgtttctcggcctctgcgaaagaccgaggctcaccatcaccgcacgcaaggtgcaactgcgcctccaggtcgcgaggcactagtcccggcaccggctggtcgccgagaagatcctccatcgtacggtaccgtaactgctcgccgtcgtggtacgcgtcaatgcgctccccgtcgtgggagagcggagtagcgaactccaccgggctgcgctcaacacgagctggcgtcggagtagacgtgctcagaggagtggctgttggtgctggggcgcgtcgggtcgccggctgtggtggtgtcggcgaagagctcgtcgcagtcgaagtcgtggcccgagggtgtgttggtgtcggagttggtggaggctcggggactggggtagacacgctcggtgaagaagagctgcctactcccccagctccctcgaagtggacgtactcgacggtgaagtcgtcgtacgtcggagtcgaaccatcgtccaccgccttgtcccatacccaccctcgcccttcgtcgaacactacgtcgcgcgctgtgcgcacacgctgtgtctccgggtcgaggatgtgataggccttcgagccctccgcgtagccgatgaacacccctagggtgctcctgtcgtcgagcttgccgatgtggccaagctccttgacgaacgggatgcagccgaagacccgcaggtgggagacccccggcttgcgcccataccaagcctcgtacagtgtcctgccatcgagggccttggtaggcgagcggttgaggatgtagatggccgtcaccactgcctctccccagaagatggccggcatccccctctgcttgaggagagcccgagccatccccacaaccgtctggttgcgccgctcgacgacgccgttctgctgcgggctgtacggcgcggtgtagtggcgccaaatgccctcatcaacgcagtacgacgtgaattcagccgccgtgaattcgccgccgttgtcggtgcgcagcacgcgcagcttgcggccgcactccgcctctgcagtagcctgcgcgcgccggatggcgtccgcagcctctcccttgctgccgaggaccatcacccacatttagcgggagaggtcgtcgacgagcagcaggaagtaacgtcgtcctcctggtgtggccggtgtcactaggccacacaagtccccgtgcacgagctcgagccgctccttggctcggaaactcatttgctggggaaaggggagccgcctctacttcgttaggacgcagacgtcgtagagctgctccacgtggtcaaggcatggcaggcctcgcaccatctccttggcgctgagccgcttcagggcctcaaagtggaggtgcccgaaacgctcgtgccactgccacgcctcgtcgtcccgacgagcggtaaggcaaactggttgtgcgacctgcgcgctgaggatgtatagtcgattagtgcctctggttaccttggcaagaaggcgatggcggcgatcccaaatcctcatgagtccgtgctcgaccaacacgcatgagccgttctcatccagctgtcccacgctgatgatagagtttctcaacgcggggatgtagtagactccggtgagcagcatgtgctcaccggacttggcggtgaaggtgacggagccgacacccttgatctccacgccagaggcatccccaaacttgacagagcctcggacgctggagtcatgtgatgggtggcgccggtgtcgaggtaccacccatcagccttgtcgttgctggagctgttgccgaggaaggcgtgtactttcggctcctagaggtggaggaaagctgttgcggccggtgccgctgaagatagctcgatgctggcgtgtgccaggagtagagtcggctcttcctcctccacctgtgcgatgtgggcctggccagagtcgacctgcaggcatgcacgcgtcgtggctgtcgacagtctttggcccaatggccaagcttgccacagttgcggcaggcgtcgtctcgtgccggcttgtggttgctagcggcgccgccctgggcgcctctgcgagcgccaccctcggcgtgtcttcgcgtccaccgcagctggacgcctccgcgcgccttgcgcggcttgcggcccctctcgagggagaggactcccccttcttcccatcaccctggctggcctcccactgctcccgagtgagatggagcttcccgccaatggtgataggccccgagagaggctgtggctcatcgccgtcgacgaccttgaggcgacctaacgcctcctcgatcgacatcgtggagaggtctagcagagactcaatcgagcgagcgatctgcctgtacttctctgggacgcagcgaaagagcttctcaacagctctctcctcgtcgtaggtgtcgtcgccgtactgcaccatcttctgcaaaagagtgttgagacggagggcaaagtcatcaacatcctcacctggcttgaaggctaggttctcccactccttgcggagtgcctgcagtgtggacttgcaggcgcggtcactgccgatgtgtgccacagcgatggcgtcccaggcctccttggcagtccgcttctgggaaagcgagaactgcatctcgggcgggactgcagtgatgagggcatccagcgcccgtcgatcctcgtcgtagtcgacgtcgccgtaccgaactgcctcccacatgtgccgcacctggacctggttttggtgaggggccacccaccgccaggaccaaagtccctgaccaccgtctggacgccgtggtgaccatggcgccggtcagggaagggagaattgcgctgcctgggagggccgcgcgcgggctccgggctgccgccggcacgcccgcgcccgtctgggttcccgtcggagggcgcgcggtcccttgggccgccgccgccgccgtggaggtgggctactgcccaccgctctgcccgctccccgtgtccttcctcttgccagctcctcaagctccctgtcggtggtgatgttgccggcgatggagccgttgatgctgctgcgcaaggtctcaacctctacctccgccacacgtgccgcatcttccgccgcctctgcttccgcctccgccctggctgctgccaactccgctgctgccagtctggccgccctcgctgctgctgcaacggtctgagccgttgctcgcctgcgctcttctgctgcggcgagctcggcgtcctgctgacgccgagtgctcgaggcgaccgaacgccgagaccgaacgtcgaacatggcgcacctccggggggctgctgcgtggagaggaggaagggaaaggggaaggaggagtagccggtgctgctgctgctgctggctgagagctcaaccgagcttgggaaggagtggaacaagagatgtttagcctacaggaaagtgtggttctgataccagatgttagaatttcaatggttactctcattgagaagagaatggcactcagagtgggacaattttctggttttcttcattcacaaactcaaaagccatacctacctgagggaggttggatacatatatatagccatagctggctgctagcctattgttgcaccctcctagtctaaaattcaaaatttgaatgggatgctgtcctagagggcatccaaactgaataaagcataaaggaggcataaaggagatgctaactgctactgtcctactaaccgcagctgtcctagcaactgaaaaatatgctaaaggggtagatgctatcctaaaaaggtgaaactatccaaaagcaaaaagaagaatcacgaccaaggaccacaaagacttatccatcactgaacagatggttcctcaggcatgtcaagagatattatgtgccacccctcctcattgcttgttataggaacattcctgaaatcgtgatgtgctctctgctgaaaaagttgtccaatatcgtccatgaggtcattgtagttctgactggacaaatcaaccacgttgatgttgagaactggtatttcctgcaagaagaaggatccatccagtgcatgagcaactgtaaggatattcagtttctgcacttgcacttgttcaaaagtcaaaacaatgtcatttcatttcaattaatacttcaatctttatgtgcactttgggaaaatgtgatacagtttagctacagtgaatagaaccagaaattgtttcacaacaaaatattgcagaactggctggctccccaagaggttggcctgtgcagcaattctttcggtctacaattaaatagaaagcagggctcttgcctttcttaagaagaaaaaaaaagtgcatacgtcaatagaagacacagagtatcattcacatgtgctacttatcatctgttttattctcagtgatgtatctaaacttattttttgttttggagattctcggaacaatgaatcatgcaacttcatttagttttagcaaaggatttcatgttgagctgcacatttggatatgttaagggcttgttcgcttagttcatatgacgaagagattggagaggattgagagggtattaaactattaattccacactcaataggtttgtggaattaatcatctccaaatctcctttaattcccatggggagggattgaccgagctagcaagttaagaaaactatggattaattttcttttccaaaaaacaaattttacttacaatttttagtaacataaagtctctaattattattctcatcatgatattttaagacaaatacgcttgttatagcatggaaaatgctaaagtacacgtattaaacaccatttaacacatttgctctcgataaaagaagttaacaaggttacatacttccattttgagaaatgcccaggagtcttccggctagctccacaaggtggtgggctagacgacctgggtacaaagcctcacccctcctaattatttgatattaggtccttccctaatattctagtttttttttttacatacttccattctgagcagcttagacgcgtcctctcttcacctgcaaaatagagtcatttgtgattcaaatgaacatttttaagcaaacaaatggtacatttttttaaaaaaagagtaatagtgatgttatttatttctttatctttatatatcatgtatctttatgcaaaccaataaataaatcaagcgaacttcgctggttttaacaaaccggttggtctttcctgataagtagggataggagagtgtcctatgctgaaaaatggactccttcatcagttttgaaggacggttttgctaatatggtgatgttgacatgatctttatcccatgtagcgcttatgtgatattagaattaaaaaatatatgtgagattcatttgtcattcacatacaaaaatatatattgtgggactcactgacatatggggcccacgtatcatcatctctctctcaaacccttcttccacctccctctctcccttatctctctattttctttcccccttcggtcttggcgatgacaggcaggacgacgctggcgagcggacgagggccaaagcagcggcggcggggagctgattcccatccctttccttggcttcccagaaaccctaatccatgcgccgcatttcgcctctccctgcgcaagaccgcatcacatgccgccgacatctactcacattgctcatagattactgcccgcgctagccatgggacatgtcgggaactcaaggttggctgcactcgagggcggggaacgggtaatccgtgcgctagagctggcgccacacctaggtcgtcctgcaaaaaggaggggagcacaagcaccaagagaggagaagcaccaccgtccaaagaaatgggatgatcggtcgcaatccagagaggaagtggtcagaggcaccggtggtggtggcagaggaggagggggatccacctgtggcggaggaagaagacgaggaagaaggcgtcgacttcatcagtgacctcccagacgccatcctcggcgagatcattgtccgtctccccaccaaagaagccaacagcacccaagtcctcgccgctctaatgctccacaccgctcaacctcggctgttgtcatccccgcgcgagaaaggatgccctcgctggctccgtttccgcatccctagctagacccagccgatgatctccaagaacgactctgcgtgcgacgaatcctcgccgtccagctgcccctcctccattgaatatattttgatacaaatgtttgttctgtattgaaaatactattatattttgctataagcttggtcaaacttaagataaatttaactaagaaaaaagtcaaacgacttataatatgaaacggagggagtatttgaactagaagtttcctatgcagta

SEQ ID NO: 64344 - DNA, 26110 bp, Oryza sativa
atataagagatagaagagagagataaactgacaggtggggccccacctattttttaataaataaattgctgactggaccaccacgtagaccaaaaccaccgcggattgggtcgaggggggtaatttgtccggtttacatagttcggggtgaaaaatgtccggttttgtggttcaggggggcaattcagacgaccgctatagttcggggggggggtaattcgtactttttccataaattaacaatgtgcactaatgagatactctcttattcatgaaatatctccgctcgtgctcgcatgcattcccgccctgctcaccggcctccctatctccttcctttccgccgctaagctcgtcgtcgcgctggtcgccacctttcctcctctctagccgtcgccgttgagccgaccgcctctctccccctccccgccgcggcgccatctggcagcaaaccaccagcccgctgccactccgcccgccgcctgtgaccgccttccgcccgttgtcgcgctcgcccgtcgccgctctaccgctgccccctaccttcttcgccttccgctcgcttccgacgaaggggcggagcacgaagaggacggggttgctctacccgcccgctgcccacccatcgccgctccgcccgctggcctccctcattgaagagaagagaagagagaaaatagaagagaagaagaagaaaagagataaaaaaatgtgcagctgacatgtgggccccacatactttttttttaattttttgctgactaggatgtcacgtcagcgaaaccacccatatatactgtcatgagatcttaagtgcacggtttgtgtgagtttaggtgtacacatttctgattttgtggttatgtaacctcgaaaaatttcgctgttaagttgagggacgtccggtgtgaacttattaccaattcctcgttccgagaaacttcagggccggatggcggcagcggtggggcaggaggaggagtcgatcgatgaggccacgtgatggcagcgaggaggaagagctgctcaacaagctctcccgctattgccgctactggacggatctgtggtccgacgattccagcgacatcgccaaaagaagtgaggaagcttcttttttttttttgttttagagatgattttatggtaaatacgaattcgctcatgctcttgttaggtttttagttttcatctcaaatcgacatgttcgctcgctgattatggtaggcgggagcctgggcgcacaatagtggggatggaaacatgaaaatggaaaatgttgggattgacatttttcacatggatatgcatcaatgtgatctaatggctcctctctttggtagtatgttgcaaaggaaaaagaaacaataatgcttgactgattgatgcggtttattggatggatgcagctgagattggtcccatgcggtacacggaggaaccgccccggttcgcgatgctcctagatttactagaggttttttctttcgaggtgacggagcttacaggtattctacgctggccaattgatgtgtttggtctcatctccgttcgtgactctctggatcggaaccgcaactatatctttgagcgcaccaggaacaactgccagactctcactgcaaaggtatctccatgcttcatggaaatagcagcacaaagtcatcagacttttctacaggcagctagttagttttgcaacttcacatttgtggtgcactagtgcagtagttcttctttacctaattataatagcagcgcaatcatgagatgtctggcatagttctgttgagaaaattggatgtgtctgaactagttgtacctttggtgcatcatttagtttacttaaacaaattagaacagtccaaacttatatgcacatcacggttccatttcacaaattatatatgatagtctgatatactagttgtatcacagaagcttatcagtaaacaacctgaaatattcaaatgtgcatgatttagtatcctgtgatggcatttcttttttacgaacggcaaaaataaaacctgtgatagcataatcaagcaattttccaatctaaaacacccctacacaccagagattaacatattttcatgatgcataaggggcatcacaaacatgtgggttgttaacagaaataactacagaaacaattggtgcacaggcgcagaattgatactacaaaaataaaatgctaccaagtcaattgatagaacatgcaggggtacttcccacgctcttatttaattcattgcagctagcattttccctatatgaacttgcagaggctatcttttctagcaagagctatgctccttgctccttgcttcggcttgtctgcattcttttccaaccattccagtaaagatgaagttgtcaatacatatatcagatatttatcgtacatcatatactgatatgcagattttgctatgcggtatcattttattattgagaaaagggaaaatagaaaatccaatttcagttatgcatagcatgtcgtcaggctcacatatgttatctttacctaattatcctcttgtttatattttgttttgacagttcaaatgccccattcatattattttgttgagtggaacttagaacacatacgggatagaattatgcatgtttgttcaccatcaatctagctagtttcaccttatcccaaaaaaaaagggaaatatttgttgtgttacattgttgctaccattcctttctaattgttttcatacagggttcttaagtggtggatagtgtatcatcaatattcttatactctctacatcgatcccataatataaggcacggtcaaacttggcacgatctccaaaactgatcttcggattataatttctcatatactataaggtttatagcaaaaaaatatataatcatatgaaagtagattcaaatgtcaatctaatgataatatttttagaaaataaaattcaattcatactatagtaattattggtcaaatgttttaaaagttaaaacttaaaatacgtgcacaccttatattatgggatggaggaagtatttagtaatgtcatggatgcgtgttgggttcatctctggttctcacaggtccaagccatgcaatcctattgatggaccctattgaatttgaaattgagctaggagttaaggggacgagtccctccgaagataagatcttgagcgctaaagcatttgggtataatggaactgctcagagacatagatgtggctcactgcgcagtatgatgttatcaggagcacgtagcaaattggagttcaagtatgcacacattcctgtggcattggaggctacaatcaaggtcaggattacaggaggttcaactgatttctgtggaaagttcattgcacatactgctagtatcaaggaacatgtcatattgctggactctggggaagaaatggtggctatctcccatgatggagccattgatttctgccgcagtgtagttgcattggaaggaaatggcggagttctgactgttagtgttcatgcaaggcagagtggtgatgagaatatcatatgtgcttataaacattttatcccggtaagatgtggacggaatcatgacacacttgatgttgggttttgccagatgagcgttgaagttgcttggttgctcattttttagtattgaaaaaaaatctaggccatgacaatacttaatattcggtattagtagtggaagtaatagatgtgctatgtggcattgtaatatactaatactagaagataatccgcgttgctgtgggacatagtgcataagacaaaacaaagtgaaattctatgggaacatttgatccattgcaattagacatagtgcataggaaaaacatttaagtgaaatttaaagaaaacatttcatcatcacatttaacatgcttcattggttgaatagatccaagtattttcgaacaaaccttaatatacttctcatttgattgaccatagaaaaatgaattttcttgactacaaattttgtaatccatcacatttaatatacttcattggttgaatatacccagttttttttcccaacagaacactcttatttgatcgactatagaaactgaatttttattgactataaattttagaaatagctacaggaacttaccttctgaggtgatcatgaaagttaagtaatatgtgataaaaaggaatgaaaaggtgtaaggagcactgttcattgtgctatggtataaattaaatacgggtcagttgtacaattattttcagctcgatatgtagagatggcattacattatttgattgaaataaataaaactgtagtaggaaataagctaatttatggtgtacaacctgaaaatttctagaaattaatcattctcaccgaagaaattaaatttctattctgaatcataacatatctgtaatatgaattaaagtagaaacgagtgaccaaaatttacatttggaattaggtgagagcatgtagcataaaatccatcggtaaataagtatatgatcttcatctaacaagaaagggagggggaaacgtgatattaaatattggctggcagagtgaagacgaacacctgatgcattaagctgagttctttgcgtgctaaacaatgtgtgtttttaaaagttttctatacgaaagttgctttaaaaaatcatattaatcttttttaaaaaaatatctaatatttaattaatcatacgctaataataagttgctccatcttacgtgcgtgaaagattagttctcaactcaggaaactgaacacagcctttaggggaaaaaaatgtgtacaaccaataatgaattcatccaaaagccacttgttttaacttggtaaaccaataaactcaacgtgggagagtgagggaaaagaataatgtacctgatccagcttaaggtttgttggggaacataaaaaatggtgcagaccaggaagacaggaaatgaattggctagtgcgtgagatgaaacaacgttgccggagtatggattagctgtggccgtttgcgcccaataatccctaataatatcagctaatccatctattttgttatcaaaagaacatattagccagtgtgccgcaacaattagttacatagaaaatgggaatgccggtagtcatttcctactaaaagattgaagctgcatcgaaaaaagccaccagagctgcagatagaagtcaccaatcctgataatcaccaagcacgatggataacaattatatacactcacaatacccgtgatgggtatagcacagggatttaaatgcgttatcacggtgcccataaggagaagttgaggcgtctgcggcgatttcctgattttccacgcacgaagaaaggcgaaggccactggcccactgagaagctgaacggtcggacgaggaatcgtcgtgaaggtaggggaatcgggctagggagattatcaagtaagattattttgcccgtttatcctacttctattttattttttctttctaattttcactgttatgcgaggaataaactagtaaataagtttttatgcgggtaatgggattgcccatttgcatcccctagtgcgcgggcgtgagcagtgctatgcgctcgaggaaaatgatcgattccccctatcctgtagaggatagcgaccacgaggggcaggatgggatgggatgagctattcaggctgtcacatgtggatgtgataatgtgggtcgtattttccctagtatgattcactccatcaaagttgcttcagcattggtacatcgcagcttcggcgttcgtacgataggagatatggaggacatttgatcaaaccgttgtgcataaaatggatgacatggcttaaccatagatcagaaagttgataatattactactctaagtgaagatcacttgtatagatttataggatgccagttagtactgaatttggaccggaggcctcacggcctagcttattatttatttgatcaatcaaattataaacttgctactactattcacctatttgtaagtagtaaccatgccatcacaattcattagaaatatgagatatgtcgttccctatactgtaaacgtcattggacacatgtatatgccactatatttttataacccaaaatgcccctatgtacatttatgtgggcctcatgtgtcataacctttatcaatcttcgagcgaggagtaaccttgctggcgatgtcatcggtctactccttagcatgtgactctcatagcttgtcgtacaccgttcgcagctggttttctttcatgattcagaggcgagtgagcaatcaaactgcgtcgcaacaaaagctggagaactgaaaaaaatgagggaaatcggcaaatggtagcgtgacataagaacatggggttagaaaagaagagccgccactgccaccgttggggacgactaccgccatcgagcgtccatcatgcgcttatcatcgacagtttcttctcgtttctgtctcgtacgtgcatgggtcgatgatgaccagatctgctcctatccctgaccaccacccagatctgtctcgtctctgttcttgccttcgctagccagatctaacgcactcaaaaatgataaaaagaaaaataaaaatagcatgataacgctagaaggagcatatggtgcatatgattagaagaatacactgcgttgaatgaacggcaataaacatctctactacttttaaaaaaaaaaggagagagagaatcgctcaatttctatccctctgtctttacttctctctccatctcccacttgcacgtaaaaatctctcaaaaaccaacaacctcaaaaaaaaaaaaaaaaaaccaactggccaaattccggttgcaacgcacgcatttccacagtgctttttattgggctctcctagcccggcccaagtgagcccaaatataaatcctctacccaaaaagactcctcgctccgaaaaacttcaggctagggccaagccggagcggagggatggcggcggcggcgaagccggaggcgggggagggggaggcgacgaattgccacaggagatcggcggcggggcaggaggaggaggaggaggagtcgaagaggccacgcgatggcaacgatgaggaggaagagctgctcaccgagctctcccgctaccgccgctactggacggatctttggtccgacgattccggcgacattgacagaagaagtgaggaagcattcttttttttttctttctcaattagccgctagctagcgttggggatttttttagatgattttatggtaaatacgtgccagacccttgtcgaattcgctcattccctggttaggttttaggtttcatatgaaaatctgaaatcaactggttggcgcgccgaattcgctcatgctcatgttaggtttttagttttcatctctaatcaacaggttcacgtgccgattaggattatggtagaaatggaaaaatgaaaataacatgttgggattggcattctttacatagatatctatcaatatgatctaatggctcatctctttgatatatctattctgatgcttgactgattgatgtggtttattggatggatgcagctgagattggtcccatgcggtacacggaggaatcgccccggttcgcaatgctcctggatttacttgaggttttttcttttgaggtgaccgagctgaaaggtattctacgctggccaatagatgtgtttggtctcatctccgttcgtgactctctggaccggaaccgcaactatatctttgagcgcaccaggaacaactgccagactctcactgcaaaggtacctctatgcttcatggaaataacagtgcatagtcatcagtaaacaacctgaaatattcaaatgtgcatggtttagaatcctgtgatggcttttctttttgaccaacagcaaaaaataaaacctgtgataacataatcaagcaattttccaaatctcaaactcccctacacatcagagcttaacatattttcatgatgcataaggggcatcacaaacatatgtgggttgctaacagaaataactacagaaacttttggtgcacaggtgcagaattgatactacaaaaataaaaggctaccaaatcaattgatagcacatgcagggatacttccccactcttattgaatttatagcaactactccctccgtttcacaatgtaagtcattctagcatttcccacattcatattgatgttaatgaatctagacatatatatgtgcctagattcattagcatctatataaatgtgggcaatgctagaatgacttacattgtgaaacggaggaagtagcattttcccccctatgaacttgcaggggctatctttagcaagggctatgttccttggtccttgcttcagcttgttgcgaaccattccagtaggatatttaacagacccctcatgagtatgtgaatggtaaaagtgagaatcaatcggtagtacaaatgtcctaactgcagcaagacgaatcatgcatggattcatctccttgcaatacagcttgagcctaagggaaaacattttgcaaatatttaggggtagtaacattttgcaaatatttaggggtagtaacattttgcagacatataatatttgttatctcatagccatcatctttggtttttatcataatagtcatcatgttttaatgggattattgaccattattcatgccaatccaagagtttaaggagatgtaatggcaatccacaattgacaatacaaagcaaaattctttgagatgttttagagtagagagtaaaaagggcagcatcaagagtacaatttgcccaacaattaactacattttgttgtgatactttgacatactatgaagattctatatgaaaagctcatgcaaaaaatgctaatgaataatggttgtgttaatactacagttctgcgataacagggtattattgatttgcaagtgctggtcattaaagattcaggcagtaaagatgaagttgtcaatacatatatcagatatttatcgtatactgtatacttatatgcatattttgctatacagtatcattttattgttgggcaaagggaaaatagaaaatccaagttcagttatgcatagcatgtcgtcagtctcacatatgttttcttttcctaattatgctcctgtttatattttgttttgacagttcaatgccccattcatattattgtgttgagtggaacttagaacacatatgtgatagaattatgcatgtttgttcaccatcaatctagctaatttcaccttatccaaaaaaaaaatggaaatatttgctgtgttacattgttgctaccattccttatatttagtaatgtcacgggtgtatgtaggattcatctctggttcttactggtccaagccgtgcaatcctattgatggaccctattgaatttgaaattgagctaagagtcaaggggacaagtccctccgaagataagatcttgagcgctgaagcatttgggtataatggcaccgctcagagacacagatgtggctcactccgcagtatgttgttatcaggagcacgcagcacattggagttcaagtatgctcacattcctgtggcattggaggctacaatcaaggtcaggattacaggaggtttaactgatttctgtggaaagttcattgcacatactgctagtatcaaggaagatgtcgtattgctggactctggagaagaaatggtggctatctcccatgatggagccattcatttctcccgcagtgtggttgcagttgaaggaaatggtgtgctgactgttggtgttcatgcaaggcagagtggtgatgagaataacagctgtgattacaagaattttatcccggtaagatgtggacggagtcatgacacacttgatgttggattttgccagatgagtgttgaagttgcttggtcgctcatgctttcatattgaaaaaacataggcccgataatattatattttgccaagtctaggccctgataattttgcttgctgtgacacaagctgtttgctcgatggcattgtaatatactgatatgacaatacttaatattcggtgttagtagttcatttttttagagaaggctatacggccctgctttttattgcgttcttatagaaagcaatatgtctttatacatagattcagagatgctggggccaccagcttgccagacacagcacaggaaactgactgtaaacacactaccaactacaggacgcataagcaagtgctataatagagaggagtattatctctaattctatccatataatctactactcataaataagaagcaatatatacaataggtcacctctaatacacaatacaaatactagtacttctaatactatcacacctagggcttgtttggtaaagctccaacttctaaatttagcttcaggaattgggtctggagtggagcagctccacctctctagttcattttttgagagtgtttcactcagctccactcccattttaggtggagatgaagtcatgaaactgtttagctgagcttagtttcaaaagaggtggagctagagctgtgccaaacagacccctattttgttacttctaatacacacatatcaatacttctaataatactctcacacacatatggaggttctcttagtacatgagaaggttgctcagctatatgacacttagggtcatccaatcctacgtgacactcatgtcaaaaaaaataaataaatcatacgtgacactcttaaaacagcacatcaagtattcctgtatatcatcactcaatcgtacgtgacactcgtgttaaaaagaaaatcgtatatgatgcttttaaggacagtacatcaattatagtagttgctcccaggctccaaactccagaatgccagcaaaagccaaaagcaaaactaaaccaccggtaacaccgatgttagcctattccagctcgcgagggacgaagaccgttgacagcatcttgtaatgccgccgccatggactccagagtagcaacgtcatcaggcttcagaaatgatttccactacaacagtaagccaatcaaacgaaaaaagaataattagaggtgaggaaaccatcttatccctgaagaccatgtcatgtctagttgaccaaagaattccaacataaagcagctaaaagaaggcatccaactctagattttttaagcctgttttccccagaaccaagcagaaaaagtcatcaaaatcatgaggaattctactctggccaagggcgtctctacaaatacaccaggcaaatctagcaacggggcatttgaaacaaactagaaataactgcgcgcttcgctgcacccgtccaatatcagaggagaaataaatttaacagcatataatttttttatatagcatgtatttggatcatttacatattagaaatgagcaaggagaaacagtaattgatgaaatagaattgtcttacaaatttcataaattaaacagtgcacatgataaatatcaccaaatgttaaagtgtcaacaaatagtgttggttctaatatgggagccaagagaggagtgagcagttgacagttagtgttgtgaccacaagatagaactgagaatcacacaacagagcatgttagtggagaattcttacaaaatgtggacattaagaataaaaaaactaagaaaaaaaacatatcctccggattagtcgttatctcacatatgaggctccccaactgttcatacttgcatttgtgttcatgagctcgtccatctacaaattgcaaaggctaaaggcatatagttgcaaaataagaaataatagatacattaggtgtggtatgaagtattactatttattttactgatatatacatatataaaaaggatgtggattatctccttcagtacaaaacatatatgaccaaatattatcaggcatttgcacatttctaagaatgtacctttaccatgctagacaacagtttgggcaagctgttgcctatatatatatgtatatgatacatatatgatatatccatcctgttatagcttataaggtaatggaaatgctaaacccaaatgttatggcttgtagccagcagtctgataaaagaagaactcatagcagtgtagcacagtaggactgagtgccctggtaagtgataacagcaagagtagactgttggcaagacatttatagattcatgtccctcatgacctcaattcagaaaatgaaaagaaaagctatctattgaaagaatgaagtcacctaactaagctttactttttgtatatctacaaatatcaccttttgccaatataattattacacattgggaaccattacatatacgcagcaccacgtgatattcataaagaatgaaattaacagtgaattttaaattagaacagagttgacttccatttggtaagtaaactatcctatatccaacaaaaagaatagtgtcccacattccatagatacatatttcataggagcataggatgatatatacttgcatatgtcttaaaatatgatggtctgcaatgttttttgtgagattcagatataatacaatccgactcaacacacctgtaatagcagtgccaaggctccttacatgctgctgaacctcacatagataaaaaatggcaaaagtgaacctagaaacaatggattgtcacatgtgacagcagtaattgtaaatcattaatgctctctaaaagtctaggcctgtagattgtaccgatcagatgagactttttcatgaaggcacctaaattgtagtgctaaaaatgctttttctttgggaatgtatttcaaaccacccacggacctaggcgctacctagctggctatcccaaaagctaaatgtaaaggttattcttcaattttagaaggcacactgaattatatgaactcaagcagtttgagttatttttggcatgccaaccctatagatgcctcagaggagatgatgatgcaagcataaacaacagatgtacacactacagctgacagaaaaaaaatgaggaggtactatgagatcataagaaagcctggatagtagatgatttacccatatttttcatagtgttggttttacagtgttaattaatgatcacaagtcgtgccccaaatttctccaggagggatggtttgattcctgggattcctgtacacgaagaaaccatgtagatcaaatatgtaatgctgtcatgctgtgctgatacgttaaaccaaacaatgcaacatttggtcttacctgctaacctcgacgaaagaaaataatgaggagcaatcagtgaaaatcttgccctgtcagctgtgactccttgttctttataagccagatgccttccatcaggaagttgaattgttttggcacttgggggacctatgtagagtttctttggcagctctactggggtatcatcaacactccctacacctaatactgcatacaaaatattcctgttaatcaagcgataaaaaattgatccctacattaagaaattgttttcttggatttcgcatttttcacaaatcaattgaagtacatagtgcattgacaaaatgattgtacaatgtgtagcatgtaaaagagggtaaaggagcacttctgggtagaaattctacatgctagcatgcatcaagttcgcatataagcaaccaagtgccataaaactcaaaaataagagggcaaaaagaatccacctggcaagcaatctgttggcaccaaaatagtaatatcaatacagcaaaaaaaaagcagctagcttgactcaatagtaaaacaattgactgaccaatgaccacaatattagactatggttgacctgtcatgaatttcaaactgcccgtaggccatgcattgtaccccatggccatgaaggcatgaacacaagcgcacaaggcatggatcccacaatccaaaaaaaaatctccttgaaataattacacgctttaaccaatatatatctagagtagcgttcacaacagaaacgcagcataaagagacagattgattctaaatccaaacaaaatttcaggggaaaaaaagagcaccaaacggttagttagatccatcccctctaatgactgaacactaaacgtgcacgctcatatcatacatcgtgatgcacgacggcataaaccaaactgcatgctgagctgtagtcagagcctcactcgcacgcaaggaagagaagatcgggggagggggggtgagagatcagcgggggattaccgatgagcgtgacgaacgcgacggcggcggtgatgacccagcacctgacggggttgcagtcctcggcgaggtacgcgttcatgaagctgaggcgcttccccatggccacggcggggcccctgagccgccgcgcgagctcgctgtcctcggcgccggcgaggctctgagcggtcggatccaccggggggagaccaaacgccggatcgacggcctgccagtggatttggcactacaccaagcagggtggagaagatggtggtggtggctcacgacccttttgtccgggcagccggaatcgcctgcggagaggaggtggtcaccggattcgatgcccctggtctcctcgctggtagatgaagtgacctgactggggagagagtcgggggcggtgcagcggcggcgagaggagggcgaggaggcgacgcgcatgagagaggagagcgaggcggcgcgggcgagagaagagaaccgagcggccgagccgcgcgaggtcgcgggcaggagactgaggtggctagggttcttggcaaatccaggccgtctgttcctaatccaacgatctcacgatggtggaagagcagccacgctgggacacgtggacggccagatcgtccctcgcgcgtgatcgaacggacctcaatagcctgaaccggaatgcaattaaccaaagatgaggggtatttctgaaaatattgatgaggtggcgccctaatcctcacccattcccacggcgtttaagtaaagtaatatgtggacagtatcctcatacacaccacataggcacattctggcaaaactctgatccacccaatagcactttctcagctgagcagaagattgtatctttcctcttacagcagccagccagagaaaatattttgtttttgcttaggagggataggacaactccaaatatcatgcatcctcacatcatttacccccttaaagggttagcatcctgtagattgattgagatgagtacacccccttcttgtctaaagacccccacactatcttttctctctcatcacacagtaatattgtcagccgaatgagagctaatgcagaacttgtaatgctgaactccctaccacatattctccaaacattgaatacacaacagactcaaatcaatttatcaaagatgaataattaaaatgataagctatatgattgtcaaaggcaggataaagaaaattcaagttactcttatcgatctgcaatcagagccataacctgcaaatacttgcacctttatccatataccagcagctaattccagttgcttttgcagctccaagggctcagatggtctgatgacaggactgcccaatagatcagcctgtaggtgggctgcatataataatatacgttgtcagcaaactctttatttgtgtccctgagatactggaagagatactagcaattggaaggctaggattgcaagtattctcttttacaaattgctaggaaggagaagaattcttttacctgaatctgcatcagaagattatggactgtgtatcgccaccgaacacgcacgtaatcagaatttcacttgtcatgcctagagatggtaacgggtgcatacccatcaggttttcttaccccatatccacaccctcaatgcacctgtcgcgggtacaaaccatccccatacccacacccgtgcgggtaatgggtactcatacctatataattgacctgtaacatttataattttgtactctaattagccatattagatctgtaaaccatcaatatttttcctaacaacaatgctattaacattagcgttcaaaggcgagtaaaaaaactttacaatcacattacataatcaagaaatcaaataataatttcatataactagactagaacaatgcttaagatgcgaaataagttttatgctatgatttaatagtcgttgagacttatattactcatagttttatgcttaatttacgggtttttcaaccaagggttgatgggtacgggtgggtaaagaatggacctatacccacatactcaatgggtaagagttctcgtccgttagtagacccataaataaagagttagaacatgattagcttctaataaaataaaagctcatagggtgtcgggtcataggtcccattaccatctctagtcatgcctccccgtcatcgtcgttgcagctccattggccattcgccggcttgatgccccgatgaggaatctgctggaatgagaatggaaagaggagaagaccgtacttgttgcggggaagacgagatgcccgtttagaactcctccaatacccataaaacggagcaaatccattttcacatgattaattaaatattaactaaattaaagttaaaaattaaattaatatattattttaaattagtagaaaaggtttttataaaaaaatacatcttttaatagtttgggaagttttatatgtgaaaaatgagggagtagaaattaaaaagagttggtaaagaacacactcatactactacacagctagccgtgcaatggacaaacgagacgccaagcaactgcttaaccaatcgacgaaatacatattaatttctactcccaaaaaacaaatggatgaaattgaaccgatataaacagccgatataggtaaagagcatctccaagagaatcttgtccctaaaagttaaattttaagaattaagggtaaaatcaaccctccaacaggtttccaaatgaggccccccaatatttaggtacatctaaaatccaaccaaatagtagctagttttggacacctccacgcactcgagaaaaatcagtttagtagggccaaccagtgatgacatgacagattttaaagtttttttaatcaagtattggatattcttagagatggagatgatttttgagcccgatatcttttggatactcccaactaggggtgtaagtggctaacccgcgaaacccacttataggctaaaataagccgtgagcccgcttattttgacttataagtgggttcgcggctgacccacttacacccctactcccaacacaagttttttaggagcctaaacaactctttgagatgctcttaacgacagcatcactcatacgatttgcttagtacgtgggttgcaacttgcgtctttcatcatctttaagagcaactacttagtcataatgcaataaaagcttttgattttagcttaattattccctatgtttcatattataaggccattcccaacccaatgactaggatgatgtccattgtattaaataagtttccacctaggatgaaaaatgatgtggcaaatgaataaatgaggaaagtgaaggaaaccatatcttgcatgagacatagtttctacgtaacatcccagacatcaagtgagataagtagcattaaattaaagtatggaatagtgatgtttgcagtggaagagtagtgtctagtactagtttcttgatgatgtagagtttatggaaactatctctggtaatggcctaagtcgctttgatatttttttctagttaaatttttttagttttaaccaaattgatagaaaatctaacaacatatataactccaaattagttttattaaataaaatattaaatatatttttaataatatgtttattttgggttagaaatgttactatattttttataaatttattcaaacttaaaatataagaaatatcaaaacaacttataatatgaaacaacgaaagtacctacttaggacgacttacaacatggccaacaatatctataagtgaaacccaattctaaaattaggattttctttttgtaaagaacttgctccaatactctctccggactgataatacttatcgttttggataaggatgaggtcaaattttaaaatctttggttatgaataatttataaaaatatttgtctttgaaatatggtgattatatgtatagattaatcttaaaaaatacttcaataaaatcatatatttgttaacatttatatacatattatactaaaaaataataaataatgatcaaagttgttttttaagatcatgcccttgttcaaaacgataagtattatcaactcggagggagtagttctctagagatgtatccaaaaattgaaatttccttcccatcctttctcgctctccataagtcgggagacgctcttgctcccaatgttcgcacggcaaaaaagagagggcgacacatgggaagggggatggaccgagcgttttttttatatcgggttcattttttatttttgaagttaatttgagatatctcttagagatctgtttgcaccttaaaatcaattaggaatttgagaatagaattttagaaatagctttttagatatttgttgggcatgctcttatgacgactaattacctaatttctttttttagcttttgagggatatagctgaaatcagaattaagaattttatgaggataggcagccccaggacaggatccgattggacggctgagcatattagcaacttttggaagttcatttgccccaagcctatagtgaaaatctcaaatttattatactagttgattttcatgtcaaatttgtcctcataaatttagtaaccacaatctcatcatccacaaatggtgtaaaaacaacagtgcgtcaccaacgcattgtaaatgacaaagaccataaggaaacaaatgtggaaccaaaatatttttagtattatcaaaaatctttgtcaaagtgaaaagtaaatatcataaagaaaccaggatatgccatgtcatctgacaaatattaaccatcggatacacttaaagacaaaataagtcgaataccgtaggatgaaacttaagtatagtcgtaaaaaatgtaggaatgttctagagtaccctgtagaacctcccctaactcttggcacagctgcaagcccaagctccatcctcttttctccatgcctgaggcaagtttagaataaaaacaaaataaactcctttactaacaaaatgtgaaacttatagttagataactttcaaattgaaatgcatttcctcggcccacatcagcggtgtcggtgcttcgattcatggccaccacttacacctccattactatctcaatttgttcataaattcaatttataaccatgaataaatatagtgaaatcaaatccatatgaagtgaaaacactacatatataaaaagtgattctcgatatatctttgcatagccgtagagtaacccaatgaacatactgaataacgtgttttctatggaatttatgtcaatagagttacaataaatcctacattcacaattaaacaatatagcaggtctaaaattatcagatgtgtcggtcatagaaacgatcctgaataaataagataaaaaaaatctaccacctacagaaatatccataactaacgaatagaaaaatcaacctaattgctcggacttgaaccaaatactctccaaagttcaatccttaacataattgaataatagaattcagatatagaactagaccaattaaattttaactaatatgaaaatagaagatagaaggagaaagagagtctcctgtcttaattcttaaatctctataggttcttaaaagatcagatttataaccattaattttaatccagaatcttccgtcttcacccttcaatgcaaagccttgatacaactgacccataaggccataactgtcgaaagccttccttagaatgcacttgattattcaatagatgtacacagaaataaaaacgtacaaaacccggcctctacatgcaatacaagtacaaaagtgtttagacccaaactcgttataaaaggtttcaacaaagcattgaaagacaacaaccaagcaaaagacaaatacaagaccacttccaatccctttctacagttccgcccaaactttgccgcactcctccaatttgtggtcaccctcttttttatgcaacaaagaccaccaacacgtccttgaagattacctgcaaattattggaattaatttgggagccattctaaatttctaataataagttacttacctcgtggatttgtctaaaaacgtgaaagcttcccggcgcctctccctcctgaaaacaccccttcatggggttcatcacgattcacgaatgattactacctacaccaaaggtagcaatttgtggattcactttggatcatcatcttgatcttgttggcaaaaactcaggatcaaactacacacgaatccctggaaatcgacaatgcttgacgatgaacagtggaagagaagaacacacgcgagaagttttttgtgccgctaaacttacgcagcttttctgtatatttcatctccttttatggaaagcgaaaacgagatcatgcaatcgtgtagatcgtgtctccggctctgtgcactcccacttcctccatttgcgcatgtgccatcccacacggcggagaacgtgagcgtacgactcgctacactacgcctaatcgtgaacttgcacgaatccggctttacaggacgtgactcgaactgtaacaaccaagccacaaaaaacggaaataaaacagactctaacaaacaccttgcatgcatcgaacagtgcacggtgtgagaaggaaaaagcagagctcctaaaacagagctccatagtgccagcttatatcatcaagtctaacattctccccctaagcctggcaccgtgaactgacctcgacgacgctgatgcgagctcgcaattcttgaaaacgaacccgcccgagtgccttggtcaggatgtctgcaatctgcccatcaatgccaatgaactcaacctgagctctcccgtcctccacgcactcacggatgaagtggtagcgcgtggcgatgtgtttactcctgtcatgaaacactggatttttgctgagggcgatcgccgatttattgtcgacgaggagcttgaagctttctggctcctcttgcttgatttctcccagcagctgcgccagccaaattccctaacacgccgccgtcgtcgccgctatgtactccgcctcacaagatgagagcgcgacaaccttttgcttgatggactgccaactgaccgggttggcgcccaggaagaagacgaccccgctggtgcttttgcgagtgtcgacatcacccgccatgtctgcatcacagtatccgacgagctcaggtggcgtttccatccttttgtagtagcagccgaaatcaaccgtgccggcaacataacgcaagatgcgtttcaccgccgcgtcatgctcggtggttggagcttccatgaagtggctcacgtacccaacagagaacgcgaggtccggccgcgtgtgaaccagataccacaggcagccgacgatgctgcggtactgggtggcatccaccggcgccgccgtgcttgccttggtcaacttgagacgaggctccatcggcgtcaagcaggaattacatccctgcatcccggctcgctcaagtatgcgttgtgcatacgatttctgcgatagtcgaatgccgtccgccacctgttcgacctcgatccccaagtagaacgagaggggaccaagatcactcatcttgaatagggacatcatctcagctttgaaacggtcgatctccatcgccacgttgccggtgatgatcaagtcgtcgacgtacacgccaacgagcagtcggctgtcgccactgccccgcccgtagaccgcgtgctcgcagtcattgcgccggaaccccagcgacagcaggctcgcgtccagcttcgcgttccacacgcgtggagcctgccgaagaccatacaaggccttgtccaggcgaagcacttgatgttcgcgtccgtccacaatgaacccaggaggttgcttgacgtagacctcctcggtgagctccccgttgaggaacgccgacttgacgtccatgtggtggacaggccagcctacttgcgccgcccgcgcgagtagcattctcaccgactccagccgtgccactggagcaaacacctcgttgaagtccacccctggctgttgcatgtatcccttcgccacaagacgagccttgtgcttggtgatcatgccacgcgcgtccttcttgatcttgtagacccatttgagtccgatggcgcgatgaccgggtggcaagtcgacaaggcgccaggtcttgttgtcctcgatggaggaaatctcctgcagcatggcacgccgccactcttggtgatgctcggcctcgccgaaggtggtaggttcctccgccgccagcaagtaaagctcgccgtccgccaggtcccttgttgctagacccggcgtgtacgctcccccagaatcccatcgatggagcggtaccggggcggacagtcgtcggcgtcggcgtcgaggttgtcgtcgccgtcctgcggcgggctgacgaatctcggtgacctcgcattgagcagtgaggccgtcagtgacggcgcgtcgtgcgcaaccgcgccatgtctcggtgtggccagcgtcggcgtggacaactccgcacgttccggctcctgagtgacaatgtattcaacagagaagtcagacgagggaggggaatgcataccatcagtggcatcccaatcccagctggcgccctcgtcgaacaccacgtcgcgcgtcacttgaacacgacccgacttcgggtcgaacaacttgtaggctttggatccctcaacgtagcgaggaagaccgtgggcttgttgcggtcctggagcttggtgacatgcggccgaacatccttgacgtacgcgagacacccgaacgtgcgcaggtgcccaacggccggcttccgcccaaaccaagcttcatacggagtcttgttgtccaagcatttggtcggcgcgcgattgagcaagaacacagccgtagtgactgcctccccccagtagcacgccggcactgacttggccttgagaagactctgcgccatccccagaatcgtctggttgcggcgctcgaccaccctgttttgctggggggaatacggcgcggtgagctgtcgcttgacgccgctctcggcgcaatgcgcggcgaactcggcggaggtgaactcgcccccattgtcggtgcgaaggagcttgagacggcagccagactcagcttcgctgcgggcttggaagcgtttgatcgccactgccgcctccctcttgttctgaagcagtgcgagccacatgtagcggctcgcgtcatcgaccaacagcagaaagtgtttcttgccgccgggcgtcgcaggcgaaatgggaccacagaggtcaccatggaccagctccaaacgatcctccgcgcagaacagggaccgccagggaaacggtgaacgtcgttgcttggtgatgacgcagcagtcacacagttgctcaacttgatcaatttggggaagaccacgaaccatgtcctgtcgagcgagtcgccggagcgcgtcgaagtagaggtggccgaagcgagcatgccacagccacgcggcctcctgcgtgcgtgctgagaggcacataggccgagcgacggtgatcttgatcaggtacagctgattgcgcgtacgctgcacgcgagcgaggagctgtcgcgcggtgtcgcggatcgtgcagacgccatgaaagatgcggacgttgcagccattttcatccagctgcccgagactgacgaggttcgcgttgagcttggggatgtagtacacccctgtgagtgcgcggtgttcaccgttcctgcactcgaagataattttaccttggccttcaatggcgaccacggagccgttgccgaaacggactttgccgcgcacagcagtgtcgagctcggcgaagatatcacgcacgccgggcatgtgattggtaccaccggtgtcaaggtgccacacaccggtgtcaacgtgttcctggcgatgcaggggagcgaacaccttgggttcatcaaggtcgagcaaccccgctggaggcggggacggcgacggaggtggcgccaactcaatggcatgagccatcagcaacgctggctcatcatcctcctcttcaccatgggcgatgtgcgccgcgacttgtttcttgggctgacgacagtctttcgcctagtgaccgagacagccacagttcttgcacttatcacgcccttgatcgtgcgtgtcgcgcgcgccacgctcgccatccgcagcggccttggatttcttccggccaccgcggcggcgacggttgttgcccgccttcttgcccaacgatccctcaccggactgccgttccttggcgcgagcagcccactgttcttcaatgagatacagtttgccgccctcatcaccggacttcttcttgggacggcgttcctccgcatttctcagacgagtctcgatggacaaagcaatctgctcaagatgatcaggaacaacatgaagaaacttttcacagacctttgattcctcgagctggaacccgagtacggcaaggttgttgacgagcccactcagccggacggagaactccacggactcgccttccttgaactcattcgcgtcgaactgcttgcgcaactcctgcgctttggacttgcggacgcggtcgacgccgacgcgcatcgtcttgatggcatcccaggcgtctttcgccgtctccttgacagcgagtaccggcagcagatcagcggggaccgccttgaggacggcctccaacgccatcctatcctcctggaagtcgacgtcacccgtctcgacagcttcccagaggccgcgcgcctggagcattaccctcatcaagagggaccagtcgctgtagttcgtcttcgtgaggatcggatagttggctgagccccccacctccttgaccacgcgcctaagcggaaccatgtcccaggcgtcgccaggcctacggcgaccacggcgcggaggaggcgagcgggattgacgacgcggcgaacgcgaaacgcgcggcgtcggagccgacatggctctgataccagatgttggcaaaaactcaggatcaaactacacacgaatccctagaaatcgacaatgcttgacgatgaacagtggaagagaagaacacacgcgagaagttttttgtgccgctaaacttacgcagcttttctgtatatttcatctccttttatggaaagcgaaaacgagatcatgcgatcgtgtagatcgtgtctccggctctgtgcactcccacttcctccatttgcgcatgtgccatcccacacggcggagaacgtgagcgtacgactcgctacactacgcctaatcgtgaacttgcacgaatccggctttacaggacgcgactcgaactgtaacaaccaagccaaaaaaacggaaataaaacagactctaacaaacaccttgcatgcatcgaacagtgtacggtgtgagaaggaagaagcagagctcctgaaacagagctccatagtaccagcttatatcatcaagtctaacagatctctgtgtttggaaccagcctgattggaggggagcaaggcgtgcagaacgatctccctaagcccgcccagaatgcaatgcgaccaacttgtttcttgttttgcatagagtgctgcatccgaaaggtcagacctcatattgatattgtgattgttcatcagtagaccaagacaccaaacttttttctcctattctggatcggcatcgtggtatcattgcaaagagaaaaggatgtgttgcaagctttttcactggaaaatgaaaaatccgaccttgcaagaaattgagaatccgaaactagattcatacacgtgtgcctcaaatgtgctggccattaattgttacgccaaaagtatgtagaactgcattcctacactcctgtctgttcagaacgaaagttgactggcacattcaggatcgctcgtccaaatccaaaaccacagcaatacacatcattctt

SEQ ID NO: 64345 - DNA, 6352 bp, Oryza sativa
aatatattttgatacaaatgtttgttctgtattgaaaatactattatattttgctataagctaggtcaaacttaaggaaatttaactaaaaaaagtcaaacgacttataatatgaaacggagggagtatttgaactagaagtttcctatgcagtacggtaatgcttaaacataataaattaacaatgtgcactaatgagatactctcttattcatgaaatatctccgctcgtgctcgcatgcattcccgccgtgctcaccggcctccctatctccttcctttccgccgctaagctcgtcgtcgcactggtcgccacctttcctcctctccagccgtcgccgttgagccgaccgcctctctccccctccccgccgcggcgccatttggcagcaaaccaccagccctctgccactccgcccgccgcccgtgaccgccttccgcccgttgtcgcgctcgcccgtcgccgctctaccgctgccccctacctgcttcgccttccgctcgcttccgacgaaggggcggagcacgaagaggacggggttgctctgcccgcccgccgccgcttcgctgccgcgcgggcccgccacccacccatcgccgctccgcccgctggcctcccttactgaagaagagaagagaagagagaaaatagaagagaagaagaagaaaagagataaaaaaatgtgcagctgacatgtgggccccacatactttttttaaatttttttgctgactaggatgccacgtcagcgaaaccacccatatatactgccatgagatcttaagtgcatggtttgtgtgagtttagatgtacatatttctgattttgtggttaagtaacctcgaaaaatttcgctgttaagttgaggaacgtccggtgaacttattcccaaaaaaattcctcgttctgagaaacttcaaggcgggatggcggcggcggtggggcaagaggaggatttgatgaggccacgtgatggcagcgaggaggaagagctgctcaacgagctctcccactatcgccgctactggacgaatctgtggtccgacgattccggcgacatcgccaaaagaagtgaggaagcttcttttttcttgttttagagatgattttatggtaaatacgaattcgctcatcctcttgttaggtttttagttttcatctcaaatcgacatgttcactcgctgattatggtaggcgggagcctgggcgcacaatagtgaggatggaaacatgaaaatggaaaatgttgggattgacatttttcacatggatatgcatcaatgtgatctaatggctcgtctctttggtgtgttgcaaaggaaaaagaaacaataatgcttgactgattgatatggtttattggatggatgcaactgagattggtcccatgcggtacacggaggaaccgccctggttcgcaatgctcctagatttactagaggttttttcttttgaggtgacggagcttaaaggtattctacgctggccaatagatgtgtttggtctcatccccgttcgtgactctctggaccggaaccacaactatatctttgagcgcaccaggaacaactgccagactctcactgcaaaggtatctccatgcttcatggaaatagcagcacaaagtcatcagacttttatacaggcagctagttagtttacaacttcacatttgtggtgcactagtgcagtagctcttctttacctaattaaaactagtaatatacccgtgctaacgctacggtgcaattatataataacactaataaaaaaacaatatcagcttagtctctcttatgcttgaaagctaaaattaaaatttcaaaacttaattttgaagttgaatttgtttgtattttgtcgtagtttattttacagaatgccctttttaatcgctaaagacacacatataaaaagttttttttttgttttctgttgctaatccacgagatagattaaagattaatataaagaaaaagagagaaaagataaaattatttagcactaaaatatcaccacattcttcgtaacccatctaattccagattacttcatattctagtatcatggaaatgtaatgcatattttcctgtactcgtacgaaatatgcaaacacgctcaaatctaacttgtcaaagcttggaaggctcaatccaagagagctatgattttcaattagtcacaggaactccagtatccaactttgtttaaaaaaaaacagtatacagtatctgcacaatagcttcatgccaaccaatgtaacttcaaaatgcagccctctcaatccaacaccagtatctagtactacacaatagcttcatgctgactgcagttacttcaaacgtgaccctctcattctgcaatccacaatgacttgatcttttgagctgcatttcaaaaccaaaattaaccaaaaggatcttaacacctgaagaaaaaaaactgcagaagcgaggatcacccaacaacattctcagctactttccagtctttgaacgtgcatccctagttttccagctttgtgtgttttatccgataacaataaattgatatagcaagaccagccacgctatcaatcacctttagaaaaatgatctatagaaaaaatatatttatgtactgtgtacctccatatcaggagaatctttgattggatttaaaagaattagcaagttttatgtacagggggttcagatgtaaacatcttacaaattaaatataattttcgatgcagccagttgcacaaatactgctaggaattaatgacattcaagtgaatcacatattttagggaacaaaggtgcaaagcaatcgcagaatttcagtataataatcttcaacataagatattatcctccaaagatcagatcttataggtgatttatttcaccgtcttcagaaaatacctaatacatacaaagccatacgtgaactaaactgtgaagaaacactcagcagtgacggtgagcagcggctcgcccagcagctcagatattcaaatttatccaatggaaaatcacatcattttttcagtatttgtagccaaacctaaatataggaaatagcatcctcaatctgctaaggggaaaatcagcacgaaatgactcaacactgaatgaacatgcgcttgaatttcttttagaattattcgtgtacataagttgaatatgaaaaatacatcgaagctactgttaccatgtgcctgcttcacttccaaaacttccaataagctgacacatgggctgtacaataacgtggaatatattactccccatcatgtaagtagagagcttgaaaattctcttcttgactcaaccaaacatattggctgaaaataatgtgaatcaaattcaccatactgagtgctactaaacaaagtagcaatactggtgttggtgcatgatttaaaagagaaaaatgctgttaataaatgatttctactgatattacaagtcacagggaattgaggtggcattgtataacgagtaattcatgattaacagcaacttaccggggatggctgcaggcacgcgatgcgaaggcttcgcctggctgcacaagatctcgtgcgaagctgcgctgccagggcgctcgaccagccggggctttcctcgctgctacgccggctaagccaccggcctccctcgccggttcgttggctcgtcgctgacaatgcgggtcagtggttctagggtttggggtgggaggttgaggggtctgtgggggtggaggacgctgaggtttggggatagggttcgggcgcggggcggggggagtacatggcggcgttgagggagtggggaaaagaatagatcagccgattaggcggaggggtcacgacatcatcattgtggggaggggcgcgacaattgggtgcgaccgagacttaggggaagagcgtcatgaatgaaatcggcgaggggcagggaatccgatccggcgatggagtgggagggagggggagctagcgatgcgagacgacgggggcgatgtctggtgtgcggcgatgcgaggcgacgatggcggcgtctggtgtgcgagagagattagaggagggggagcgtgcgggtccaaggtgcgcagagggccgcctcttgcgatgcgcaaggcaggtggcgattacggcactgggtcaggggcggcgtgagagatgcacggaagagggcggcaatccaaaccgtttgatcagatgtagatgaatacagagcgttagatttgatgaatgaagtatgaaaggatgtaagaggtacttggtgaattatagggtagaagaatagcagcgcaatcatgagatgtctggcgcagttctattgagaaaattcgttgtgtctgaactctgaactagttgtacctttggtgcatcatttagtttacttaaacaaattagaacagttcaaacttatatgcacatcatggttccatttcacaaattatataggatagtctgatactagttgtatcacagaagcttatcagtaaacgacctgaaagattcaaatgtgcttgatttagtatcctgtgatggcatttcttttttacgaacggcaaaaataaaacctgtgataacataatcaagcaattttacaatctcaaacacccatacacaccagagattaccatattttcatgatacataaggggcatcacaaacatgtgggttgttaacagaaataactacagaaacatttggtgcacaggcgcagaattgatactacaaaaataaaatgctaccaaatcaattgatagaacatgcaggggtacttccccactcttatttaattcattgcagctagcattttccctatatgaacttgcagaggctatcttttctagcaagagatatgctccttggtccttgcttcagcttgtctgcaataactgtattcttgtccaaccattccagtaaagttgaagttgtcaatatatatatcagatatttatcgtacatcatatactgatgtgcatattttgctatgcgggatcattttattcttgagcaaagtgaaaatagaaaatccaagttcagttatgcatagtatgtcgtcaggctcacatatgctatcttttcctaattatgctcttgtttatattttgttttgacagttcaaatgccccattcatattattttgttgagtggaacttagaacacatacgtgatagaattatgcatgtttgttcaccatcaatctagctagtttcaccttatccaaaaaaaagggaaatatttgttgtgttacattgttgctaccattcctttctaattgttttcatacagagttcttaagtggtggatagtgtatcatcaatattcttatactctctacatcgatcccataatataaggcacggtcaaacttggcacgatctccaaaactgatcttcggattatattctcatatactataaggtttatagcaaaaaaaaattataatcatatgaaagtagattcaaatgtcaatctaatgataatattttcagaaaataaaattcaattcataccatagtaattattgattaaatgttttaaaagttgaatcttaaaatacgtgcacaccttatattatgggatggaggaagtatttagtaatgtcatggatgcgtgtagggttcatctctggttctcacaggtccaagccgtgcaatcctattgatggaccctactgaatttgaaattgagctaagagtcaaggggacaagtccctccgaagataagatcttgagcgctgaagcatttgggtataatggaactgctcagagacatagatgtggctcactgcgcagtatgatgttatcaggagcacgcagcacattggagttcaattatgcacacattcctgtggcattggaggctacaatcagtgtcaggattacaggaggtttaactggtttctgtggaaagttcattgcacatactgctagtatcaaggaagatgtcatattgctggactctggggaagaaatggtggctatctcccatgatggagccattgatttctgccgcagtgtagttgcattggaaggaaatggcggagttctgactgttagtgttcatgcaaggcagagtggtgatgagaatatcatatgtgcttataaacattttatcccggtaagatgtggacggaatcatgacacacttgatgttgggttttgccagatgagcgttgaagttgcttggttgctcattttttagtattgaaaaaaaatctaggccatgacaatacttaatattcggtattagtagtggaagtaatagatgtgctatgtggcattgtaatatactaatactagaagataatccgcgttgctgtgggacatagtgcataagacaaaacaaagtgaaattctatggg

SEQ ID NO: 64346 - DNA, 2055 bp, Oryza sativa
tcagctatcagacgtcctatcaatgttgctgctgagaaggatcggttaaggaatgagttggatatggccattgccagaagggatgaagctgaagcagaaaggatccgttcaaagctcaatcagctgcagaagatgtcgaagccaatatcaaataatgagaaggctgccaagttggaggcgatgaacaagaagaaccgtgctgagaacttcaagaacgcatcagaaatgaagcccgttaacacgagtttgaaggttggagaggctggttatgatcccttttcaaggagatggacaagatcaagaaattactacgcagcaaagcctgaaggagagagcgctgaagtccccaacgggaacgatggcagcgcagtagctggcgatgaagatacgaagaacgggccgcgaggtggttcagcagccactgcagcggctctagtggcagctgctgatgccggtaagctggttgataccaatgcacctgtagatctgggaacggaatcgaatttgctgcataattttgagctcggtatatcattggccggcctggaagaattcggcggtcccaagggtctcttcgatggttacatggcgaggaagcagaagattgaagcaaccatgggttacaaggtccctgacaatgatggaaggaggcatgctctaactctgaccgtcagtgactacaaaagaagacggggtttactctgaacttctcaagttatctgtgcctctgcctgctgttcgatggattcatctgcctctttggccacaaagttcatcagctgatcggcaccatgccattgtgactacttgtccagatcaatttgcattttagccttgagtgtatgtaacatgatgagacaagcaaggttacacattttcttttcataaacaggacctgtatgcctgaattgtgttgatgacaatttccgcattaatatttgtggagtgagtccttctgttatttagtttgttacccttgttgctctgcataaaacatttatgcagcggatattgggagactagactaagaggtacaaatattctatgttgtatacttatatgccaaaaggaaaaaaaaaacatgtgtcaagttatgaaagttcctaatgttccttaattagttcggtctaaatcattatatcaatgttgattatcagattcttatttctatactacaaaatgtaaaaaagaatagcaatggccgtgatactatagcaaaatttctactggaagaaggcaaagcttgtgttgaataataaaatcttgtgtaagataaagctgagcatctgctgcattgcatctcaggaagcttcataggctggtctactcacgaaaggcatacacaaaaaaggcttaattaaaccttcagtacaaaaagctaataaagaacaacgcatatttgtctaggcactccaaattagacacaaaagcttggtaaatgtacacagcaggtcagattatttatgcttttcagtgcaagattcaagatccatgagaagccttattcatctcagactgagctggttctctgaatacatccttgtttgcaattattacagacatggaagcctcaaggtcaacagattacacaaacgtcagtatgttgaactggcactaatcgttcttcgctttgatgaacttcttgatgatgcccatcatctcacttccagggaaacgtccaaggcagccccttgcagcggcaatctcgttgaattcaaagacagaatcgccactgaaagctttgcgctgatcagacttgcgatcagctacatctatgttttctgccacatcttctccagatttaactgaaggaagcaggaaatcgtccagggggaagttgataacattgtcctcccccatagctcctacgaaatctctaagtcggcacaacacaaaaggaacgggttcaaaactgtggtcaccgtactcaactggagtagagtggtctccggtgacacaaaggaaatactggtatttcccagacttttcagcttcccacaggagccttgcaagctgaacgatagcccgatcaacagcctctaggcctagtacctt

SEQ ID NO: 64347 - DNA, 1903 bp, Oryza sativa
atattcaacaaaaaattaccacaagagtcaaaaactttacttccagttttcttaaagtgaacctcaaaattttcatcaacaatttgtgaaaccaaaagcaaattgtactttaagtcctcaaccaaagctacattcttcaattcaaaattttcatttaccttaaccaaacctgtagcgagaacggcacttgtagaagcatcaccaaagataatcgattcagtcttggatgccttcttagagggaggagaaccaatttttatcaccggccatgtgccgcgaacaaccggaatccacgatccacatgttctccttccttgccaccaaagcctatacataagcagaagtcgaagcctcagtactggagttagatgataataaaaacttaggaatccagtactgagacacacgaccagaagatccaataggcatatatccacgtgcaaaatcaatttgagaattttcagaaaaatttctccgaggccggtctgaccgaggtacagtggccggtctgaccggtgtccggtctgaccgaggctctgcagctgtaacatactgaaaatttgctattttctaaatatgcatcatgctgattcttatgtttttaataacttcctaaacctaagaaattacaattagagggacctcctaaaactaacatgcataaaatccatgtctagtattaaaatctttcgtgcttttattctaaaattgatctttttagatcgaggtattctctttgatttgattttgcattttaaagcttctttcgaccaaaatttccttaattcaaatttagtttgaaaatcctttttacttttgtgaaatatggtccaagaaatcctccaacactacctttgaacctaaatcgaagcaattccaatcttattggaattaattgtcaacccatcctttgatttcaaacctattcttattaccaaatattcaagttcctccttttgatctagccaccaatttaatccctatggcttgatttcctatccagcacaagattaacaatattttaatgattgctcttgtgcttagaaaattccaatttattttcctcatccaaaattcaaattccctcaaacttcacctttaaagatgttgcactcaaataaaccagaaaatatctcttctggaaattatatccaaatataatttcctttcaaaccttcctattcaaatattctccaaattgaaatcccttgtaaaacttagccatccaaaattcctttgaatcaaattattcaaacctatatgaaaattagattccttccttttgtttttgggccgaattctccttctttcttactcggcccaggccggcccagttagctgagccaactcgtctctccctgtgggcgccgccaccaccgagcaccgtggccgcgtgtggcgcgcgtgtacgcgccgccgccgccgcccacagcgctttgctgccgccgtcgtcttgccttcaccgctaagcatcagccgctgacgtcagccgccacctcacatcgctgacgccagccactgcaccaaaccgacatgatcgaccaatcagagttagagccggcgtcgagttcttcttctccacccaaccggcgtcgtgctctccttctcttcctcctctccgaaaccgcctctaaccaccgcctttcctcgcctatatatagccgaagaggccccgtttccttccccatagcagagctcctcgagttctcttctctctctctccggccatgtccggccattgccgccaccactcgatctccctcaccggtgcattacggaccaaaccctcgcgccaccgtgcttgcctcgacgaggtgaacccatttttctagtttcccctttcccttagtaatcctataagccactatagccacttcttttatcgccggagcaaagcttttgt

SEQ ID NO: 64348 - DNA, 4545 bp, Oryza sativa
gactgtcgcatgtttttgttgggctgtatcagtcgtttttttggtcccttggattttgtttgagattcgtgctatctagacttttgttttcttttgtatgtgggcttttgattattgtaagttcgggcttccatacgtgggctaaatgggcttcttttttttttacatttttgtgggacccactttgtgttgccgatagagaaatttttttgtgagagtgttaatggtgggacccacatacactattcaaattttgaaatccgcaccggagagagagattgtctgaatcagactagagagagagtgtgagagattcattttgctttttgcctttttcctcgtcgtctcgtccggcgatttcggcggagatttcgtcggcgactccgggaggcgacgacgctgcgtaagctacgccgcggcgtggattcgtgcaggctacgtcgcggcggtgattccactggagtttgcggtgtgggcttctccatcttgtcctcgagctccttctcctctttttctctggtgagtatgttttgattcttctccagcttcatttgttagcttgctgctcgattcgttgttgttttgctccgctagttgtgctccttttgccgatggagagagagagttatagaaggagaggttgacgattttgtcgtctcgttctcatcgtctccggcgacgcggcggcgatttagcgaggcgacgaggctgctcttcggcgagccgcgccgtcgattgcgcaagattattccagtggctttcctttttgttttttttccttttttgttcatttccatctcctatttagcatgctacatgttgtgtttcgttgattctgtagtactagtcgttctagttttcgtagatctgagcaccttttgtttcggtgtttgtttcattgaatccccatgattcgtgttcgattttgcttttgtgattttttttaggtttctgtgatatatttgttcataaatttgtgctatgcgatgttctagaaagtttcgtttatgtgatgtgtgatgtgtgatctgtgatatgtgatatgtgatttacgaattgtgctctgtgatctgtgatgtgtaaagttagatctagtttttcccatgggaatttgagttgaatctatagttgctcccttgttctccggatgttaggttgtgatttgttgaatctgcgagttgctattttagtagatgcgtgtgatttgttttgaatgatgtttatgaagaagtttgctcatgtttggatttatagaagtttgtgttgcattattttgtctctcttactatttgtactttatttgtagtcttcaactatttgtttagcttgctagctgatgaattattgttagctgtagatctgatagtgaattattgctgtgatttatgtattgattatgtttctattttccctgtgtgctatgcaatgttctatttctcatttcatttttttccattgcttatgatatgtgcatccttataataactccttgtgcttttttttttgtctctctccctttgttttaattattagatgggtcatcaaaagaactgttgtacagattcagaaactttgcatcatgatgatgtgtgtgatttagttgtgtgttgtattactattgctacataagtactatatccacgttgtattttgttttctagttctttgtgtgtactcaaatgtaagctagaaatatgaagcctgagatattgatctgaagtgtagatcaatataggttttaacttatatagatcattcgattcctatatagacagccccttaatttaatttctgttaagttagggcaggcatgcaggttaattgattttgttacgctagtttattgagaactttatgatctatgcaaatttgttagccttgtgggatttggatgtctttttgtagctgttcataatgtttgtagtagactggattacactctagtgcaaaccccatttttgttattggactcgtgtttatgtacttaggtctaacatgtcttcccctttggggatttagacgccatttgtgtcggttctactgctaatgtttgtagtagactggattcattggattgcgtgcctctgcatagaccaactgtggaatggtcatgttccctagtgtgaatcaggtgtacagggcttaagtttgtgagattgtttgactttttatcatagtgtggacctctttgcatatatttgtgaggacatggagatatactataacatttgacttcaagttgaaagtactaaccaacgtatatatattgtactgggagttattttgttcgtttgccatgtttaagtaatgttcatttttttcttgaatacagtggtcaatttctgaggaattatatatctttttttaatgcataccttcacttattttataatttatagtctgccaaactttattgatttttaattgctatttttaatagatggttcaccaaaagcgttcaaaattggataattgtagccagcccataagtgaatctgatgatattaattcagagttttcgcgtgaaaaagatgatgattacaattgtgattttgatgataactcagccagtcatgtaagtttattttacatttcaatttcattgatttgaaatatagttgtttttttcatttccatttgtaaattcatgaagagtttgcaattatacattctcattgcttggtagccaatgtaatagtatgaccaatattttcttgttttatttgttcttgaattgtcatgttgttccaaggtcagaatagtatccattattctttcattattttttttcattagtatgcagttgtagctctgttgtagccatgtttcatagcacatttgcaatgttttaattgtttaatatgtttttttaggatatggatgtttcacaaccacatgtaaatgaaatttctacaaatgaacttctgaaaactttgaaaaggaaactcagtaagtctaaaagaagtgaagatgataacattaaggtaattattttgtttgttatttttcattttatatttttccatcattcttgtttttaattttgaattttttttaagatgaaaaggtctgaatctattgaattggacaatgatgtaatgataaatcaggttctacgtgatatcatacaaagggatcaaattatcaacagtttgaaaaaaaagcttaatattcatcacaacataggtgatcaaaatttgaaggttagttttttgcaatgcccttttatatctatgtttggtttttatttattgattaaattgttttattttctttttgtcaggacaaaaatgttgacactgatttgaagtctgatgcattctctagattctcagtcaaatatttctcaaaagttgattctttaagtccacatcacaaaacagtcattgaaaattcttgttttcaaagcatgctgctatttgacaagtgttttgttcccaattcttttgctctctggattgcaaaacaagtagatgtgaactgttctgatatagttttgggccaaaaacttattccattgaacaagcaatttgtccatgttgtgctaggcctccctgttggtggtagtacaatccattcaaaatttgattctggcaaacaaaagattcttcagatttttgggaaaacttctattccttctgtcaagttctttggagaaaagttaattaaaaatgaagaacttcctgatgatcaaattctcatctgctttatgattgtttccttgaattgctttctttgtccaaactcttctttgattccaagtacaaaatacctaagtgcctttgaagacatggacttaattgaaagtttggactggtgcaagttagtttttgactggttgatggaacacattagcaagattgagaaatcaaaaacttttggtggttgtttattccatttagcggtaaatttttttccctccatttatgctaatttatattttgtactaaatgactattcatttaatttctatattcaatgtttcataggttaattacctggattttctcaactttggttcacaaaaagtattacttgatacaccaagaataaaagtttggaaaagatctatgattaaggactattccaaatttgataaaatatctgaaggagtgtatggaaaaagaccagtcaatgatattgcttcaacttgttacccaatggtaaatgttcagttttttttttcaaattttttatctttttaagttctaataaattttcttagattggaattgaaaattctgttttaattttttaggggaataaaagagctcatcttcatttgctgatatgctcaaaagttctgttggtgatctgttgccaagtgatgttcaagacaaaatttgtcatttgctctgctatcattttggaaaagaagatgaaatctttgaagacaaggctaagaaacttcttataatgttctgttgttgttagctgattgtagttccaattatcctactcaacctgctgcacatgaaaattcaggttattacttttaatttacgaattttgttgtttattttatttttaatttttttccattca

SEQ ID NO: 64349 - DNA, 649 bp, Oryza sativa
aacgatttacattaaggcgccgttacggatagtcgaatggagaccttcgaagtcgcagacagagctcctaaccaaccgagcacggtattggcattcactttattgccaaaacaaattaatattgaattttgaagtacttatacactaaccacacccccacttacattcacttacacaacacttacactataattacatatgtaatttattcacttacacggcacttatacaacacttacactataattacatatgtaatttaggaacttataatgtaaatacatgctgactattttttggtgaaaaatatggggccataaatatagctactccctttattttttgtttttaagggggaatcggatatagagttggatttttttagagacagaatcggacatattcttttttttttattttcttcctttttacccggtgtcggattcgtacagatccgattttttttcctttttttcgcccatttttttggtcggacaggtttaagttttttttttcatccgaatttttctggatcggatagatttggttttttcgccctttataatcggacagggtttgtttttttcttttattccgcctgggtttttttttgaaaattttggtttttttttcataaggtttttttgac

SEQ ID NO: 64350 - DNA, 673 bp, Oryza sativa
cttactttttgccaacgaacggtacacatctttctcaaactatggagaattcattggatagctgtacgctgaaatttcctggttcaacataacaacagagtgatgatggggacataatgcattagttcccaacccatatatatttttggtgcctgcattgtcaggtttcaggcttggagatttgtccttctatttatatttttggtgcctgcaaacaaatataatgttacatggtagccgatttgttagcaatttacttatctgtcactgaatcagaaccatgagcttcttgagattgctaaacctgttacaatgaaagttctttttggttagatatgtagtgcacacgttaccggtgtccgcatccattgtctgctggaggtccttgtatatgctcttcatcgttggatccattcgcttcttgggtttcttcgtgccggttcttgttttcttggcattgctttgctcatggaggttcatgttttgttgatgcattggcatggtgggggatgctgcatcttagccttttgcatgattaatttcagattgtgcttttctttctagtgcagtgctggtgctagcatcttacaaagtcattaaactgtatgatggggggattggttcaattaagtatctcgttgattctcagagttattttttatatggaaaaaaa

SEQ ID NO: 64351 - DNA, 652 bp, Oryza sativa
gaatacgaataagaatcgaatatgatcggacacgaatacgtaaacatttttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaaatctataaaggtatattgaaggttatagagttagaaaaaaatggggtatgtctcatgggtcctgcggatatccgaatagcactgttcaccggatatccgaattattatccgtatccgacggaatccctgataccatatttgtattcgtatccgggagaaaatatccgtattcgtatccatatctgaactatccgagaattatccgatccgaaaggtatccgtatccgtttttgtccggatcggacggaaactatccgctccgttttcatcccaatctagcaccctcttgatcggttgttaggatgaggaaaaaaaaagaaattgtgcttagaattatctctcattagctggatctggtaacctctatttttttttacaaaatacgcaaatgatttacgtatttttgtataaagattaaaggatattgcctcacaaagcc

SEQ ID NO: 64352 - DNA, 4466 bp, Oryza sativa
tggatgggttggggtcacatgggcagttacagtttagcagttacagacagcccctgcctcctctggaataggtctcaccacctccttgtttcaggaaacaaaagccatcatgggtctcagtgagtgagagagagcaaaggagaaggcatcttcttctcctttggacatgcaatgcctctgcatttttcactgcattttgcattgcattttggccttttttttttttggggggggggggggtctcaacttgtgcattcctctgcatttttgcattgcattgaagaagaagaggagtggtttgtgtgtggtggttgcgtgttgtggtaatgaaatgtggagaagagattcctgtggcgacatgggcatgtgcaggggatatcaaagtggtaggcgagtacacggcaagagaagaaagaaaagcaaagcaaaccaaggcttctctgtaatgctaatggctatacatgctcttctcctccaatcatgagctgcaactgacatcctgcaatttactaattactagtactattatactgccattggtgattaattaaccttttttttaatttcgtggtaaacttggttgaatcttgcggctgtcactgatcagggattcattcatggttaagattcggtttaactacatgtacaatttgtgtgattataagatggcaacttggcaccaaagagttggtgagcagaacatgagaaaaaacctgtaaaagaaagcgatagaaccaagaaattaaaacggcaggtcgccgtataacaaaacagagctgctttgctgctaataatgaattagcaactgtgtgtctgcaggtggatttggttgtgccaccactaaccctaattaaaaccggcgatgaatgtcagagacggtgaacaagtcaatgggggcaagtagattatcatctctgaatctcatctcaccttcttatctgccactacaactacaacatcatcagtatatacaatgtacaaacctaggattcctgggaatgagataatgcgctgcgttgacattttctgaacctttgcacgaatgaaccgttgcaacagcagtaaaagaaaaaaaaatattgtcctaaccatcttagctctgcacccagcgtgcggggtaattaagagcagcagtagtatgtactacctggtgaagcagtaaatatactcctaattaaggggggagatttctactacccctgcaagcctagcttgatgtactacaacattctctctgacagacgcagccacacaccattatcctccacttgtttaccgtaagctgatcaaatctgttcagagatcagatcatttaaactgtctgctagctgcgctgattaatcaggctgtgttcagtggtcattggcatgtactagtagtagtaatagatctaacaatttcgatcaaccaaagtacaacacatcttctgattaccaatgtgttttcaccatctctggttgcatcattgcagacatgtacattgcagataaagataagatgattaactaaccaattctttctgtgtgttttttttaaagggtgatgtaagcaggatttggatctgagactgagactagtgccatctttcactttaagcttactactactatactactgctgccttttgcatccaatgcaagcattaaccacctcctcccatatgattctccctcaataagttaattaaaaaattgttgttgggttaagacagcttgtgtagatccaaaatgtggccactttacccaactactccatccatccatccttgtagtaccctctaccttccaaccagcttcccttccatggtagatagccactatttggccaaggtatctttgcatgtttatgcatcactacttgtacgtatccacaaagcaaaaaaccctgtgatatgctacaagatccttgtacatgcagcacggctcattttgatgcatggaatcccatggcatttcccttttaattggatggaagtatgtttgagggagagagttttacagaggattgcattgcacggatcttaaagcaaatatctgatcttcgtttttttaaaaaatgtaagaaatgttgttagtattcgaacatgtcgttgaaattcagacgggaatcgtgggtccaaagatgtcttccatttatttttgtttgtatatcttttttttgcaaaataaataaataagtgtaatactatatgaaatttcatttaaatttttatttgatctgcatattaatctgttttatatttgttgatccattcttgccaagtggcaacagagatgcaaatgggggttgtagtgaagtgacatgagtagaggagatccactatcacagcaggagtgagttgcctgcatatggatggatgatcgaagtatggcagatctagaagggagcatacaacaaacatcagctgatctgtgtgtgagactgacagagttggctcctgcagttagtcattgatcactgggacccacatgcacataaaaaaaacttgaagcacacacaagctgcatcgctgtgtgttgcagggcttgcagcactgtagtacttttgagcctctcccaggacagattgggtggaaagtgaagtgaagcgaagcaatcagatctcagtagaaccaaaagcaaaatgcacaccatttatactagtagtacaaagctcaaacaaaacacattataataagataaaaaaaagtaattaaaagtacaattagttccatatttttttctcttaaaacatactccaaatattttaccagttgtgccaatgcagctagctacctgtgatgtgtactttcagcaaggtataatagcagggtactactagctaacactatcacctttttcctccttccatcttaaaactgaagcaacactcatgagggttgatccccggcctgagtgagtggcacaattccatatcttgatactcaagcaatgccatgttcccctggcctcctctctttgagacttttttttagccttttgaccactcacataataatgccttttgggcagtatacagtacagctgcaagcacacacaagaaagagaccaaaggatagatgcataggatgccatggcaaccaacaaggtggtgtcactcactcacattctcactcctatctaggatgatcctctcctctgctgctgatgactgcatgttaggagagtactagtaaaactaaaccaaaagcctgcagctggaaaggctgtcaactgatgcttctcttctcttcttcctcccccaccatcctatgttgccttctttctttctttttcctcctccaaagttggataggatagatccatctctctctctctctacatcatgatgtggagcaaaatagataaatcgaacatgcatctctatgtgctgggaaagatacctctacaatgcacaaggggccgccttggaattcgggcaaagtatatgcattatgtgccttttgttggtttagaggttgttttagctgctgtgtatggttggtaatacagtttaacacaacatgttgcatctccataagttgtatggattgttaaataatcctccctctgtatttaaaggtactattgaatttatttgatcaaacttttaaaactctgaccatcgatagtccttaaaatatctcaaagtatttagtttgaaaataaaaaggatcatatttagattttctttacaaacagttttacaatattacaattttgttagatattattgttatagaaaacaatggttaaagttgcacataaaaccaaattaataaaattaacagtgccatatatttaaatagggactaactttccctgaaaaaattcccttaagaaaaggggctaactatatttatggtgccaaactttttaacaataatcattttttatattataaaatatatatagttacactctaattacagtataaatttaaatacttatacattgtaaatgttaatatttacattgtaatttttctaatactcactgtatatactatatgacatttagggctaggaatgattatttactaatgtaaaagagaaaaaaaaacaaagagataaaaggggagggaaccatgcgcaccgagataagcgtatcggacggccacaccttcgactaaaatcggacgcaaaaacatgacgacagatttttagtaatgtgatttaaatatataccgagatagtaataaataggtaaaagtacttacaagctgctattgtaaattacggctgtaagatggacactgccgaattgtgaaattgtgaatgtacatgtagcacacaactattcaaaactcagcaaaaaatttctagagatcatcgtattttgtttgccttttttttttgaaaaatctagaattaatatactgtccttcgttttgttttgcattccgaaaatgctaatcctatgacatgggcgtacaatatatgtatgcatctacgacgggggatatatacgtacatatgagccgtacat

SEQ ID NO: 64353 - DNA, 1044 bp, Oryza sativa
tgatgcatcagttgaatagaaaagtcgttcctttcttgttacaagtgtagactaatattttcatgtgcatcttggtggacctggagtctcctgcttcatgggatgtcacatgtatacctaggtttcaacacgtgaaaccataggtgattgaaaagtttggcatccttgtgtattgtccatgctaagttatttctaaccgtagaccagataagttctgttcaccagagatttacaagtgctggttgcttcctagggggctaatgtcaaaagtcagtgataattcatgttttgtgctgtagatatattggctttgagagcttaattatgttaatttttttattgttttccagcttcttgtcagtgaggttagcgagcatttagattcacaaatgagcctagttgccaatctactctccttttttattgctcatccagtaggagcactttttttttgtgaggacagtgggagcatccagtagaaaaaaaacttgaagtaatctgtttaacaaagggtctgaatgtatatttgtcgcattgcaatcttgtgttcaagcactcaaaagttttgagcgaactagcatttgtttgagcaaagtaaaaattgttagtttgatgtcatatgttcatactttccagtttccactgtagtaccctcatcatcttctgtgcatatgaatattccagttacaccagcaatttgttgatgtgcatttcaggtgactaatgtaatttcgagacggagctcagtttccttcaacagccagagaataagttttatgtccattcgttcaaggccaagtcagcttcgttttaagatttgctgctcggtatgctaaggttttctcctattagcaattgttctaccaatgtattgagtttatttgcacatttttctgttatgcacatgtgttcttcaaaaccttcataggtgtctggagcaattgtttacctattcaaactagtttagattttggaatatctagtgaatcagcagtaaatagatattaaataggagttcatcttgagttcttggcatgggtcttt

SEQ ID NO: 64354 - DNA, 16687 bp, Oryza sativa
aactaatttgatgttgtaaatattataaatctatattcaattatagatttaaagtagttaaattgctccaactttgaccaattaagtttatagaaaaaatattaacattttcaatccaagatatattataaaaatatatttaattatagatttaataaaactaatttgatgttgtaaatattataaaaatatattcaattatagatttaaagtagttttttttgaaaaatttaaagtagtttaactttaactaaagttaaaatgacttataatatgaaacggagggagcatatacgtctgcaaattaatttatatacatcgatcgtacgtgcgtatcagatcgatcgagctagctagctagtacgtgcgtgcaaggtgttacggggattcttacttttaatatcacggcggtagaaaagattattaattaattacggtcgatgttattgcgtatctaatggaggatccatattccgatcgtttttactaagatactactataacatcacgtactgtaatatttattactactagctaatcactaatctatacggcatatgtttaattaactatttggttgtctgcactctagctattggcgagagacccgtacacgcttgattgatggctaatgtgtcttattcgtcatgcatgcattagctccaaacaagctagctactaatcttatcctcggcttaatcatttggcttgaaaaagaaatacgtactcctagtatgatagacaagctagaatcaattaattaaagaatggatttgagtttgcagaaactgacaaattaaacctgtgacttatctgacacaggagcaacacaatgatcgacatggcacggagagtcgtctgagaaattattacagggacaaaaataccaaaaaaaaataacggtcagatatgatcctactatgctactatacgcataagtaaagggtactgtaaaaataccccttaattaagctataccatatggtattcgatcgaggaggggccacatgcataggatcgtccaatgacgtggctaggatttagagtaaaaataatctatctaaatataatgagtcaaattaaaagatggttaattacatataatttttttatagttttagacaaatatctactacaattttagccttgagttaaaatcttaatatggtccataacctaccgtgtcacctagctagctccgcctatgtcatcgaggtccaaattaacatgagctacagctacaatctacatgcatgcaatggacatacttcctccctactcataaagtaagtcatttaggacaatgtttaagtcaaaacttgtgaatataaatcatgaataactctcaagttgttgagtttgaaaatgtaaaaattatatgaatagttttgtctcgaaaaatactttcataaaagtatacacatagataactttttaataaatatttttatagaaacaagaagttaaagttatgttttggagaccatgtcgctgtccaaaactaacgactttatttacgaatacggagggagtacgccatggctagctgctgcgtgatccgaatagtaaagtgtgcagtgaggcgatagagaaatgccttgtgtccaggggaacagggcccggccgtgtccacatcgattgagcctctttgcatgcatgcttgccgtaggacaattactacaaaatccttttggacgcggtagtatttattattataagtttattaattggtgaagtattggagatccacacaaatcaggaccaatccaaatcaatatatccacaccgatgcaactacatacaaaaagttcagacgatcgaccgatcgaaccatatatatggatgtgttggatttaatttaacgctatgtaaacctgcaaaattcaatttcaaattacagtggctgtctatcgatcttttttttttcatttgacatctcgaatcaacagggctttgaatttccatataaaaaagacgtgaatattagggaataagctaatattaaataattagaagggcgtgagacttcgaaccagatcatctagcccaccaccttgtgtccttgtggagctagccggaagacccctgggtgtttctcctggatttccatatctcaagtttaagttttttttctcaatattgcatcccagcctctacatctatatataggatgcatacaacaatactcatatttatgttgtcaaatccatgatttctttggaataaattcattttttaaggaagacctcaatgcaagaaggagggaggggatatatagttcctgctgctttatatttttataaggaacagtcaaatcatttttatactactataaattatctacacttaattcgtaataattacaatgtataaatttgtaactttcaaaatttacatagtaatttttataacacataatgtataagagaattaggattaaaaataatttattatttacttggaagaggagatagaagcatacatacttacttataggagagagtaattaccgagggaaaagtgactaaaattaagtgaaaaatgtggtgctataattttaggaaaccccgaaaagttagttaaccttgtttatatgggaaactggcacagttaattgaaagaaaaaaaaaactccacatggagaattaaaataaaaaacctgcagtgacacaactactgagactgcccgccgcaagtcatcgttgtccagcaaattgcaaatgaacaagcagctttgattttctatgatagtcggtaaacgatatccacaaaccccaattgtgaagtagaacacaataggcaaaaaggatacatgatcgatgacgctgtcaatacccttttagaacaccaagatcggatttctcatctgaagaaagagagatcagtagagaaccaccacagcgacatctctaagttggcggaaaatgacacccctagaccttaacatcatcggcaccagtggcaccagttagagattgggtaaggcttttcggtaattttaccatccttgagaaaataccgagaggtaccatactttctagtgtaaaatttaggctgcgttctttccacaagtttcccaacccctttccctcgttttccgcgtgcacgcttttcaaactgctaaatggtgtgtttttttgtaaaaagtttctatacgaaagttgctttaaaaaaacaaattaatccatttttgaaaaaaaattagctaatacttaattaatcacacgctaatggaccgctccgtttttcgtgcggtggagttgggttcccaaccccaagtatcaaacacagccttagtgtttctaaatactaagtaccttgaggtatcaaaaactttaatgtaaaatttaagtatctcgaagtatttttttgaagtacccagttaagctctctcaactgtcgatcacctttgtgttgccaaggttaataagtattataggttattgttgtctacctcgtcacacctgacgcaatggctctaactcggtcataatccaatctccacataagctatcaattcaacagcactcctatttcgttggaatatttccaacaaaattgcatcactttgaccagtttgccgatcccaaatgaagctttatcaattgggtaattttaccatccgtaagaaagtaccggaatgtatcatattttttattgtaaaatttagtatcttgaggtaccaaaagattcagtttaaaatttagggacctcggtatttttttcaagaaatataaaatttctcttattaattaatctccgtcaattacatcaaggtgatcatttttgatacactaccttgttccatcggtgggcaccgaaaacacacctgcggcagatagatcgagttttcttcagatctgcatgcatgcatggcagcagcaggtatagccaatcagatgaaaatctgatcacatggagacaactatccgatcacctccgtgacacacccaacaacgatagctctcgcgatcaatcggccttcgccaccgccgcccgcgagcccactgaccagcagccaagatcgaaacctgcacgccgcatgcttatttgcaactcaccctcctcgatcgatcctcatctgaatatactgaaaccgtgtgtaaacaaattgtaatcctatcaatatggcatttgggcaaaatcaatcagtgatattcctttgttcctgtctaccaccatgctgtgctagctagcttatgtctacatttgcgttgctgtgatattcctcggtgcgtacagtacgtacgtagggcatgtgcagaaattattgcttagctagctagtagtgttcgttctcttctgatgttcagtcaaattttcagtgggggtttcgagagatcggagagaaggaaagatgagatgcgtctttctcgtctgcatgcttgggcttcagatcgttggacatgactgtctgctctcccggctgcatctgtttgtcatggcatatgtgtttgtgcaattggatgatttggcttttggttggctgatgaccatctgtgtgcctggaaatggaggctgcacactgtgccgttttgggcgcctagcttgcctcatgcatatcattcagtcattcagtctgatgactgactgtattaatatctactcctccagtactccaatacactagtactactacttttgaactctgtctggttttggttacttgtgtgtgcatggttattttgaaatcatatcagcatgttcttttctgattttggcctggtttagttcccaactttttctttaaacttccaactttttcatcacatcaaaactttcctacacacaaactttcaacttttccatcacatcgttccaatttcaatcaaatttccaattttagcgtgaactaaacacactatgggtttttatttgcacgcttgcaagctcctacatggtgtgctttgtgcaaagaaagtttatataatttttttcttgaaatacttttctctttgtagcaaatttattcgtttacaccttcaaatagctattacaaaaatcagattattcatcacctatcttaaatgggtgtctttctttaatagttttgagctcttgattaattatataggaccagatcatcacagctctttgggtagctaaagataagttcagacagtcaaaattttgtctgcagctagccagctagccagctagcatgaagttagttaagctgcctatgtgtatggcaccagctaatctacactagaatttgaaaaaacctgaacttgttttgattactgatatacatcagtccagtatatagatggctacaaatgattgtctaggaggagtgtactcaagacttcagagccagagtcgacatcacgtctagtcgatcgtctatacacaataatatccgtataatgccaaattaacagctcgaccaaacttacacgaagttggtcatctagaaaattggataatgcataacgaaaattgacctgcaggagagagacagttgtctaatatagtactagtttgcaattatacatgagccaatcgaccaaaccgtgttcaaccttcagaagcacattaaaacgaacaaacggcaacaatccaaactcaaatcggtggataaaaaaaaatgcaagctagtcaaagatgaacatatgcaacgatgcacagctacctagctagctggcagtttcatgctgcaacacacaaaagttcaggatcttgatagaaacagcttggaagttgagcgtcccagatcgagtaatatggaagtaaggatctccaatcggattaggtgtgatatgcagcatgtttcatccggcaccaaccgtgacaacgccatggatgacaattttgccatgagaaacggcgtctcggccggcagcaacagatcaggttgggaataatttgcatttccaggctaatttaacctaacaattttgagtattaatgggccggttagtcacacagggttctgaagagaaagttgggccgtggactactctattctactgtgggctgttgtggcaatattggaaattgctgaacgtaagtgaaaaggctaacgggcaatcgatcgcccctagcgatcaccccctccttcacgtgttttttttttttgacaccacattacttttctattttaataaatttatgcaacctgtacacctcaagtttacacatctaaattttatacacctaaagtttagagactcaaagtttatatatccgattcaaatttgaatttgaattcaaatattttttatatacagtatttctatacatctaaattttatacacttaaagtttagagatccaaagtttataagtcaaaaatttatatacccgattcaaatttgaatttaaattcaaatatttttatatatagtatttctatacatctaaaatttatacacctaaagtttataggacaaaaatttataagtcaaaagtttacatacccgttccaaatttgaatttgaattcaaatatttttatatatagtattttcatacataaatttttctaactttattttctttttttttaaaaaattatggtgtagtatgaagagaagaagggaaggagaaagagggagaggagtgtatagcggggatgggggtgatcgccgtcctttagccatgcccgaaggtaagtgcatgacgatattgccatggatgattattcgcagttttctactcaaactccaatgtcatttataccgagaattccacgagcgatccgacctatgtggtgagagaactgacaacttgacagtaagtaaacattgagtaccaaagagaagtgcatgaatacaatagtaactcgaggttttgcatattgaaactgatcaaaacattgaagaaaactcgaggtttcagatctcaagccgcgcttttatctcatcgataacagatgggaaaccctgcataagacgcaggtaaccaccagtgactaccaccttcctgaagttgttctcttcaacgaagaagtcgaggcacctgctcttcagctccgggcagctgtgcatctcggcacaggccagagtctccgccaccgtctccactgtcacgctttcccacagcttctgggcgcacatcagcttcagcctgtccaacgcaaacctgtccgctgccgcgaacaatttcttgaaaaacgaaggagatagtatgtctctcggtggcaaagcgtccgtgtacacgaagtgcaggagagctctgaacgtcgccggctcgatgtcgtgcagcgtgacgcacggcatggtgccctccgccatggagccgaggagctccgcgctgaacaccggcgagcgcgcggcgagcacggcgcggtgcgcgcggatgagcgtctcgccgccgacggagaaggacacgtcggagccgtcggcgctgcccaccatggcggcgagatggccgcccaggttcggcggcggcacggctatggggtgatggcgatcgtcgcgcagaatcacgaggccgaagacgaacgtgaccacgccgtcgatcgcgtggagcgaatccacagcacttcgcttcacgaagcgataccagccaacgaagcgccagaataatcggtcgtttttctcgacgcgcaaaaggattgcacgtcaatatattagaagataagaatattcattacacaacgcattaaggtagaccgacttatgccaagagagaagggaaacaaaagaccaaagaaaaaaagactaagaaagtacgactcagaataatcggccgtcgtcttcggttttgttggatgattggatcctgatgatctgcgtacacctgtctgcatggtgcgaggatgatgatggtgcgccatctttgcccatcaggagagcttcgaagatgacgctgattttggggtcgttcttcatccccacgaagagagagatgtactcgccattaattgtcgctcttaagcccacgagggaagagctgaatttcggcattaagctccctggccgagattcttattccgggcaaatacttgccaatggcaagcttctgggattcgaggtagtcgagtttgtactcgatgaaaccggaggccagcatgttgccggcgggcggcggcgtatgtttgttgcaaggggatgaacagctagctgacgggagaatttagggcatgttcagattgctgccaaaataaacatttctaaaatttggcaatgctaaaattttgacaagtatgttactaaatttcggtagaatcgattatatatgttagctaaacgattttggtctttttcttgaatatatggtaatttagtgtccattatgttgtttcttagttgccttttgccttttactatgtctattggattttaatccaaagattaaaaatctatgtgatatgattataaaaatctttcgaaagatgcataggtactcccactgctaaaactctttaggtattaccaaaagtaataaactaaaggggtaagtccattttacacccctcaactcttaactttgtctaaaatacaccctcaaaatacaaaacaggatatttgataccccttaactatcaatgccggacactttaccccttgagtggtattgtgctggttttggtacacgtggaagtcacagggcatgccacctgtacaaatgctacatgtcaggcctatggttggttgtgggagaggcggcgagatgttgtggcctgcgacgcgcgccgacggcatggggacggaacagcggcgagcggctgccatgtgcgtcagtacatgtgcaggtgcggctcagggaaggagcagcggcaaggcgtcgatagcagtgcagtgtgcgggggacagagcacaatgagcacggccgtgggcttcatacccaccttggccctagagcgcggatcggctacaacgaggtcggcgtcgctgaatctggccacaaagactacagagagctcacctactgctcatacacgctactgcatccactactactagggtattcttctcccatgaccatgatgcaagtgctagctgtagaacaaaaggagtaatcacgaatcaagaatgtatagagctagcagcatatacagtatagcttaaggaaataatgattgattatttagctctccttgcaaatcctccccaccccatctctgcagggcggcgagttccgatctggtaggatgaagagagaagaggggaggaagaagaaagagaaggtaatgagaatgaacggtgggtccatcttcttttctgtttatttgttggttgaccggagtgtcggctcatcgccgcatgggcaaaaaccaccttcatcgggaacgaagaggtgtaaattagacagttttgaaagttgaggggtgagttatattcggtttaaaagttaaatgtgagttttagataatgcaataggtgagggggggctaatgtggacttatccctaaactaaatacatccacatgtttgccgattttatcaaaaaatgatatggttcaaaatgacaccaatctgaacgagctcttatactagagctagtatactacacagcatgctgcatgcagcgatatactcgtaataataatctagtgtgtgtgcatgattccaagtgctatggataaggcgatgcatttcgaagaaaaaaaatgagaggaagagacatccctccaaacattttttaagaagaaattatgagcgtgttcggaacacagaaccttagagttgaaaccacacaactcttgccactacactatcaagtgcatctcaactctatagaagccattcattcatctgcatctgccgttagcggtgcatttgaattttgtttgaatgtgtgatctggaatttggatgaattagagctagcttttcctcgcagaattagttttttttggtgaatttgggtagatttagtgtagaattatgatttttgatgtgttagaaatgatttgtatcaggttctgtgaagaaacagtacaattttcagctgcttcaaagcaaactttcaattctgaaaactgaattgtttccgatgtgcggcgttcagctgtcactttactacgtgaacgttgttcttctagggtaaaattaccagagatcgagatgaaaggagactgccatggatttgccgcttaccagctttaagagacttcaacatccaagaacaagtatatctatgataataacatggcaaaatattataaatacaatttatatcaaacttaactgctctctggctatatatttcaggtctcaactctcaagctatgcatttatctcgtcaatcactagtggaaaactctgcctaagataaaagtaacgtcgtcggtgaccactccctttctgaagttactctcttccatgaagaagtcgaggcacctggctttgagctccgtgtagttgtgcatcttgttgcaagccaaagttatcgcgacggtctccaccgatacactctcctatggctttagagcgcacacatgatctttagtctatcgagcatgtatatttgtcagatgctactaccaaactctcaaacaatttagtcctcgtcattgtaggcgccgaagaggctccgggtgacaaggcgtcaatgtacacgacatgcaacagagctctaagagcaaggataataattggccataagccaactataaacttatgtggaagagagataaataaaattgagaagggttggctcttatgcaaaagccagctatgaacacgctccaaaatatttactacattaaattcatagtgagagaaagagggagaagagaaaaggtagagccaaccttatacttaacttattagaaatgttacctataatatggactaatagccaatagtcaactatactagtagagtgtggaggatggatgcccccacttttatccatgattctgtaatccgttcaatgaaatacccaaagaacaattcactatatcaagatataataaaagaacaattcactatatcaagataacatgatctcttgtgcaacactgctacctatttcaagtctcaagcctggagccgtgcctttatctcgttgatcactaacgggaagctctgcataaagatgcaggtagtcatctgtcaccgctgccttcttgaagttgctgtccttcatgaggaagtcgatgcatctagttttgagctccgtgcagctgtgcatctccgcgcaagccagagtcgccgcgacggtctccgccgacacgatctcccatagcttctgagtgcatccgcaatggttatctatagactctctacaagagatctatgtcagcatatttttctacttggaagagattaaatgaagagagagcaaaactatctattagcctagagatagtctatagagaaaaacgaaacaatggattagagagctatagatacccatgtagacatattattagagcacccgcaatggtaaagtaaggtgctatctataaaacatgtacatctcagcaatagactagaataatagtaaaccatctcaatagtatgtctacatgggtatctatagctctctaatacattgcctcgtttttctctatagactatctccaggttagtagatagctttgctctctctcttcatttaatctcttctaagtaggaaaatatgctgacatggatctcttatagagagcctatagataaccattgtgggtgcccttaaagtggtttactattaatctagtctattgctgagatgcacatgttttatagagaacaacttcctttatcattgtgggtgctctgagcgcacatgagcttcagcctatcgagcgcgtatctgtccgccgccgctagcaatcctcggaagaactcaaccgccgccgccgccgtcgaagacgacgtggagctcgctggcaaggcgtcggtgtagactaagtgcagtagagctctgaacgtcgccggctcgatgtcgtgcagcgtgacgcacggcatggtggcctccgccatggagccgaggagctccgccctgaacaccggcgaccgcgcggcgagcacggcgcggtgcgcgtggatgagcgtctcgccgccgacggagaaggacacgtccgagccgtcggggcagcccaaccatgccggcgagatgcgcggccaggttggggggcggcacggctatgcacggccgccaccgccggcgatcgtcgccgtcgtcgtcgcgcaggacgacgaggccgcacacgaacgtcgccacgccgtcgaccacgtgggacgactcgaggtcgccccgcctgatgaagcggtgccaccccatgacgcgcgtgccgccggcctcgccgacgaccgacctccgtgctcctcctcgcgtgctgcggcgacggcgcgccatgcttgtccgtcaagaagacctcgaagacggcggcgtcgatccgggggtcatcgtcgtcgacgtcatcgatgaacatgaagatcgagacgtgctcgccatggccaccctcgatcccacgcgggtagagacggatccgcgcatggtgctccccggccgagaccttcgtttctggcaacgaatcgtcgatggcgatcttctcggattccagatagtcgagcttgcactcgacgaaaccggaggccagcatgttcgtgttgcacgtatggcgatcgatcgattgatctatcgatgaacagggcacgctcaagggaaaattgattcgtcggtcgatatgatctaactaaaccgatttcaatgtggataagtttgattaaggttccgttcttttctccaacaatcatatattaatctatttttcaagtttgtaataattaaaactcaatcaatcatatattaatatcacctcattttacataaaaaaaacttaattttcatcttcattttcgtctttaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacctcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacatttttttttaatttgatctgacaacgtcgcaaggggaaaaacttaatttattgtgatgaataatggtttggcagttgatttgatccaagatgagtcgacctcgctcctcgtttcaacagctcgtggatgaatcatcgtctgacgatgacgatgatttttttttgccacggcacaaatcgtccatagctattggcactctgtcaatgcaccaagacatggtgggtcagtcatgggacatgaagtgattgatcgcaacagagaagcacggcacttgagattataccaagactacttttccgataatcctacctatggcccagttttattcaggcgcaggtttgtataagtaaattttatataatttatttttgttatatgcatagatatgcatgtctcattagttatgattcgcaggaatagaatgagcaggcctctgtttctccgcataatgaatgcagtagaggatcacgatgactattttgtgcagaagagaaatgcagctggtttaattgggttcagttgtcaccaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatggacacgattatatgatgggatattatcttgctgatggcatatatccttcttgggccacatttgtgaagaccataccagaaccacatggcaacaagaggaaatattttgccaaagcacaggaagcagtaaggaaggatgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgataattttatccagatgcacaaaaaaataagggacgacgaaactcactatcagctacgtgaagacctagtggagcacttgtggcaacattatcttgataaatattgaggttttatttatatgtttgaattccatgtaataaatagtatacatatgtgaggatttgcaaaatcattttaatttgttcttcatgtattgaataaatggtgtactgttcggtttaagaatagtacaggagaattaataaaagtgcacttcctttatgcattttgttgaatatgtcggctggcagtgataaatgtgtcatgtggtcttcctgtcaatcatgaaaagccacagatgaggtagaggccccagaagcttttcaatcatgccaggaaacaatcaaacatcaggctctcagtgagagacaatacagattaccacaggtcaatagcaacatcaggctctcataaagtctgattcattacacagactaacaccaagggcatgataagggaagtacccatctactaacaccaacttcggacaaaacaaaaagacacaattctgaatataaatagtttgcattgcagacttagtaaacctagataaatttctaacaaaccactgatctaaactgcagctacgattgccatctctttccctcccattctctgatctggtcacaatttgttcagttgcttcttcacatgtacgaaggtctcagcgaggtggcttccctgttgatagcaataagatggagttcgaattaaccataatacatgtacagagtatagagctgccaagttttctagtctattttaattagtaatgtacaatatttgaagctacctatatgtttgtactgtaaacaataattgaagctagctagtactgcaagtgatttttttgactgatcactgtcgaaaatatggattcagtaacctatcattcaaactgaaattgaatatgcactcacatggatcagttgatcatgcagcaaggtatttgatcttcggctcttcggtctctgtaggttcattatcttcatcaacatgattggtagtatcatcatttgtgggtatagctttttccaaaccatctgtgcttgccttctgttttttggtggcatagggtttttgggatgttatttgcttcatcttatcatgccacttggattgtgacctcaagagagtccaacagtgcaggaattggaagggcttatcttccaactccttaaatacagcaatggcctgagcaatctgcacatgtcaagtcaagtgaatgtggttagcaaacatcatatcttttatttataaactaacataaaaacacaagctacataactatgtagtaccttgtcgtgtatactaaccccgctttgtcttctaccctcaatctggctcagatatccacaaaacttgttgacattctcttgtatagttttccaacgatgcataagtgaattctggctgcgatctggtgtggatttactcgttttgtataagtgctcgtatattctagtccaatatgcagcacgagtttgatttgtgcctagctctggatccaaacttacatgcaaccacgccgacacaagtatcttatcttcttgttcactaaaattcttcgatcttttttgatttgatctagccacggtagtcctctcaatagtggggaactgctgcgtgacaggctcgctactcatgccattctcatcaagctggttactcatatcatcctccacaggcatcgtactcaaactatcccaatctaaggaatcgttcccctcattcatcaaattagtatagaatccttcttcttccattatcagtaggacctacaagcaattatctccatcatgtatgttaaa

SEQ ID NO: 64355 - DNA, 682 bp, Oryza sativa
caatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcctaaggagctcctgatcattgtagtacagctaaaaacgtactgcagagaaaccgaaaacgggaggagaaaaaaacagcaagtacgagaagggaggttcccccacttgagtaagtgacattggattaggccgatccttctccctcacaagagacattgttgaaagtacaggaagtaaaaggtcatcctctcccttcaaagact

SEQ ID NO: 64356 - DNA, 6037 bp, Oryza sativa
ataaaatcttcagtagaatatgaaactagcatgtcccatttgtcttcttgaataaaatagttttagtacaattaagtggacttcaatagaactttagggtgagaagaatatggtctgttagcaacttgtgaagactattttggacatattcatctaagacttgtatcaacgaaaacaaagaaatacacataaggaccttgtcagtactaggatatcaatggggataatatcagtgagtcaacctcaattgaacacaaagagagttagatccatggagagaagcagaaaataaatgagttgttactctgaaattacctcaaacaaatccagtagcaactcacgtcgttgagaggcgaggtggacgaaggggcacagactgccgacggtccctggattgacagtcgatggtgacttggacggaggccgctagcgctctggacggaggggcggcagcgacctagatgggctgccggcggcgccctggacggagggccggcgacgccttggagaacctgcggcgtcccggacggacggacggctggcggcgccctgaacggagttggcgcgaggagaggaagctggtgcgaggaggggaagaaaggcgcggctcctcccggcgaacgaagagacggtggttgagggaaagcgcgggcgaggaaaaaaattggcgccaggaaaagaaaaaacggcgcgggcaggaacgattgcttcgattgggagcgcttctagttgcccaatatttggttcaggttggtcctggttttggaggtggctaaattttgggaccatgtttaggagtttgttggagggctgattttcaccaaattcctaaaatttatgttttagtaacctgtttagcattctcttggagatgccctaactgttggagtacgtatacatcacggtcagttgggccatgaagtgcaaaatccctaattggctaacgtgctagcgggccttaccaatttacgattttctattagagtaagtctacttgtactccctcaaatatatgtccattttgattcctatcccgtaacagtaataccagatatattgatccctccaactattaaaaccggtgtaacagaatcttgtatttgggtttaacttttgtaccttttgcattggagtgtgcgtttttgtattataatgtgtgcatctcttaattgtttgcagtcagttgttaaaatgtggcgaatggtttaaccttaagaagacaggagcgagtactctttaaccgcgttctggccggataatagttgtaatctcacatctctagatgtggatgtttttagtgagtaatatatctcttttttccaaaaacaaaagtggcgaatggttgaaccgaagcaatttcctgtctatgttatttctggcctgaacttgttttagcacaaagcataccatttatgggactttctgggacgtttaattatttaccatttttaagatgcgccaattaaagatttgtcacttgctatctatgacatgtgggtcctcatgtgtctatgatatgtgggtccactaacaaattctttagaaccacccataagagtggcaaatagttaattatgcccctgattcctcaatgagttaactctatggtttatcttggcatgtggattgaatgtttttaagctgtaggagtatttctttgttgtttcattaattacacaaaaaaatattgtcccattattactggccttattcagtaacatcttacataatgtttgctaaatatctgtttgatgtttttattagaaaataggataaacctggcttcacagctaacctgtttggtgttaaggcactacctccgtcccagaatataaggagttttagagttagacacagttatgaagaaaatatgtaaaattaaattgtggaagagattgtgattggtagggtgcgttcggtctgaccgaaaaattcggtctcggtcttcggtctttcggttatttcagtctttgaaaaatgaggaccgaatttcttcccaaaaaaactcaggaccgacaaattcagtctcggtctcggtctaaccgaattttgacagactggggactggctagagatggaggcggcgcgatggcggcgttgaggcagaggcaggctcgcggaggcagcgtgatggaggcggagggtggagacggcccgggcgcgatggaggttgaggatggactggcggaggcggcgcgatggaggcagagggtggaggcagcgccggcgtgatggaagtcgaggacggaccagcggaggcgccgctgaagccgccgtggacgagctgctgctgctactcaccgactgccttacctccgaccaaatctgggagagagaggggagggtagtggggacccactgcctcctccattgttgccgctgcaagcggcctcctccccactggccatatctggaagaggtagaggaggagaggagagttggggagccattgttggtgccccctctactgcttccgtcgtcgccgatctcctcccatcccgccactggatccgcctcccatcgccatcgcctttctcctgcaacactgccgatgccacctagatctaaccttcccataggtggtctggggtcgcgccaccaatctgcaacccctgagcggtcattgtcaccgttgccttcccgagctcccaccctcgtcgtggtcattgtcgagcttgttgccgctcttttgccaaggcgtgaggacggcgaggagcataagtgtgccaccaagaaagagatcgagagaggagggatttgcactggtgagagagagagagagagagagcgggggggggggggaggatgagattgagaaatgaatggtgagggatggcttgtatcacgacactttgaatatgctacagttgtcgaccgtgccatgctggtcgctagtttttgcaggcggtcccttaagtacaccacttgtaaaaatatccttattattccatgcaaccctctttaatctaccgtttgtcaaaatctattcttgcagacggggctaaaactagggcctctagttatttttacaagcgtaaattgttcttctgaaaaaaaaatcaaacctaggtgttgtgaaaaattgtttttctagtagtggaggtatgagatgatgtgtcactcatccggaagcttctcatagcaaatcaacatgaaagtgatgtacaactgttgttaagtggtggctataaaaataaaagggcaatttgggggtttcccatgggggtaaccttctgtattttgcctataaatatagagctaagtctagtgtttaataaggtgtatagcgagagaatctttgtgaggaaaaattgtgagaaactgagattggcttggtcaatgcaattttacttgtgatagttcaaattcacatttaatttttttgtccttgtttacccgaaaataataggagaaactcctattgtattttacactaaaagagataatatttacaagcatcacattcatatttcacaagcagcatatatctctccatgacttcagctaagcatgcatgctacaatttgttactatccataataaattgagtcgctgaagtaataacatttatctcgtgggacaactacatctgcaagcttcatggtaacctccgatctagatagacaaagaccgagcccaatcaaaatcgacaagaagcataaaaaactcaacaacaaacactagattgaatatgttgaatgctaaaaagaatctaataaacactagattgattatgttgaatgctaaaaagaatctaatgcaggaatccttcttctatcttcagttcaaataaggcagcacacaacttttattgaaaaaaaagaaatgcaaatataaaccaccagttagtgaatttgtttcaaaatctcatcatacaaagcagaaccacacaaacattctccaaaatatcaatccaccttctctagaatctcacatcccacattgtagttacataagcagaagtgttgtttcaatggtaccatttcaccatctaacataaagaactagagcatttttatacaagcaggtgttactgacaaatcatacaaaactaggtacgatgcttcctgaaaacactccctaaacaagacaactaaccagagaaagttatctatcaaaaagagctaccatgtgatgtcaaggttgttaaggagcatatttatctccttttaacaccgatggggagtcaatgtaaccctccctccgtggctacaatcttcctacagttgttgtcctccaagaagtattcaaagcatttcttctttaatgcaatgcaattgtacgtatcagcgcaccagagtggctgcaaatgattcatccgtcatcctttcccatagattctgggtgcaaatgagcttcaatatatccagagcaaacctatctgctgctgccaacaaactttcgaagaattcacttgtcgtctctcatagcagcaaggcgtcgatgtatatgaaatgcaatagtgctctgaacgtcgccagctccaggtcatccagcatgacgcacgggatggaactctttgccattccacaaaaaaaaaaaactctgcatggaacatcggggaacgcgcggcgagcacagcccggtgcgcatgaaacatctcgctgccaacagagaaggagatgtccgagccattggcgctgcccaccatgatgccgagttggttccccaggttggaaggtggcactgcaataggttcgttgtggttgcgcagaatgatgaggccacatatgaatgtaaccacatagcgagagtcaagttcactcagcttgacgaagcgccaccaggcatcaaagcggaagccctgggatgccttgcttaccagcagactcctctgggaatgttgcacggctggtaaaccatccttgcccatgaagaagatctcaaagatgaggtgggtgttggcgtcggtctcattcagcatcgccaccgcgagagagaggtactcgccattgtcttgttgacgcggagacagccaccacagaagacatgcattgtgctcccccgctgagattgttagctttggcagtctctatccgacagcgagcttctggatttctaggtattccaccttgtgctcgatgaaattggagacgagatccatcacacatggctgggtggggacgccgaaggctggggtgggagatcgggagatgaggatagtgacgggacagcgtcggaggctgggaatgcttctcgttggagagcgtaggagccgggggggggggcagccgtgcgagccgccgaagacgagggaggagaggtggggtggggaaatttcgctggagatgaagaagaggagtagcggaggaggtgggggttggggagtacggatggcctcgtcggcacggtgccggcggcgcgcgcgagggttgggggatggagcggccgcgatacacatgtgccgggtggaccacttgaacggctccgacgtgttcttcttcgtcggtggcgagacgttccatgcgcaccgggccctgcttgccgtgtgctcgccggtcttcaaggctctgctccttagctccacggcggaggcagcagcctgcagcatcaccctgaacgacatcaagccagcgatgttcgaagctttgctgcacttcatgtacaccggcgacttcctgccagcgggagcccactcgtcgtcgcctgacagcagcgacaccaacaccgacacgctccaccggctgctcgcggcggcgcacgagtataagctcgacaggctgaagctcatgtgcgcccgaaaactcgaggagagcttgtcggtggagacggtggcgaggacactgggctatgccaagatgtgcggctgctcggagttgaagagcaagtgtctcgacttacttcttcttggcgaagaagaacatcaaagcattggccacacatggctacttctggctctggcataacttcccttcggtcatccaagagattaaagtgttctggtcgcttgagcgtttacagatatagatagatactccctccgtcccaaaaaaaacccaacctaggatgggatgggacacattctagtacaatgtat

SEQ ID NO: 64357 - DNA, 845 bp, Oryza sativa
tattgatatcgtaaaaaactcaattaattatgtactaatagctttcttgtttttgtgtaccgtatttaacaattatattcatcactaccggtgtggcacgaattcgatgtggcatgtgacaacaaagcacaccagatccaacgtgggataggagaggttgacacgtcagatgatgacattgtgagagcatgtttaccatagtaccataataggctcatgtatcatagaggtgtgaaaaccattacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatcatgcatccaaatcttatcaccgtcatagccatcgaagccaatctgataaagactacgccacactagtaagggaatattcaatatggggcatccacgaaggttgtgacatctaggatgatgtcattgcattccatcctgaactaggttttacgtggagagctcaccttgagacacaaaggtgatagagagggtgaacaacatctgaaagaaaagtatgtgccatctatagacgtcacgaatttggtgctccactagcgtggcaccctt

SEQ ID NO: 64358 - DNA, 13238 bp, Oryza sativa
tctcccatcccatcctaggttgggttttttttggatggagggagtacttgttaacatctcattcttatacaagaagccagagatcttcttgttctattttgggagtggatttttatccctcgaggggatatccctttgttgtttgcctgtcacccaaatagttataaatttgaaaaaaaaagaagatatattaacatgtgatatatcgctccacaaatatgcaaattcaaattcaatttctacacgaagttgaatttgaacttacatgcttgtagagtgatataccacattctaatacatcttctcaaattttttcaaattttttcataatcatttaggtgacatgcaaacaaggatgatatataatatacttcgttcctataaaagatctatcgttatagattctcctccacatctctgaacttcatgccatcacctttttttttttttggaaacccatgccatcaccttggacatgctgaaatcatacacctgttaccccgtaaacgcacagtaaactacacagaaatatacagtcggagcaatgcctgaatgccattttcagtaacacaaatacaaccaacgaatcacagaagaagaagaacagcaaggtgaccagcagctcattgatgttcaggacagcagagttgcagatgtacctcccggctgcacggggtgtctcgtagagcaggatgcggcagctcgcgacgtcgtccatgtggacgtacaccatcctcccgtacatggtgaatttcgttctcacctgcagtgcgatttcatggacattaagagtcagagacttgaaagcggagagcataaatgtagaagtgtttctgaaagattgcgctccattgaaatgcacgaatttcattcatatgaggtagttcatgatcagagaacattctctgcatttcgggtggtgttttgcgtaccatggaataggcctaggacgatatcggtggtagcggggcttaattcatggagaaaatcccctgtgtacacttaaaagttcacctaatcctttgtgtacccctgaattttgctcaatcccttacatacccctgaattttagtttggatcccttccataccctttccgctagttgaccgttagttgaccgttaaattcttatgaaaaagtccattttgccctttggtataaagaagcatataaattaatagagtatattgttggagaatagaaatttgttatatgagactattatgtttatgagatagttatgcaccatactatttgcgataaatatacttttaaatatgacataaaaaattaatacttatttattagttattaaaagatttttttagcatatgtgttctgaagtaataaacaaatctgttgtattactatgaaaacacatatgctacataaaagaacttttaataactaataaataagtatcaaatttttatatcatatgtaaaagtaaatttgtcacaaataatatggtgcatcacatactcataaatataatagtctcatccaataaatttttacatttcaacaatatacttcattaatttattatgtttcttcatagcaaagggcaaaatggacttttttaaaagaatttaacggtcaactaacggtcaactagcggaaagggcatggaagggatccaaactaaaattcaggggtatgtaagggattgagcaaaattcagaggtatagaagggattaggtgaactttcatggataaataggggattttctcttaattcatgacacaccaacataagtttggacacttcattcttaagacaaccaccaatcagttctcaaaataaatttattacccctatctctatatgtatacatctttctccttcttactacttgtaccataagtttattcactctctagtccctaaattgtttatcggttctcgccttttcggtgtttgaggatatgctaattggcttatcgaacctaggacaaatcgacgtgtgttcaccataacgggtttttttttcgagtgttcgttcgatgatatctatcttttttgcggcgatgggttttcagatgccgctgtgggttgcacgcaagatgtttaaggtgtggcggcataatttagtgtcaacaccctggtcattaggggagcctaatttatggcaaaaccatgatattcttttggagtaagagaaggcatataggcacaacacattatgagtgagtgtttgagtaaagatgattagaggtaaaacgatgtgggattaattaatttaaactaaaaatagattaataagtttttttaaagtaacttttgtatataattttctaaaaaaaagaccctttagaagttcagaaattgtgggcgtgaaaaacaagatattttccaatcttcttaaaatgatgctccctaggtagacgaattcataagacatgagttactgcacataatatacatcttggactgggcttcagcccatatgcaccaaagtctcaaatcccccaaattcgtagcaaattcggcattccaaattctaatttgaataatatgtaaactatttgagaaatacgttaatacggtactcgcgtagaaatactgcacatgatcgtcgtgctctactttacacgtctggatcgtttggcattttctaaacaaattctcgccgaaaagaggagagatcacgcagaaagttcatcctctaatccatccctttttctctccattctcttctctaatcctcctcttctcctcgctgcaacgcgacaaatcgaacagatcaacccaaattttgatcatcttaaaattctaaattgatctaagcagtggcatccattgctactcctcttcccactccaccctcttctcgtcttcgtcttcttccccgacacgtcacctcgccgccgatggagtcccacgacggcggcggcggcggcggcggcgatggggactcgctcttcgaggggatggtcctcttcaccccgtccctctccgtcgatcccgatcccgcgccgcccgtcgccgaggcccccgaccccaagccgcccacccctcgcgacgatgccgccgtcgccggagctgacggggcggcctcccagcagcagccgccgccgcctctggatgaggacctgttctccgatctcaccctcctgtccccgcagtcccccgtcgacctgagcggcgcccaccaaggtcaagatcaggaccactccgccgccgcgcccccctcgccggtgccggctccggctgcacccgtcgccgttctggcccggcaggcgtcctcctcggcctcctcgtcgctccgcaagaagaagagggccgtgcgcatcgggtatggccgctcgcctcaacccgcgcctccttcccctcctgccgttgcaattgctgctacgaccgccaccgcagctgctaccgctagtgtaatccatggcagcgtcctccccgatgcttcgatgcatcatcaatccgctccgaccatcccagtccaccacctcgaacaccttgataatggcgttgagcaggctgcagcggtagcggtggtggatccggatgagaattctcttcatgtgaaagaagaggatggtgaattggaggaggatggaggtgctggggctgaagcaatggggattgaggagagattggctcttcttagatcccaaatctccggcaagctcgagtctatccagcagagagccactgctgtggctgccaagaggaggcagttggctggtaggcggcgaaaggttgcggaggacgtgggctctgcggcatccaggcacaaggatttggagagggagcttgaagaggcgtgcgaggccgaggactttgagagggccgagaagatcagcgactcccttgcggcattggagaaggacaaggatcggttgttgacagcgctgcgtgatgcggagctcaattatgattcggtggatttggaattgcaggatgtgctggattcccgcattgccgcagaggaggaagctgcttcactcctggagcattttgcaaaggtaatttagctgaatttcttcttacgcactttgcatgagactctgaggtctggactcttgacaagatatgtacttcctggaatccaggctcccctgcaagcaaccattgcttggaaaccgataccaaacctgaagtttccctacttgaactctaatattttcaaatagctattcaagcatgacctaattctaagtgcttagtaatgaatcattgcagaatacattttaaacgcatggtccaataaggcaataaggcttcattttccagatatcctagtctatgctgaatattttggccactatgtcataaattcatttgcacagttgtcatattctcctacaaaagttgtcttgtggcattgcatctgatcatcatgaactatagactgtagtagtaagtacataaaaaactgaaaatgccgtgaaaagaaattttagcttaagtttgtaagttaaacctgagtgataaaaagcagccctgtatgcttcaaagtatcagtgcattgtgttctgttcttctagttgatattacttatcaacattaaaactctgttttttaggatgctactgatcacactgattcagcaagcaaggaggcagaagaaatatcattgaaagaaatagaagggtggcgagaatcaatggaattgctagaaacaaagaaactagagacggaagtagaaagtgaattggttttggcagcacgttcaggattggaagattcgatagaacatctggttgaagatgacaaaagagaaaaggacatgctgagtaagaaggggatacccttgcagaggagttaactgagctcctgaaattggtaaggttgaaagaagcagagatagctgaaaacaatgctcagatccaggaggttcaagaaaggatcactgccgttgtctccagattttatggatcccagacagatattgatctaaagctcaaaacccttcaggaagcacaaactaaaatggactcagaggctcaagcacttgccctaaaaaagaatgaaattgatagtttcatctccttatcagaacagaaagactcaaaattacgggaaattatcaatgattgttcctctgaagcaaaagcttgccagcagtcagtagatatcagaaggaagcttgcatcgtcaattttgaagtcaagggaggacagaattgggttgttaaaaatggaggaggaaattttgcaagatatccaagtgctcaggcaacaaacatcagatgcaagaatcagtcttcaggtacattaatcctttttcatgttgataaaaaagatcatcatgtttaatttttagaggacaccgtgtaagtaagaacacaaatatttttatgtacttattgagtttgatgacttgcaggagatatcttcaaggaaggctgtcattcagcaagatatagctacatttaagcagaaattgagctttattgacaaaaggggccctgaactagaggctgaaaagagagttgctgccgctgcaaggaatttcaaggaagctggaaggatagctgctgaggctaaagcgctttactctgaaaaggaagaacttcatgctaaacttgagaaagctgctactgatctggaggtaatcgaaaaggatatcacagctaccactgacaaaatacaggaatgcgaagggcttattatactcaaagaaaaagaatcagccatgacaagttacaaaagactcaggttggatgctgctgctgctagagcagaattgactgctgcaactgaaacagacgatagcgaagaggttgaggttctgcggaaagaagctgaagctgcagaatctaaagcaatggaactaaaaacatgctatgaccttgaactggacgacaacgaaatcatgtttcagcctgtagtccctatagtattcataaccaattcaacagggcagcacttgctagaaattgcgtcttctttcggtctatccccctagaagcaaacttcgacagtacttgcatgccaccatgcttgttacagtttgtagagttttgccagcgacagctgcctattgaagggaacatctgtgctgcaatcaaagcttatctccagatatacatgtcttcctcattgttcctccttacctcctagcatttgggatctactctaaatcgaggagaggttcctaggggacagccaagtgtataacatccattttgcgtactcaaactcttcagggagtttgtctccccctcatttttgtgtacattaagactgtaattcttttgttgttgtggtaattttggttgagctacagtaaatgccattcatccgaatgtaatcagtataagttatccatgaaataaactctcttctgcattgcacaactagtcacatcgagtcatcgagtatgtgttgaaagttagtcctagctaagaactgttttatagagttgttgcttcagcatgaagaagctgtgaacctcacaggccgttgtgaaatctatcctactctctacctgccaaatataatcaccaaaagggagtgacattttagtatactttttttttctgccttttgtactcctaatacatactttcacagttcatataaagatctcgagggtgaaatttcaggagcaattccagtttcagcttgggagaatggagaacactaccaagggcaaggtgtgtgtcactggggcttctggctatgttgcctcttggcttgtgaagcgacttcttgagtcagggtatcatgttcttgggacagtcagagacccaggtccatctttcattctgttctaattgagttcagtttacttgtttcatggtgatggatggacttgttaatttgagtttaaatttctgtttttggttactttggcaggcaatcacaagaaagtagggcacctgtggaatttaacaggtgcaaaggaaaggctggagcttgtgagagctgacctcttggaagaagggagctttgatgatgctgtgatggcttgtgagggtgtcttccatactgcatcacctgtcatcaccgaaactgactccagcaaggcatgctacactaactgtgaagaccactttcaccctgcaattatgcgactctcctttttatcttggaattcagatttaagatgccatctggttgtaggttttaacttttaacagatgtgatgctacttcatttgtaggcagcagtgcttgattcagcgataaacggcaccctgaacgttctgagatcatgcaagaagaacccatccctcaagagggtagtcctcacctcttcatcatcaaccgtgaggctcaaagatgaagctgatctgccacccaacgtgttgctggatgagacatcatggagctccatggagttctgcgagagtctccaggtgaacagagcacaatccgatatatacatttgcaggtttttggcattgtttcagctgctctgaacatctatctttgtacatagatatggtacgccattgccaagacacttgcagagaaggcagcctgggagttcgccaaggagaacggcatcgaccttgtggctgttcttccaaccttcgtggttggacccaatctgtctcatgaattaagtcccactaccaccgatgtcctcggcctattccaaggtacatgaaacgcaaccgtgaatacgaagaattttcttcgatttcagttagaatcatgaactgtctcatatgaaactcttgcatttcaacggagcgtaatctttcagaaacacttctacaaagacgctctctgcattcagtcctctgagtgaatgtccatgaaatcgcattgcaggtgagacaacgaagttcaccatgtacgggaggatggggtacgtccacatcgacgatgtcgcgagctgccacatcctgctctacgagacaccccgtgcagccgggaggtacatctgcaactcggctgtcctggacgtcaacgaactggtcaccttgctcgctaggcgattcccttcgtaccccatcccaaagaggtcaagaactccggcgaaatggaacttttttttttctgctgattgatcgattcattggtttgtgtctgtgtttctgaagatgacattgtcttgggatttctctgtagtttgccgtgcgtttacggggagcagacttatggtttcagcacggccaaggtgagggagctgggcatgaagttcagagatgtggaggagatgttcgacgacgccgtcgactcgctcagagctcacggctacctgctgaacagcgtaccatgacaattgacgacaaatttatcagaattcagaaattgggtatgccccgacgaagatgaagctgtagctagaatcatcagttgcacacaggaaaaatgtgtctctgtgtcagagaaggttgtgcgctactgaagaagtggagatgattatgtattatactccctccgtttcacaatataagtcattctattatttcccacattcatattgatgttaatgaaactacatctatttaagtttcattaacatcaatataaatgtgggaaatactagaatgacttacattgtgaaacggaggaagtagaagatttataacttgttgagaaaacgttaatcgtattgttcgtgtatccaaaacataaattttaaaaaaatattatctcgttcagattattgttagtggtgactattactccgtagtattttatttcgaccgcttgttagttaatgaggacgatgcacaaaatttcatactcgtgtctaagatacaatacacttagtaaacatgacatcttttaagtatttgcttttcttttcccaggagtagtcaaagttggatgatgactaattctgttgactgctacttaaaaatggatggagctatgtttaaaattaagaagatttaactgcaactactgtagtataatttttttttaaaaaaatatttttgaccagagggagggtttttttttttttgagagagtaatagggaggaggtttaaacatgaccaaaagcatgactcgctgatcgatctgagcccatgggccttatctcggcccaagattccgagacgtaatcaagcaggaggacaaagtcatagagataagccgtttttagcgcactcgcttgctcaggttcctcctcatcttcttctctcctcttatccccttcgccttcctcctccccgcctacacgaccagttcctggtttctgctgccttccctcggtctggatcaacaaggtgagtcccaatctttgacatcctgcctcacttccattcttgcacccaggtttgcttggatgatttctggtttcgttggcgacctgcactgcacctgttcgatgaattgccgcaatggatagtttcttgattgattgagtacgctagggtaccgtttgcactgagtgcactagatgtccgaacacacgctgagaaatttgagggatttttttatggttgttgagcagaggaggtcgtccaatggcgagtggtgggagcagcaatgccgggagcctgacgcagtggctgagggagaaggggttcgacgaggaggccatcgggcggatgtcgagacggtgcaagaaccttcacggccttgacgccggcgaggcctccggggtgtgggactacctcctgaacgtcgtcaagatcgagcggcggaagctccggtacgtggtcaccaagtgccccaaggtgctcaccctgtccgtcgacgacaagctcgtccccacggtgcagtgcctcaccacgctgcaggctaagcccggcgaggttgcgcaggccattgtcaagttcccccagatactgttccacagcgtggaggagaagctctgccctctcctcgccttcttccagacgcttggcatctctgagaagcagctcgccaagctgctcatggtcaacccgcgcctcatcagctacagcattgaggccaagttctcgcagaccgtcaacttcctcgttggccttggcattgacaaggagggtatgatcggcaagatcatggcaaaggagccctacatcatgggttacagtgttgacaagcgccttcgtcctactgccgagttcctcaagtcggcggtcgggcttgaggggtcaaatcttcagagggtgatcatgagttttcctgatattttgtcgcgagatgtcgataagattctgcggcccaatttggcgttcttacagagctgcggtttcagcaaggatcaggtcatggcattggtggctggataccctcctgttctcatcaagagtgtcaagcattgcctggagcctaggatgaagttccttgttgaagaaatggggcgggacatgggtgaggtggtggattacccccagttctttcgccatggtctcaagaggagcctggagtaccgccacaaggtgctcaagcagatgaattcaaggtgcagcctcagtgagatgcttgactgtaatcagaagaagtttgccatgaaatttggtttgcttgcagcagtttaggcatgcatcctctcttcagttcccatgtagcatgtttatttttcaggtgaaagtttttccttttgtactagcattttggacatcgagaattcaaagcattttgctttactgggtgttttctggaatgtcaagtgcaaatttgcctctttcagtgtcatgattaatgtataaccttgcatcaattcgcagaagagaaagcaatgcaaagcatatgaattttcttgtcggcatgctcttctcagttgaaatgcccaagtgagttgtaccactacagcagtaaggggaagacattactacagcattcctatccttggaagctatcacaatcacctatttacactacacatatacaccaatcatttgttatttgttcattacttacaagcacaattggggaaagtgggaaaacagtgcctactcagccaaactcctatgtatagtatatctgaaagatgatttgaaggggatccactcaacacacttgtctattcttctccgaagacattgtctgatttccttttgttgagcttcaggcatgatctcacatgccatctcaaccaagtcaggcaactcgagagcagcatccttcgcataatgatggagaactttaggtaggaagattgtctgctttctgactatgacactagcttgaatgaactcagtcctggcttgatccagttgatgattcactttcttggcagtgtacagcctcacctgcagaactttttacagtaagaatattgtgatcactttgcagacaaaattttagcatatctattctgcttacaggtggatctgaaattgctccagtggaaagagcaaaatgagcaagtggctctggaggatgaagagcatatggatgtatggagctccctgatgccgattttttcagtggagtaaatagagtccgtacccactgcatgtcaattattttgttagtttctttcctcaaatgtgtttgtctttgtattattggtggaaaatattgtgcaggtgtaaaccataccactgaagtgcgatgggattggcatccaataattgagttctggataatttgggcgtttactgaaagcccacccacattatatgcagcctgacaacagattgttcaagtatgtaagatatatcaaaacatttcaaatgatgacagtatcattgttcaaatttgatagttgtgtaccttcagaatcatgtctgtgtttttcatgcgtttctcctgaagtccataagccataaaagcctgttatatttcagaaaatactgcgggttaggtgtgcatgcattctgggtttaacactgaagtgtagaacatagcgaaggtgacaactgttgtcagtcataaaaaaaaaatgttatgactactatgcatacatgcatcaccaaagcgttgtggatgttgatccaaaaacagagctgctcttcatgtgccatttttgttgggtcaattttctcaagtcgttttatcagcgatctgagattaaaaaaaagtgaacataagtaaataaatagcatttcctgctttataggatttctttattgcagagttgcttacctgacagtctctagcattttagaggcatattcaaacttttctgcatccatatatatccttgggcatattatcatcccattgtattgttcacttttctcattcaatgaatcatatttgtcagagcttgtgttgacattgtaatggcatcggggactccaactatcaacacggtgctttaaagaaaatgtacttgatgaagaggagaatgaaggagttgataaagtctcaaaatccgccaaattttgtgatggctggcttgcaagtttgcagtatactgcagaaatgcatcttacgatgtcctccgaaagtttgcaagagatctttggcacatattcagcgattgaagcactcaagaaatttgcaaggctagaatgtcctgaagatgatctcgacagcccctgtgaaaaacatgaaagatagattttctcagtttgagagattttgacagaaaaccatatgtttgtgcctgagctaaaacctgtactttgaagaggaaaaagatataactgaaactggcacaaactggtaagttttatcagaagaactaaaagaagagattgttcatacatgtttagaatctgaaactgttgatactgttggcaagttgtaggatgctgactccttgatatttctcaatcggagggcaccttcatcagctttctttctgcttttctgatggtgtatttcttgatccacctgatcatgattgtaaacctaaatatactgtatactctctgaatttatgtgcagtatagttctgaaaattgatccatccaaggtgcaaggcatgtacctgggtagaaacacgaggggatacacctaggtgttgatcaaatgctgccctgtagagggaaagcaaatgcagttccttgcgaacaacttcctcctcaagggctgctatctcccaaactaagtctgcaatagactgcaggaaccacaaggtcagtgatcagatatcgataactaaatgtttataatttcatttgccttttcacttcgttttgaattttaaagttggaacactgttttcagagtatcattattatggcacatgatctttgttactattcttaaggcctcaagttattttgaaaaaaagcaagatgattagaacaaaagtacgggtataaaacctgaactgaacagcttttcttcagcttttggaaacaaataggaccttgagatcatgaaatactatgcaacttatgaggatgtggagcaaacctttgatatggttttctcactttgttctgcacttgtaatcacgtgatgctcaggcaaatgctctgccagg

SEQ ID NO: 64359 - DNA, 707 bp, Oryza sativa
gggtgtgtttagtacacgctaaaatgggaagtttggttgaaattgaaacgatgtgatgcaaaagttaaaagtttacatgtgtaggaaagttttgatgtgatgaaaaaattagaagtttgaagaaaaagtttggattttaacaagggctttattttgataggagtgattttcaggatttacaggaggtaccatattttttttccgtgaaattttaccatccttaaaaagtacccatgttttttagtgtaaaatttggtacctctatatactaagtagcttgatgtataaaaaaatttagtatgaaatttaggtacctcgaggtatttttttaaggaccataaaatttctctattttttaatataaaatttgatacctcttaatatctctgatggtaagacataccaaatttgcaccaaaaattttggtatctctcgatatgtctcaagtattgttgaatttgtgttttgatagataatcatcagatcaaattttgttgttgaatgatgatgatactctttcttgttgcagtgttaattagagttattcaagacgcaaatgaaggtgatgagggcggaattaaattcgatgactccatgtacagatcgattcaaattggaggatagcaaagaatttgcatgaatttgatatggtcttgcgccaatgcatgaatgcagatataagccccctgcttggtacactgaaactg

SEQ ID NO: 64360 - DNA, 625 bp, Oryza sativa
tgaccaaagtaaaaaagactaataatcagttttattttgaccaaagtaaaaacgacttataatctgtaaaagatcatagaaggactaggttttgctttgtgtgatttgatttgcttatgttttttgtgttactttcctaccaatacacatttgtggttttccatcttagaattatgtccccaatcgccttaacaacaagggctgtttgttacaaggtccctatcttgtccactccaagaactgcatgccccaactgaaaaaactatgatttctcccaaccacccccatgacaccagaatttctgttctgttatgcttcatgctgctgttaataggatttacaatccggtggaaaccggaccaaatttcgtaaaatacagacttttcggatcgggttgaaaccatagacactcgatttgatggtcatgtttatttttgcgaacgagtaaaagaattgcacgtcaatatattagagggaaaagagtttttgttacacaatgcaatcaggcagagcggcttataccgagggaaggaataaaaagcaaaacaaaaattgttgctaagaagaaaaaaatacggtggctatacacaactccgattggaggaaggggcaaaaccacagtaca

SEQ ID NO: 64361 - DNA, 1121 bp, Oryza sativa
acttcattcataatttgttttttttggctgtgtttagttccttccaaagttggaagtttgggttaaaattggtacgatgtgactgaaaagttgtgtgtgtatgacaggttgatgtgatggaaaaagttggaagtttggatccaaagtttgtatctaaacacagcctttgtttcggagtaagatttcattcactcagaatttgagagtgtatagtatactctctcacagcattttttggccgcatatgcgccgtcgtcatatccttccttggtggcggcggctggcggccaagttgctcctccacgcggcggcggcgccgccgccctttcctcttgtcccgccgtttgcggtttgtcatgcgtgatctcaggagcgtacacctgccggatatagtggccggcggcgaggtctcgccggagcactcctcccttgagtgtctcaagaatctgcaatgccttgctgatgtacgaacaggatattgttcccatctcaaatctggcatgtagcagccaaatcttggtatgatcacggcaacatcgtcaaggaaattcccaatatctattcttcgtggtttgccatagactttttcataaagtttctactatgttggcatggcctctgtgtcccaaaataagatttttttttaaacgacccacacaagtatagatggtaataaggcccgagagccaacagttgagccgtgtctggaccgatgccttggtacggtgggccgtcccggcacggcacggttaatggaaaatagtagagggactaaatagacttaatgcagccatataagcaaaggtaagccccaaagaagaggaatacaaaatagacttgctccagccatataagacacacccaaagagttcagggacgaaaaatagacttattattatatggagaagtgtgattggttgtcatgccttattagtcacacacaataaatttatatactccatcgatatacttcataaatttaactgtcaactaacgaaagagatataaaagaaaggatataaactgaaatttaggggtatgaatgaaaataagtaaatctcaggatataaaagggattggacaaaatttagggttacgcaggaaattttctcttattctta

SEQ ID NO: 64362 - DNA, 1066 bp, Oryza sativa
tactcccatattttatatgtgaatttccttcacgtagttctttattttcaattcactcctatataattaacttaatgttattttatgaaaagttacttcttttcaaactaagttacttccataatttaaataaattactttcaagtatttgaatatatttaatgttgtacattttgtcatatattttaagaagagtatgatggtttaaacggaatttaaaaataatgcatggtttaaaatatatagactgcaaaaggtttggtattaagaaaaaaatagattagtgttggccctcagtaccaaccatttaccttatttggtacttcctccgtcctataatataagagattttaagtttttgtttgcattgtttaaccactcgtcttattcaaattttttttttggaattattatttattttttgtgacttactttattatccaaagtactttaagtacaacttttcgttttttatatttgcataaattttttgaataagacgagtggtcaaacagtacaagcaaaaactcaaaatcccttatattatgggatggagggagtatataactagccattggcttatttggtatatagctagctagagaaatatttagacaacacactacccattactgtgcacggatgataaaaacgttcgaatcggaaaaaggacaccagggtcacgctgtaagtctaaacagtgcacgtgtacttagggcatctttagcttccaaggataaaggtagatgaacagccatttgatcccccatcaaaatccgcattgaaacctttacacactaatgggtgtaaacaaatagtacgcccctctactaaagtgggttggaaagcctgtatggctaatctatgcagggtcaaagctatttgatgtctgactcaggcctatatgaccgatcgatcgaaatactctaagactccacctttgtcatatattccatatatcacattagatagatatcatattctagccaatatttctctcgtgcctttccgcgttcatggttcgatattctggtgtccagaatttttgaggagccggacgacgaag

SEQ ID NO: 64363 - DNA, 14243 bp, Oryza sativa
ctgctccggaaatacccagtgggagcccataccggccttttggggcgtatgtcctgtgctctccggatggtgcggcgtgtgtcgacaatccaacagcagcggttcagatgctatatgcaacatttgctgcaaggcgtgctccagagacaggcgcggtgccacctgaggctgcacactcctgctacggtgacctcgtgctgagcatgccgcaccacttgctgctcaagaggcgccttggtgccacagtcaccgcacctgccgcgtccaactacgacgtcggcatctccattgcactggaggcatcaggtatcaccggtgaagctacagaggcagcaccggcacggcagtggctgaagacgtcgaagcgcgtgggccggagcccgagcctgaactgtgcgagcctcgcaacgcggttgggacggatcacgccgtgccgagcgcagatcgagtggtacaaggcattgttcgatgccaacaccgggtattacgacgcattcaagcagcggctatcacctaagaagttcagcaaggccaacatgtaccgcatcaagctcgcacagttctgggatggcgtcctctccatgcttgacaccagccagctcccctacgacttccaccgccgtgccaagtgggtcaacgctgcccacttctaccagctccttgttgagccacttgacattgccgactaccaccgaaacaacctacaccgcacacgcggctcttacatcacccatggccgggagagaaggtagaagcagtagcacaaaaccacattgttcattctagataattcatggactccattaggcttatgcactacctgtactctataggtatgagctgttcgacaagtggtggaaacagaagggctgcacagatcccagcactggtgacacctctgccaccacgacagcgaggaggagcaagttcgctgggctaacgcaggacccgtgcttctgggcgagggtggaggaagcgcgcgagcagacagagagtgccaagagcgaacgcgacatgacatcgctggcgaggatgctggaggacttgcacaagtttgagcgccattccagcgagctggtggagaacaaggaggtctccattgatgtcgttgcgccacagtcgagctactccctgtgggtgaaggagtggaatgagctcaagctccgggaagaagttaggacaatattgtttcaattttgaagttgaaacaccttaagaaaatttaattaattaattaattagttagtttgttgagcatttgtcatctagtttaggcacagatgaatgaatgttagcaacataatataggtgattgtaaatagatttagtcctggtagaggcattgcattatgatgtatctgttcttcatgttgaaatttgcaataacttgaagctgattcacttcacttctgtcaagaatttgcttcaaccaaatctgtatgactctgcatgttttacctttatggatatcaccaaatgtacatagtttgatgacagacttgttgaaaggatcttgtaggcttgctgacttctgaccaagaaaattgtgtgtggagttggattcttctctcttcaggttgagctactggtgtggtaactagtacgagtgtatgaccaagaaaatatctgtttccctgatttgatccccaactctgtcaagagtttgtaatttacattctgaatttcaaaaccgtctgaagcttcccagtctgaactcccgaaactgatcaaaccccagcttctgaaactgtggctactctttcagacgcatgtacaatttcagcccaggagtcgcaatctataagtaattttgtttttccttttgcgaatttggtgcatgtaaaaattcaattacgcagcagaagtttgtgaatttctcaccaacagttcaaagttcatcattacttcattcataatttgttttttttggctgtgtttagttccttccaaagttggaagtttgggttaaaattggtacgatgtgactgaaaagttgtgtgtgtatgacaggttgatgtgatggaaaaagttggaagtttggatccaaagtttgtatctaaacacagcctttgtttcggagtaagatttcattcactcagaatttgagagtgtatagtatactctctcacagcattttttggccgcatatgcgccgtcgtcatatccttccttggtggcggcggctggcggccaagttgctcctccacgcggcgggggcgccgccgccctttcctcttgtcccgccgtttgcggtttgtcatgcgtgatctcaggagcgtacacctgccggatatagtggccggcggcgaggtctcgccggagcactcctcccttgagtgtctcaagaatctgcaatgccttgctgatgtacgaacaggatattgttcccatctcaaatctggcatgtagcagccaaatcttggtatgatcacggcaacatcgtcaaggaaattcccaatatctattcttcgtggtttgccatagactttttcataaagtttctactatgttggcatggcttctgtgtcccaaaataagatttttttttaaacgacccacacaagtatagatggtaataaggcccgagagccaacagttgagccgtgtctggaccgatgccttggtacggtgggccgtcccggcacggcacggttaatggaaaatagtagagggactaaatagacttaatgcagccatataagcaaaggtaagccccaaagaagaggaatacaaaatagacttgctccagccatataagacacacccaaagagttcagggacgaaaaatagacttattattatatggagaagtgtgattggttgtcatgccttattagtcacacacaataaatttatatactccatcgatatacttcataaatttaactgtcaactaacgaaagagatataaaagaaaggatataaactgaaatttaggggtatgaatgaaaataagtaaatctcaggatataaaagggattggacaaaatttagggttacgcaggaaattttctcttattcttaacgcagttcaccggcatatggcaacaattttatcacattaattgtttctggctagctagctagttagagtgtgcgactttggtcgatcttgtggttaattattaggctcaaggaaatttctagtacttcgacacgtggtcgtgccgcgccattgacccatgagccgcgcgcctgtctatctccgcaactaagatacgaatcatatctatagtttttatcggtactttaataagttatctgtatatgagtcgggttttaagttcgtttgcttttagaaatacagattcgtatctgagtcaagttataagttcgttcgcttttgaaaatatagaagaagtcatataaaattttttttttaaaaaaactcgcatgctaatctgagatgattgggctcctaattgcaactcataattttctagaaaaatatatatccaagcgaattctcagagtaatttttatcttaactaaaccatataacaataataaaattaaaatagccttcacccgttgtaatgtatgggtattttttttaagtatacatgtagtttgaactaggaggatcggcgggaagttatggcttaagctttagacctaggatccaaacttcatacaaattatgtataaatttaagaaaaaaaatgcttgaaattatatagaaataaggcgaaatgaagaactcaagctctaggtatggctccaagctgattttgtcacttgttagaagttgtttctctctctcttttttaggagggagtaggtgcgatagtggataaacgtaccccatgcttgcaagctacattttttaattttttgagaagggtatttttaacccgatatctatctccaacaggatatatgtagcttttttaaattaagaatgtagcccatcaaataacccaatctaaaattcgcttgtatgaagatttaaattcaggatcttagagcatctccaacagccgctccaaattggactctccaaacacccatatagccaactctccatttgatttggctagtcaaactagatagtcactctaacagactctctattaatcatctctaaaataacaacggacccacatgtcatcctctactcctcttcttcctctctctctctcccccttcttcctctctctccccattcttttcccctttatttccttcaaagccgacgccgcagagaagctcgctgccaatttccgccgcatcctcaccaacctcgcctccgccgcgtcctcctcggccttcaccgagctcctgctacacttgccgtagagggggagatccagcaggcggcgccggagctcctgttcctcaccggatcggggcggctcgagctcaacctcgcgcgggcccacgcggcatcggacgcgagcggtcaagccctcgccgtcgcgctgctgagccggtccaagcccctcgccgccgcatcgccggagggtacctctccatcggcgctgccgaggggctgcagtggcgaaggacgacgacgacggaggggtggcgccggcaaaggacgacggcggaggggtggcgccggcaaaggacgacgacggcagagggacggcgctggcggaggggcgacgcggaggagtggcgccggcggagaggtcgatttgggggagagagagtacaggacgggagagggaaaagcgtgggaccatgcgtggggcccacaattggctaggctattttggctggccaaatttggccagcgcgaggagcactttggctagccagatggcttggccatccggttagccagtttgttggagcacaaaattgagttaaaattgccaaaatttaacttgaagagtgggataaggaggttgttggagatgctcttggggtgctactcggatcagtacaaccattagctatatgcccttccactctactttaattacactttgcaggaccggtcgagtgacgactgatcatgataacatgcattgcatgcgtgcccttttgatttttgcagagagagaattaatgggaagagatgatcgaatcctaccactagcgtgaataccgatcgacgcctaccactggccatggttgctactagtagcaacacacgattagaaaatgaccaactaattatgaaccactaattgtctcacatatacccactgctgatcatatccatcgatggtacgtgatgttgccggccggcccggccggccggcagttagtaggtggatatgttcgcgtaatcacatcatctcaggcttcttagtttcttcctgaagcctcttgatgatcaattaattgcaaagagaatttgcagtgtccatgaccaaagagaccggccacgagcccaggatgcatggacgcctgttcgttctttttctctctttcttttcgattgccctgtcgctatataattattgatcacttttgtttttagtgatcacttttgtttttagtgctgaaattaataattgacccattatatatttcacaaattttctctgctaatagcctagtatagttaatgtaggacttttatcatttatcatgtaatggagcattttttttatataatgctgtctcaactatttgcagtagattaattacttctttttctactgatagtataactataaatcaaccgttgcgattacttctactgatgattaattaccgtttttccaatttggactttggaatgaatcaacatatttgtctcagggaaatatatgcacttaaaaatgataactgtagatttttgctttgggaaatatatacttccatagggcaatagtattaccattcttcaaattaagctgcattttggtacacgtccaaaaaacgaacatcgttaatttatttgtggacaaaagagttactagatgccaattaatcttttgaacacttcaattttagtcaaacttaggtagatatagagatgaggttctaacttgtaagctatgtggcgaatcgatcgatcgtactgaaaagaacaataagtactccctccgtcccaaaaaaagacaaaccatggtttccgtgcccaacgtttgaccgtccgtcttatttgaaaaaaaattatgaaaaaaaattaaaaagacaagtcacgcataaaatattaattatgttttatcatctagcaacaataaaaatacgaattataaaaaaatttcatataagacggacaatcaaagttggacacggaaacccatggtttgcctttttttggacggagggagtacgtggtatagctagctagctagtggggtggtctaacacctatgattaaaagaacctcacaaagcttcattttttgccagctttttatgggcaatgttatcaggctagcatatatgctacatttgacgagttgccacgtcgatacatatgctctcttagctttatactccctccgtttctaaatatttgataccgttgactttttagcacatgtttgaccgttcgtcttattaaaaacttttgcgaaatacgtaaaactatatatatacatataagtatatttaacaatgaatcaaatgataggaaaagaattaataattacttaatttttttgaataaaatgaacggtcaaacatatttaaaaaaatcaacggcgttaaatatttagtaattaacggaggtagtatatagcgagaagatatttgcatacgtacgatcatatctgtagttaaccggtatatcattggagcttcacaattgcttttttttttcctcgctacacctttcatcacttctatgacgtacccaacttgtcataaacattcggcttaatttcacacaaattcctcaattgcttaacttttctgaaaccaaaccggcagaagaactagcaattatatatatttcaataagcatgagtaaaaaccctagacagaaaggaaattagaaaaaaaaaacttcatcctatgaaaattttgagttggattaataattcttttgtgtatgaaatttcttaagtgagaaaaatccttcaatatacaacccacactttatctggattgttcaacttcattccaatttgaaaattttcttaattcaactcaacggaaaaaagaattccaactcaaaatttggtaacatcttaagcaagaatgcacactctatgaaaactgcccagtagatagtacacagttgaacaaattggaattttgcgagcaacatctacactgtacttggctagcttggaaagttcatatgccgtatatatacctgcccaagtttgattggtgaattagacggcgatattagttgtggtatatatgcctaagtcactatatacggcgtgcacgaacagtagtctacggtgagaaggatggccacttagaaaaattcctcacttaattttcggtttatttgatttgcgtacttaaattttctaccacgaagaaatttaaagcatcttgggataaaggggcattgtcgtatgttagcatgtatattattacgcacatgtacagctgtggcatccaaataattcagttaattttctaggtgctcgatctattaatttgacatggctgtagaagcacatattatttccatagttaactgaaaaatttggatttactaatttgttattgttgctgctagaaccttttatattatattgtagaatttcaaaccatatgttagttgttaaatcgaaattctcctgaagtatgatatttatatactccctctgttctagatataaatgtcattgttttacacacgcaaaatcaacatttcaaaattctagctaataattgatcgaactaaataatatatgtatcatgcatatattcgtatttaaaaaactttttattgctattgattttctagtttctgataatatatattatgatatcagaaactagtgtattatttttctcacaacctccaacgtttatatatattatgaaatatatattgctattgatttattgctatttattttctagttttttatacactagttctatattttagaaaggaggggtatctagctacaactgaccagagcaaacatcgattagatagattcttacgcaatacaagtacacaacacaacacaacacaatacaacaaactacaatctctttcagagaaaaaatctcgaaagaggcgagagttttgggcatatatatccggaccaaagacgagatgaagcatatatacctaacattttcccatgaatgcgatgtatatatgatgccggaacgcttcttccatttcaatttgtttggccttgttcttggtcgatatgccgaccatgcatgctactgtagatcaatttggccaagatacacatataagacaatggagataatgcgtacgcgtgcacattattgtgaccaaggttaaccgtctgatcattgacttcaactagtgaagtgaagtgctctcgagaggatataccctcattttttcgttttatctaaatagttatgatttttttaaaaaaataataagatgaaataatatatcatacatcatttcacaaacatgcatggtaaaatttaagttttacaagttgtaaaataaaataaacaaatatgaatatgaatatatatgtatataagctaaagtctattatttactttgttaccacttgtattggtcaaatttgagtttatatgtttgtagaggatatatcatatactaattttttattgtcaactttttctcataactcttttggatgatacgcaagaaaatgaggatatatatccctgtcaagagtttatattccctaaatttctgcgtgtgcacttgagtcggtgatatctccttctcatttagtgtgggcaagcgcattgttttcctttttagcattcggctgagtattttactcatgttttattaataaataggacaaaaatcccgttagcttttcttttataaaaaaaaggctagagataaaccccaaaaaaaaccagagaggaaaatagaatatttttcataaggaataaatcggatgtgacaaggtttcaggagggcatattttgtgtgtgcctcttaggctgggtttagttcccaactttttcttcaaacttccaacttttctatcacatcaaaatttttctacacacataaacttttaactctttttttcaaacttttaattttggcgtgtaactaaacatacccttaaacgtttatttaggtacctctttaaacagttttggacatgtatcaatgcatcttttacttctggtagttgaagacttgaattggcatcaacaaccaaaaaaacaatgtgtacgttgttgataaatcatgcacaaagctggggaacgaaatgggtctgaccgtctgagaccaaacataccatgtgccggaggcagaggatgcattgaaaatacagggcttccattaaatcatattgaaagttcagcatggtgtcaggtctatgctatgaatgagaatgcagatagttcaggccaaacagatcccggctacccaaaaatttttcaccctgtgactaatttgtgagataaatcttttaagcctaattgctccatgatttaacaatgtggtgttacagtaaatatttgctaatgatagattaattagatgtaataaattcatctcgcggtttaccgacggattctgtaattagttttttttattagtgcctaaatacccccatacgacaccttatataatacccgatatgacacaccaaaactttacaccctggatgtaaacaccccgtcggtatgtggcaacaagagcttctccctttacaacatggaatgtctcattccatcttgtcctaaattaattagcatgcaaaaaaagcatgaggaaaacaagtcttgcccttctatattcttttccccacaacatacatagctctcgcaagattggcaattcttatccaaatatctatgtttgtaacagtagttggagccaatggtgacatcaaggccagacaggaaaaatcttttattagctaccaataattttttgtagtggtttttagcggataaccatgtcgcatgtcaacattgttgaagagccacctgaccttgtctgtccaagaggtggctccgttgcttcattatagtgtgtttcagcaaatggcaccctattaagcatgaacctcataagtcataagatcaatacaattttacttctttactgtcaatgttttaccattcatctaattcaaaaaattaataatatgctaaagtataagtactgaaagttcctttgattataaaagatggcacatcaaataaatatatatatatatatatatatatatatatattaaatacaacgaatagtttaacgctatgttaaaagttagcggcatcatctatttaacaaacaaaaagagtatatccttccacatcatctctaaatccatccaaaaaaatgtgaccattaatcctaatctaacacacaggggcgaaggtacagtcaattaccggggtcagtagaccccgatgattttattttaacctctcatatcctctttattttaccagctatgaccccggtgaaaacaaatattagaccccggtgacattaattgttgattgttgtgttaaattccaattgacaactagaaacgatactggcagcagcaaatagaaaattacctagcatttatgattatacgtcagccgaatatgcatatactttgagtttttgagatttgagaccatgcataaggccagtggctcataacttttcaaattccctagcaaaataatttctataggaaattattttaaaaaccatattaatctattgtctttcaagttttttataagctaataatgcttaattaatcatgtggtaacctcgccctattttgcgtgctgggagggaagggttcagatcccatagctaggtctgaacacacccagattgtatcagggttcaccaattcgatttaaaattagattccaaatatagcaatatggctttttttttaccaaaatttgatatttttttattaatttggtttaattttacaatttcaaatttgaattcttgaaaaactattccaaatttcactcaaaatctacttttgtcccaagttggaacatcgaaattgcgttgttttcaatccgttttgtttgaaaacatagaccatggctagtaatgaccccgacgatcatttatcctggcttcgcccctgctaacacaccaaaagattatctgagaagaagaaaaaaaggcacacaaaaggacatgtggtggctatgatcccaggatgcccaggtgcactgccatttgccaccggcctcagtggcagtggcagtgtcagttcatgttggaaaagcaaagctgtccacgcgtggcgcgccatggcgggaggaggaagacgaagacgaagcagccgcaaccctacacgcctctctcacctctcctctcctctcctctctctctatatatagctctcgtcttcttccacctctcactcactcaacccaagcaacgcgcagcacaccatcaccagccaagtgttcgacagagttcttggcgagctagaggtgtcgaacaccttcaagagaggagggatggggaaggcggcggcgatggaggtgtcggcgtcggcggcggcggaggcggggatgatggtgggtcatggggagtggcgcgacgacgacgggcgggcgcggcggatggggacggtgtggacggcgagcgcgcacatcatcacggcggtgatcggctccggcgtgctgtcgctggcgtgggcgatcgcgcagctcggctgggtggccggccccgccgtcatgctgctcttcgccttcgtcatctactacacctccacgctgctcgccgagtgctaccgctccggcgacccgtgcaccggcaagcgcaactacacctacatggacgccgtccgcgccaacctcggcggctccaaggtccgcctctgcggcgtcatccagtacgccaacctcttcggtgtcgccatcggctacaccatcgccgcctccatcagcatgctgtaatcaatcaaacaatttctttgtttcgattcggtttcgatgcaaactccattgatgatgtgattgctgatagcttagttgattcgatcgagcagggcgatcaagagggcggattgcttccacgagaaggggcacaagaacccgtgcaggagctcgagcaacccgtacatgatcctgttcggcgtcgtgcagatcgtgttctcacagatcccggatttcgatcagatatggtggctgtccatcgtcgccgccatcatgtccttcacctattcgacgattggcctctcgctcggcatcgcgcagaccgtcgccaacggcgggttcatgggcagcctcaccggcattagcgtcggcaccggcgtcacctccatgcagaaggtctggcgcagcctccaggccttcggtgacatcgcgttcgcctactcctactccatcatcctcatcgagatccaggcaagcagctcgccgccgccattgccgcatcctctgtttcttggcttcttctatttcttgtgtcctaacagaacagagcgttgttgtgtgtgatgtcatgtcaggacacgatcaaggcgccgccgccatcggaggcgaaggtgatgaagcgcgcgacgatggtgagcgtggcgacgacgacggtgttctacatgctgtgcgggtgcatggggtacgcggcgttcggggacaagtcgccggacaacctgctcaccgggttcggcttctacgagccgttctggctgctcgacgtcgccaacgctgccatcgtcgtgcacctcgtcggcgcctaccaggtgttcgtccagccgatcttcgcgttcgtcgagcggtgggcggcggcgaggtggccggacggcggcttcatctcccgggagctccgcgtgggccccttctcgctcagcgtgttccgcctgacatggcgcacggcgttcgtctgcgccaccaccgtcgtgtccatgctcctcccgttcttcggcgacgtggtggggctcctcggcgccgtctcgttctggccgctcaccgtctacttccccgtcgagatgtacatcgcgcagcgcggcgtgcggcgagggagcgcgcggtggctctgcctcaaggtcctcagcgccgcctgcctcgtcgtctccgtcgccgccgccgccggctccatcgccgacgtggtcgacgcgctcaaggtgtaccggccgttcagcgggtagagagaatgtgagatcgatcggtgaccgtccgatcgaagtagtactagcactagcaaacatgtgtacgtcgtatgggcagcagagcaacactgccgttgccaggtggggcccaggtgtgagataaaaaagaacgaggtaaacaaaaaattatttactgagctttgtgtggtgttttgtcatgtaacaccttgtagattcttgtattatgagtttgattgggataacaaggctttaatggttagtgaagcacagcttactgtacgtctctgttttttttttctcccttcgattttgctattattgtgtttagttccaaataagctaagctaagcttactagtaccagtattaaacggttgaatatttcagtgatattcaagaagtggtaagcaaatgactgcgtatgcaaatacatttgtctgatgaaaatgacttttttaaatggaatttttgttaaaatggtcaatttttttcgatctatgtacttagtgttaattaataattgttatattaagataaataagattgttatatcttaagatcaagattttgttgtgatatctatttctctcaattgtgatgttaacagaagataatttggttatgagaaattggagggagtattatttatatatctatatttcactggaaaagtccacatgcatgtgatatgtcattcggaagatgaaaatgaaatctatacatggcgcaatgtgcttcagtgtgttgtgcactgttgtaaatatattgtgacgttcgaggctactgatatgatggttgaaacttgtatttgtacatttgatgttgtgattgtcagtgagaccattggtggagcttacactacaatttttttccagggatattgcattattacatatacattatccaggtactttgtacaaaagagcaagcacatcacactagcaatgtaaacatactaaaacgaggtgaggcattagcgcatgattaattgagtataaactattttaaacttcaaaattggattaatatgattttttaaagcaactttcgtgtataatttttttttaaaaaaatactccgtttaatagttcagg

SEQ ID NO: 64364 - DNA, 31640 bp, Oryza sativa
cgaaagagctggaaaagggggcaatcaaaatggcttagactatgggtacgtactgcatgcagtactgtatacatagctggtcctgcagtatatgagatgccgtcctatgataacaaatactctctctttcccaaaatataaacatttttaaaatagtgacaagttaaaccttttaaattttgactataaatagcaaaagaaatttaaaagattaatcgtataaatttaatgttactatatttatcattaaacaaattatcataatatacaactctttatttaaaatattttactttagtagatattgttggttaaagtagtatttcggagaatatgtcgagacaaaaaaaaatacttatattttgggtagagggagtaagttttttttttagggtatgttgattggttattatgctcttaaaaaacatagcattgaccatcgaatacttacaagtaggtttctgcttctgtaaactttcttttaaaggaataaacattactctgctcctatatgaatcttaaagcacatgtcgggtttaggtagagtaactaacctggattaaactaaaacaatcaaactatcaaaggaagattcccctaatgcagtcttcaatatattcatgtgcaattgttttcttaaaaaccacatcattcttgcataaccgaagtcaaagtggtcagtaaataatagcagctcctaataggacatgcattttgtttatgttcgtatacgtagtaagcctgttccaattattaatagaccactgccctgtttatgctattgtaacaagcaaatggtaagtatccaattggtgaaattttggaaaagatagttttctttagtttctagcttctatgcttattaatttctaaattctacacctactaaatcttaaaatgtggtgcgagaattttttttaaaaaccgaagccagcttaagttggaattatattaaggaggagagaaagtattaaccttaacaatatcaccaagaaatgtgaaagaaatcagaggaggcgaggaaaaaaaacacaaattagaactacacactaaacaaaaacttaagcggatattctcgcgatgtcttttgctctacacatgctacatagcttaatttcgtcttatattttggtaagtagctgcgacatggttttttcttgacttggtgcaagaatttggacgtttcagaagtgttgtatattcttaaatttgttgcggctatttttttaataaaaaacagtagaataggctagctcctaattattgcagctaccaaaagctcttcaaccagattctgtgacggtgcccattaaattaaacttaactaaattaagaagaagcaggcatagacgggatcgaattacagggatgcatggggggccaaaagagcagatggatgggacggagtgagctactactactaatcaacttgaggagggtaaaggcagcaatcgagcgaaagccgaaagccgaaagatcagcagcggccagcaaggcagcaccagcagcagctgctgctaaaagccgggaagcgagcagcgccttctccttcgaggagtccaagaaagagcccaaaagccgcaacggcaacggcaaaacgcgatgaaaccaacggtgcgcgcgcacgagcgagtcgtcctgcatttctgatctgcgccggcgctggaggggctggatcgacctgcgacactttacagcgcatgcagagacgacggcagaagcagcctcttcgcatcgcttgcttttcgccaacaaccacgacgatgataacaacaacatcagcggctagcagcaacgtgtcaattgttttttttctttaaagaaacacagtacaaacgaagatgctcataacacacgtatattcaatcttgtaaacacacgtatacaaaattattgttacggaattatggacatgttgttttcagggggcaatccccttcggttcgatcatgtctgcaccgctgcatcaatgagatggcgctttggacggagaatctgaaaattgagggtcggaatgtaatctctacttgtaaaaacatcttctcctcccctctaagatctctaaatatgatgtaatgaaaccttttcgtttctaatgtcataacatgatttaccccccccccccctccttctggtgacttagtaaaaaaaaacatatgtataccctgcctctctagacaccttcgaaagatttggaccggcacatttaatctatagtgctacagctttcgtactcgatctactaggcacttggcttctccatgatcacaaggcatcatcggtgcatcgccatcagaatcatctccgaattgaccaccactgcagcgcattaggcaccattctctacagtgcacacgaaatcgaccaccactacaccaccctaagaaagaaaaggaaaaaagaaaactcaagtatgtatcatctaattaatgtgtgtaggtgcatccgttcatgcatgtacagtgcacgacggcacacggcattatcagagaaattatacgggtgcagtgcagcagagatatgcaaagtgttactgtcatatgatggagctagagtatatgggcctgtttgaggagctttaaattctgagaagtagttgtttgttagtcagcttctgagaatctggaaaagctcttaaacccagcttctctagcttatggcttcttagtttatttttcaaaatctgtaactatatattctcagaagctgtgaactgtttggggcagcatctagcagaagccgcttttgagaaaagctacagctgagacatgctccctcaaacagggctatatatcgatggaagaaagggtcacgggcacaaaatatagggtgataggcacgcaccaccgaatggatggacggacgcgtgcgtgcgagcgagaggcggtcgcccgtccatcggtttctccgagtttgttaatagcagccgatcgacgagacgacgacgcgccaaaggcccaaaccgcatgtgacccctggggcacacacatgacacaaggacgcgtgcttggtacggtgaattggtgatcatcgcgtcgtctcgtcatcaactaacaaaaaacctggcatcacgtgactgtgcgaagcaactttttgggaggatcacattagttctttttttctttcttgaaagaaaagagggggtcatatgattgaagaactggagcattcgttaatttcgaaagtgtgtagaagaacgcatatacatgaaataatcgatcgtgtacgtggctgcactgaatgtctgcagttaatttgctgagcccacggtcaaattaactcgcgaacacgcatgcgtgcgtgcacaatgtgcagcttatgcgcgcattcatggtgcttgtgcatatttctgggcgagaggaagcaacggtaatcagtgtacgcgtgtggttcatgatgagccatgcacgcacgcacgcattcatagtcacagtcccacgccgtcggccgcgcgcgcgtgccggcggttgtcggtggcgggtggggaagggaagggaaggcaacgtgactgacgaccaaatcaccgaacgatgagtctttttttttcgcgaacgtaaaaggattacatgtcaatatattagcaccgaaaaatgagtcaccaaccaaacaattggggaggatcgtacggtcattgccgttgttgcctcacacatgtggagggaggggaagtcgcagccaccatcacccggaaacactaatgcgcgatcaatcgctaccgcgatggggtaacgatcaccacccctccccccctccctccctccacgttttcttttttggcaccgcattacttttctattttagtaaatttacacacctaaagtttatacgcctaaagtttatatacccaaaatttataaatcaaaagtttatatatccgattcaaatttaaatttgaattcaaatattttttatagtatttctatacatctaaagtttatacacctaaagttgtagacccaaagtttataaatcaaaagtttatatacccgacttcaaatttgaatcgggtatataaactttaggtctataaattttaggtgtataaactttagatgtatagaaatactatatataaaaaaaaaatttgaattcaaattcaaatttgaatcggatatataaacttttgacttataaatttttggtctctaaactttagatgtgtaaacttgaggtgtataaatttactaaaataggaaagtaatgcggtgccaaaaatgaaaaccaggtggagggagggagggggaggagggggggggctaccgatcgctaccagatcggtagggcgatcgatcgcccattagaactaggaataagtctatttttcctccctcatctattgcccttggtcgaaaaacatccctcaaacgcaaaaccggatataacacctcccccatcttcgaaaaccggtgcaaatcgacttcttgagtggttttgagtggtttaggctgatgtggcaggttgacttgattcaaatgtgctgatgtggcagccaggtcatcaaagggattaaaaatagaagtgggtcccacgtgtaagtgacaaatgctaaaataaaacaaatggtggggcccactcgtcagccccattttttcttatcttcttcctccctcctctctctttctcgcagccgcacgcgcggaggccaattcggccgcgcggcggcgcccttctcatcccagtgagcttctccttcgcgcccagccggccgcagcctcccggcgagctcctccaacacacgcgactagccgtggcctcccggcgagctcctcccccgtgcccggctggccgcggcctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcacttggatcttctgaactcttatccttgcgaacgcgatcttccgaaacgatgggaactacacgctggcatgcaaaacgaggaaaaactctaataaaaaccaagaaaacagtacataaaaagtaaaccaacatgtagagctcaattttagatgaattttgcaagttgaatggctcaattcgtaattcgaatgaattagatatgaattttagaagttttgggccatttaaatgaatttttagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgcaaggcggaggggtgggttggctcgccgaccaacccgaccagacggcggcgcgcggccggacggccaccggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatggggctcgagcagagggaggcggcagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcgccgcggcgcggggacgtcgacagtggcggcagcggccggctggagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcggggtggaggaggtgggcggaaacggccgcgtcgtggggcggctcgggcggccatggcagcaacggcagctgccggcctgaggttggggatgacaggtggggtccacgggttccatctgtcggagagagagggagggagaggccggctggggaggcaaaacagacttgagggagagagagagagccgagcgggccgagggagaaggccggcccgagagggagataggggggaattgggccgaaaggggcccaaagagaggagggaggattttattttttttctttttattttaattgatgcaatgatctttgtgctattaaaactatttctcgagctccgaaaattcacggaaaattccggagagtacattagggcacaaagaatattacaaaatatttccggccaatgatttttaaaggaaaatttcaaattctcccattatttcacttgattaaattgatttaacttttatttaatttctagaaaatgtattattaattgatttttattcccgaacgaaaatcggggcgttgcctcccggcgagctcctcccccgctcccggtcggctgcgacctcccggcgagctcctccctcgtgcccgcccggccacgacctcccggctgcaacgccatcttctccacgagaccatggagccccgttgctcacgtcgcccatcggggacgaagatggccatggagcccgtcggtcccgccgcccagtggctcctgccgctccgccgggctcccgcggtctcgccgcctagcggctcctgccgcccccgccgccccgccgctcccatcgctccgccaggctcccgcggtctcgccgccccgtcgctcctgccgctcccgccgagctcccgccgtcccgtcgctcgcgccatctggtcggatgggaggtggttcattcgttcatggacgtcttccatgtcaccgaccgcctcggttgcaagctcaccaacgacagcgtcatcacctacatcgagcaggttggtgggttttcttggtggtttcttgattctggcacgagtgttcgacggagttgggattttctgatggcatacatggcttctttgcagtctctggggatgtggaacgggccaacgcggccgatggcgctcgaggggttgacggcgctggagctgacaggggccgaccggacggggctcatctcggaggtgttcgtcgtgctcgccgacatggactgtggcgttgtggagggccgcacgtggacgcaccgcgtccacctcggctgcctcatcttcctccgcgacgaggaaaccgacaccgagaggatggcatgaatcgaggccgcctcggacacctcctccgcggcgactccagcagcgccggtggcggcgctgtggccgctgtccccacccccgccgtcacgcacgccgagcgccgcctccacgttggacaaaaccacctccgaaaccaccgagggagatgatttgctctggtttttagagaagaaggaggtgttatacccggtttgttatacccggttttccgattgagggatgttattcacacaagcgcaggagatgagggaggtaaaatggacctattccttagaactacccaccatcaccgccaattccaccgtgcggccgtgcctgatccaccaatcttcgctgcctgacacgcccatcgacggcccaggctgtctgtccgtcacttcacattcggcccagtttctgtcactcccgttcggctaagcccatgcaaaatggcccggcgttacaggggcctagtacgtgctgatgaccaagtaatttgagccaggggtttgcagtattgatgaactcaaaaaagggccttaaattccattactctatccattcaaaatggtataacaaagcacaagaggattaaggtgcaatagggtaggatgtctttgtggtgtctctatacgggtgagtatacgcatgtgtatacgagagtctttgtcgcaaagagaaaagtaaaattattgttgctacttacccttgtcccaaaataaatggatgcgtagcatataaaaaacaatattgtggagaaaaaccaaaatgctcctaattattggaaagttgtattggacctcgttcagatgggatgatatatctgagatatctcctgctatctagtaggtattagctgatatctagatatcacgtgatatctctaaggtatcatttcgtccaaacaagatatcgccctataacacttttattttttttttcctttcgaccgtgattaacgcttcatgtgaggaggccatgtgaggtatgtcgcggaaaggccgtggggagccaagacccaatctctcacggcctgctagctgccaggcccatccaaacacttgtataccccagctagatacctatttagaaaaagaacggaaaggaaaaagtctactttaacttttttaaaagtacgccgaatctaattcgtaccctttaagcagaaaaccgggtaggatgactccctcaactattaaaactggtataatttgactccctcagcgattttggagggcggtttcgttgacgtggcattttgacttggtccaaccggctgactcagcatgtgggacccacatgtcaatgtcacattttcctcttctctatttcttttctcattttcccctctttttctccatggtgttgggcggtggctggcggcgacgtcttctctgcacccgtgtcgctgccactggtggagtacgccgagcgcgccacacgggacggcgtatccgtgaatttcaacgcactgcagctcatcggtgatggcgggagaggaggtaaccttcgtgtcggagtgaggcggcgccgggagggggggcgggggctgttcctgtgtcggccggggtccgagcgggctgagccgctgccgacggtggggagactgttccatgaccgcccctcggcagctgcagggcgtttgggtgtaccgcaccaccgcttcgtctccaagccaacccgccgcagctccccctctaggccaggccaccgccactccgctcaagaccggggcaacgctgcgcgtcaggaggtctagccaccgcttcgcctcgaggccacagcatcgattcgccttgggccatgtcgttgctccgcttccgagccaggttgccgcctgtcatgcccagaaattcacgaaccataatttctaagctgaatgtgcattaaacccctgtccaggaccagccagggtacacaaacgacaattgttgacatacagatccacgtcttacaaaaatataaaagattacagatgcagcggaaaagataaaagcgagataagcctaaagacttgactcctgtagcggggcgattccattccacaagcatccttgacggcagcgacgaaaccaacttcttcgagacatttccaactgagaagaacttcaactctggtgtgggggaaaagagagcaagactgaataccacccactgtactcagcaagtcgtaccggaagaggaggtatgatgcaggatatatccaaaggaggctaaaggtccttttgcataaagctagcatttaaaagcagtagttgaaagcagtaaaacagttgcagtaattaatcaatgttaaccaatcaatgtccaacgctacactacgttgtaacaggcccaaccaaccacctgaactacaccagttcattagctaactaggggtgggactaatcacggtgaatctggtcgaccgcccataaccgcgggcacagctattcgaatagttttactctgatcagaggtgtacaattgtacccacaagacacagccccacgacacgtttccgtgcgccgacatgccactacgacataccggaaagaggccgtgacaggacccttcgcataaccccctctaaccgatcgcaccacacctcagggttcgcccccgttcccagcaggcaacgggcagccccccctcgtgccgcggtgaatccggaagccgatcaaccggacaccccggccgacccaactccatcacgcccaccctcgcctgggtacgtcggctaaaggaaagctacactacaagcccagccgttgcccacgctggcttgtggtaagtacggtaagttcttccagggcatcccgcgaaccggtccttaatcgccatgggcacgactagcaaaaccatgcacccacagcccaccatgtagtgtattttaattaaccaacaccattgcggtggcactaatccaaagctatgccaataatcaaagtctatgctttaatgtaatcccccttttgtgtactagttgaactaagcatggctaagcatttcctaaaccaacatctagtcattttaatacccaagttatcaatggcataaggtaaacaatatatggctgagtaatagggcccatcccacatgatattgtaaaatagtgcaacatttaatagaaatgcgggacatttgtaaattgggtataatatgatcaattgtaatgcatgacttgccttgctcttgcactgatgagaccacaacaacgtcttcgaggaatcgcggatcgacgaaacggccgaaatctatgcgacaaacaaagcacacaagcaaaacatgctataagtccactgaaacaggaaacaaaaccatttttaatggattctatgcatttttatgaatttactgagacttgaatggacttaatcggagctcggataaattagatatgaattttagaagattatctgtgtttttactaataaagaaaaagccttaatgtatttattgcgcaatatgtcccagggctgacgtcacccaagggagggggtggtgccgacatgcgggccccacgggccagcggcacaaagagagggagagggggtggttggctggcgggccccactggcagtggcacaaggcgggagggcgcgtggctggtggctcggctcggctttaaagcctgccggccaagcgtggcgagcggcggcggcacgcgcggtcaccggctacggcaaccggcggcaaccgatggcaagcggcggcgcgcgacggcaccaccgctagcggcggcaccgcagcggcacggcaccacgacgcgacggcggcgcgcaagcggtgagcggcggtgagagaggagaggaaggggagggcctcaccgacgatgaacgaggggggcgagcaacggacctagggaacatgatgagagaggttagagggagagagggagtccagggcgcatggcatagccggccggaggcgatggtaatggagatgctcaccggcgcttggggagaagcgggctccggcggtggacttcgacggaggagggatggactaggtagcccttgacctcatgaggccaacggcggcaatggagtggcgcggcgacggcactagcgacggctagcggcggttggagacagcggtaggcggcggcgcgtgggagcggcagtatggcagcaacacgtggcaagtgagcagtggctgagatagcccccgtagcggcgaagctagcggcggcgagcgcacgccggcgcttggggagaagcgggctccggcggcggacttcgacagaggagggatggactaggtagcccttgacctcacgaggccaacggcggcaatggagtggcgcggcgacggcactagcgacggctagcggcggttggagatagcggtaggcggcggcgcgtgggagcggcagtatggcagcagcacgtggcaagcgagcagtggctgagatagcccccgcagcggcgaagctagcggcggcgagcgcacggcgtggtgatggctttagcaacggcggcgtgcgaccggagctcggcggcgagtggcggcactagcagcgaacggcgcggcggcgttagagagcgtgggagagcgcggcgaaaaggggaaatgggagaggaggacgtgtggttgctttttatatgcgcggggagggcggacacggctgggaggtggccggatttctcgccgacgtcggggatggagagagagagtggggggattcgaattaaatcccgcccttgcaggcgcacgcgcgtgggcgggagaaggcggggcgtgggggcggcgacgtgggggcgtggagcgcggagtgggcgcgggaggagcgggggaagcggtggcgtggggaggtgggggcgccggcagttggagctcggctccaatcggctggaggtaggggaagggctgacaggcgggccccacctgtcagtgcctgagagggagagggaggccgggtgaacttcaggagagggagggaggagcgggccggcgcgggaagaaatgggccggcggcccaagaaggaaaaaggagggaaaaagaaaacagaaaagggaaaaaggattttctcagggattaaatattgcactttgcttattttaattggttaaaattatttccaaggctttgaaattttcactaaaaatcctgttagcatattttgacatgtagaatccaagaaaaaatccacatgccgattccgattattatttacatttattaatttgatgaattagctctaggttaaattaaatcatttcttcggacgatttattttatgaattttaaagcaaggaggggaacttcagggcgtgacaccgccgctctgtttgatggcgggcctgctcctcgtccctgctcatctgcagctgtacctaggtggtccaagctagagggagtcggtggcatgccaccaccgccgctgccttctcatcgtcgtcatcctcgcctcgagcctcggcttcgggtcatcggcgcgcttgctgctgccgctgttgtggtcgtcgccgccgccaccacctacgagggagatcggcatcgcatcgcggatgagtggtgaaagcctgaaaatgggagatgggattcgagaggcgaggcgcacaccgggagggttcttctgcttcctagtctctgcctccatcaccgtctcccgcaatgacgatcctgtgatgtccgtcccatgtggcggtgctcggcgtactccaccagtggcagtggcacgggaggtcgggcgcagaaaagacgtcgctgccaggcgctagccaccgtgcaacgccctgaagaaagagaggggaaaacgagaaaagaaagagagaagaggaaaatgtgacattgacatgtggggtccatatgctgagtcagccggttggaccgggtcaaagcgccacgtcaacaaaaccgtccttcaaaaccactgagggagtcaaattataatggttttaatagttgagggagtcatcctaccctgttttctaattaaagggtactccctccatttcacaatgtaaatcattctaccatttcccatattcgtattgatgttaataaatctatataaatacacatgtctagattcattaacatcaatataaatgtgggaaatactagaatgacttacattgtgaaacagatgaagtacgaattagattcggcatactttaagggagttaaagtggacttttcctttccgctttctccgatggaggatctatcgcgacgcgaattcttcgcccatctcttcgtgccacacgtcgaaaaattgaaggaccaacgtttgaaccaatcagcaggcgctagaagcccgaattaaatttgaaaatatactttgattcgtttatttctcaaaaatattcggaatgcaaatttattagcagaaatataccgtcgatctcacacaattatttcacgaaagtgacgtgggagtgatgttgtgaacagtctcgcgtgaggagagcgcgagaccgcacggtatcgcatgatcatagcacgagaccgctcggtctcgcacgacgaaatcgaggacgtacacggcggcggcgtcagaccacgcggtctcgcgcggccaaaccgcgagaccgagcagtctcgctcagcgatagcgactgcctctgccgattgaataaggttaattagtgattaattaatcgctaattggaataattaatcactaattattgttaattaatcattaattatggtaattaatgactaattaagcagctccgttggacatgacattcggtctcgctgatttcttatgcgagactgttcggtctcgctgcttcatcacgcgataccgtgcggtctcgtgctcctactgtgtgacactggtatattttcgctaaaaagtatacatcacgaatatttctgcgaaaaaaccaaatcaatagtatatttttaaatttaattcctagaagccccaactttagatttttagatttatgcacacgatgcacgagtgcaattactatattacgttcaatcgagaataagcgaaactgtagcaccagatatgattctgttataccttcatggatagtacgtgcttaggctgaatgcttgtgttgagagctcactactagtttcaaattatctatagtcaatgtaatagccaattcatacgatagttgcttactatactattaatatatggtccacatatcatacacccattgcgtcttggagtccgtgctacagctggctacagatctgtagcccgctacttttctatatcttcttttatctctttaaaatatgtttatagctggcttatagcctgctattgtacatgctctgattggtatatagacacatgatgctcccatgcttgtgcagttgtgtaagcagtcgatcgagcaaagcgtacgtgtaagcagccatggctcaattgggtcaactcgacgccgagagcaacgtcgtcgtcgcccctaccgctaccggagacgagggagccgacatcgtcctcgcgtcgcttccgactagggaaggatggtggacggcgttcgtcctctaccacggctgctggatgacgccgcaggccgcgacgagcgtgtcgctggtgcgcgcccagttcgcgccgcgccccgacgacgtgctcctcgccacctacccaaagtgcggcaccacctggctcaaggcgctctccttcgacatcgccaaccgctcccgccaccccgtcgccggcgccggcgaccacccgctgctcacgacccacccgcaggacctcgtgccgttcatcgagacgccattccgccacctccaccctctctctgccctcgacgcgctcccgtcaccgaggcttctctccacccacctgccgcaccagctcctccccccgcgtgtcgccgagctcggctgccgcatcgtctacctctgccgggagcccaaggacgtcgtcgtctccacatggcacttcatgaacaaggtaggcaatggcttcttcctcgacctcgacgaggccttcgagctgttcgtcgatggctgttccctctacgggccgatctgggatcactgcctacacggtgctcttcctcaagtacgacgacatgatggccgacccggccggccacgtcaagaaactcgccgagttcctccgcgtcccgttcactgacgaggaggtcggcaccggcgtcgtcgtggaggttgtgaggctgtgcagcttcgagaagctgagccgcctgccggtgaacttctccggggtggttgatcggatcggcggacgaccgatggagaactcgtcgttttttaggaaggcgaaggttggagactggaagaacaacttgactcaagagatggcgcagaagcttgatgccgttattgcggagaagctgaaaggatctggtctcaccttctgagtatggggattcgtgcttgctttttatgcatgcattgctcctgtaaaagtagaacagtaatcttcagctgtaactgagttgtgtccaattatgtacgtgcacgctcgtacaggagttggaaaccatgtactgtgtattgatttcctcgtggacacattttatcccttcctccccatttattcctttctcttttgtattcctattcctcctcgcattcttggcaacggtggcgggcactcccgcccatccacgggaaaacggcagcggcctcgtgacaatgaaggagaagaggatggaaccaacgagtttgatgagttcgccagcccgtccgcgggaatgaaaaccgcttggagaaaaatatgacctgctcggaagttctatatgcaggtgataggaatcggatggatgagattgccatgcattcttttgatcacaccatgattgatgcacaaatccatatgaacaattcaaggcagaggggaaatagggagcaaattaacatcgatcactatattcattgatggtacgttgaaacgtaccgatactttgctaacatatactccatatgttccataatataaaggattttaaagagatatgacacattgtaatagggagtagctatatttatggcgccatattttaacaaaaaaatagtcagtatgtatttacattgtaagtttataaattacatatgtaattttagtgtatttacaatgtaagtctcaaaattacatatgtaattttagtgtatttacaatataagtctcaaaattatatatgtaagtcccaaaattacataagtaaattaagaaattacatatatgtaactagtatataatcatcactcatcattatgtatgtgtggaaataatcttcttctgcctcacggaagcacagttgggaggcctcaggcctgtgctgttgtgtggcataggcatgcatgcaaaccgactgtaatcaatggaattttacggtgccataaatttagcaaatctgttgtaatattataaatctagacagtggtatcatatctctttaaaatctcttatattttaggacaaagtgagtgctttaaaaaaacagagggagctagctaccctatataaaatattcatgcacacgatgcacgagtgcaattacttattacattcaatcgagaataaccgaaattgtaccaccatgatatgattcttaattttatagcttcatcgatacgtgttttaggctggatatgcttgtgttgattggtaaagacacaggataatatatatatatatatatatatatatatatatatatatatatatatgcttcctgcttcatgcttgtgcagttgtgttatttgttgctccaaaccactaagctcactcgtgtcagccgagcaaaacttaagcagccatggctgaaggtcgtcagctcgaagcccagagcgtcgtcgtccctacagccaccggagacaagggagacgacatcctctcgtcgcttccgacgagggaaggatggtggacgacgttcgtcctctacgacggctgctggatggaccggcaggcagcgatgagcgtgtcgctggttcgtgcccagttcgtgccacgcgacgacgacgtgctcctcgccacctacccaaagtgcggcaccacctggctcaaggcgctctccttcgccatcgccaaccgccaccgccaccccgtcgtcagtgccggccaccaccccttgctcacccaaagcccgcatgacctcgtgccgttcatcgagctgcccttccgccatatccacccgctcgcggcggccctcgatgcgatcccctccccgaggctgctgggcacccatatgccgcaccatctgcttcccccgcgcatcggttgccgcatcgtctacctgtgtcgagagcccaaggacgtcgtcatctccacgtggcacttcatgaacaaggtaatagaaggattctccattgatttcgacaaggccttcgagctgtttgtcgatgggtgctcccccttcgggccgatctggaaccactacctaggttactggaacaagcacgtcgaggagcccgacagagttctcttcctcaagtacgacgacatgatggccgacccggccggccacgtcaagaagctcgccgagttcctccgcgtcccgttcaccgacgatgaggtcgacgccggcgtcgtcgaggaggtggtgaggctgtgcagcttcgagaagctgagccgcctaccggtgaactcctctgtggtggctggtcgggtcggcgtcgacgagcggccaatgaagaactcggtgttttttaggaagggtaaagtgcgggactggaagaactacttgaccgaagagatggccaagaaattagatgccgctatcgaggagaagctgaaaggatctggtctcaccttatgattagcttaatctaatatcgttatgttgtttcttttaatgtatgctctcggtgtgtcttgtgtacaagtacaataatcttcacaatgccttgtaattatgctatgtccaattgtatgcaccattgtacaagagttggaaatattatattcctgcaataaaatgtgatctttctttgtgttctttttgtaggaaacctcaaaaaagggcatgagctctcacaatttcactatgtaagaagagagttgatccagtttatgaggaaaaccggatctaaaactcttacaacaacacggttttataaggaaaactggcgaaaactctgacattgtcatagtaagctatccacatggaccaaacaaactaagcttaagaccaactatctaacaagggaaattcctaagatgaagcttcaaaatgaaccaagtccataggacaacaacaacgtccgatccataaagaatctaaggttctcacgcggagagagacccctaagctagaggaaggccctatagcaacgcttccaagaaagtgaacggttcccaagagcatcatagtcgctagctctggcaagccgagcaaggctttcgccccaggattacatccaaccaccaaaaccacgaggaaagctacacaatatcgtctgcacacctaaaaccaccttcacagccaatgtccttgcctcgaagtccaaacaccgcaaagccatagctagccaccacaccacagaacaatgctcctcacgattggaaggggaggagccttatgcacaagcggtctgggcacaagcggcaacgcttggcccgacaccaagcaccgaccggccagccatgctgccacctgtacctgcaccgcatggaggacgaccgggcatagttggaaatatcggcagagagatgacaacaccgccagacagccacgctcccgagcgaccattttgttgccaccgcctcaagggatctaggcctcttgcgtcggatcctcgctgggggaacaccagatctggacgttggggtgctagattcagctgcccccctcgccgctgcctgccggtccgctgccaaacgcactgtcgagctcttgctctccttcacctaccccgccgctagcaagtctcgccactggaaccggtcgggatgtctggatctggccggtgcagcgctccccccgctgcatcgatgcccctcacgctgtcacgtcatttagggagaaagagaaccccaccaccgccgtccttgcagcctgccggtaagccaacctgtttaggcggcggcgaggtgggcgtgaggagggaggggagcggtggctggtggatgggcgcagttcgcgtcgcccctaggactggagcgacccggacgggagactggactagcgagctaggacgacggcgcttggtgtggtgcgttctttcgccatctggacggccggtggtggctggagataggaggcagcgtcccggaacaaatgtcagccactatctgccagacctttcagggctctaactccagcttaccgtgcagtagaatgaacgtcagttcttggtccttcttcatacttccaagctgcataaacgtcacaaatagaacagcacacttgttattttcgtactacagtcacagttttgtgttagtgcaacaactatgtcagccaattgagctgacaaatgaagcatacaaaatagtgtgtaagctcattaaagaggggatattttctgttaaatacttttacagagctgagccatcaagttgcaaaacaatgggttccaattcaaaagggatctggaaatataaaatttcagcagggatcaaagttctcatttggttacttatgaaaagtagcatcttgacaaaagataacctcttgagaagaagatggaaaaagcaaagaacaaaaaagtgctagcttttgttccgcggatgaaactgttatacacatgtttgtgaaatgccaacttgctaatttcttatggaatggcatgtatagatggccgaataggtcgcccggtctgggccgaggttagtcgggctggcacaacatgccgggatgcgtcgtgctagcccacgggctgcacacatggcccaataagactcgggtcgtgccgggtcggcccgaagacatggcagccgattgtgcttctccatagaataagtatattttttctccatcaactctttgggctgtgtcttatatagctgaaaataagtccattttatatccctcatctctttgggcctttgccttatatgattcattaagtctattttggatccctcaactattttcttctattgtgccggaccggaccggcccaccgtgccaaagcattggcccaggcacgacacaactgtcaggccggaccgtgccgtgcttgagccgggccatcgggtgggccttatggccatcaataatggcatgtactttaatttgaagaaaatgaggtcggctggtgacggcagcttcaacagcggcgagctgagaacgcccatgggtggctgacttggctggttctcgtggccgattggagttgatggaaggggtagaaagaaatcgtggcggagtggcaaggtttgaattttacaaaatttcagtagcacacacccgatattgttaatagcaatgacattttttaaaaaaatcggtaaatttgtaatggcatggatctaattaactatatttttatgccgaattttagttatttctaaattatatttctacttgaactcttttttatctttttgtccgatgaatgtgagaaaattaatctaacctccatagtaaacatggtgcctcatttcaagagggaatgcggtgcctaattgcaaggttgttttaatataatagatagatgaataatatccatcatatctttggttgatggttacatagcttcaataagaatgatacgaaattggtggtgattgggatagctctgctatcactagaagagataccatcatctcaatcgggcggtaaaccccatctcaatcgggcacggcgtccgtcacaggctagaagtcacagatgtgaagagttatttcaatcgggcaaacggccgtcacggataaatctatctcaatcgggccctaattaaagggcgtcaccgatagctttgacccagacgaccagtcaaactatagcccgtcacggatgaacaactacgcccgtcacagatgacccttatctttacccacgcggggatgaatctatctcaatcgggccctaattaaagggcgtcaccgatagctttgacccagacgaccagtcaaactatagctcgtcacggatgaacaactacgcccgtcacagatgacccttatctttacccacgtggggatgaatctatctcaatcgggccctaattaaagggcgtcaccgatagctttgacccagacgaccagtcaaactatagcccgtcacggatgaacaactacgcccgtcacagatggcccttatctttacccacgcgggaagttcaaacttcccggtcggtcacccactatagcccgtcacggatgaacaactacgcccgtcacagatgatccttatctttaggtcaagcacgcttaacattaaagttctttagagattagcttccagaaaagtagttataacttgttggtataagtattctattaatcctattaagccctaggccaggatgtcaaattggggttattaaatgatttcaaatggaaaagtcaccaaaaccaaagttgtagaactcatcgaggtgcaaaatttttattttggtcatttctccatctgacgctatttaaacaatttgaaatttgaaattcaaagtttgaaaagttcaaatagaattttagatcagtgaacgacttcaactgaaaaagtcatcaacaacaaagttgtataactcatcaagatctataatttttattttggtcatttttctatataacattttttgaaccgtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgacaaagtgatagtaacattgttcacaaaattgatatatctcttatctggttttataaactacaacattgttcacaaagaacgaggaacgacgctgaccccagatcgtttcgtcggtgttatcgacatcggttcttccgaaccgtcagtcctgcatctactcgaggactacgactcctcgtcaacaagtacgccacgtgaggtattggctatcgacgggacaggcacatcggcacgcgctaataccggggcggaaaatcagacgtctacaccggctcagcacatcaggaccctcaacgcaatactgagggagaccccttatgaccccgttctacacgatgacctcgcacaatggacggaacggttacgggagtcagtgaccaacctcagcaacgagttcgaacaggccgccgctgcaacccacccggaacagcaaccaactactggtgccaatggcgaaaaccccgaacagcgggaatcaccccatcgagccagccctccacctcgcggcaccagcgatctccgcgatcacctaaacggtcgccgagaagctcgtcgcacatgggaaaacgagaaccgttcccggcatcacgtttcttcacgacatcacgacaatgaagaacgaggaggccgctcgaacgaagaccaagaccgtgatcaccgccacaaccgtcatattcgcgacgatcgtgagcgacggacgccgggcgataccagtcgaggacgccgccatcatgacgaagacgacagagaacggcgccgggacaacaacggagggcgacgacaggattctcgagaacccagccggcattctcgtaatcctacaccggaaccaagcgacccatcgtcgtccttatcttcttcctcctcctcatcgtcagacagacatccacgaaggacatacgatcgccgacaacccaccgcccctagtgctgggtgtagggctttcggtcgttcgttgcgcgatgtccgatggcctgagaggttccgaccgggggcaatagaaaagtacgatgggagcactgacccagaagaatttcttcaagtctactccatagtactctatgctgccagagcggacgacaacgcgttggcgaattatttgccaactgcgttaaaaggctctgcgcgttcatggttgatgcaccttccgccctacttgatttcttcgtgggcagacctatggcagctgttcgtcgccaacttccagggaacctacaaacgccacgcgatcgaagacgacttacacgcattggcacagagctcgggtgaatccttgagggaatatgttcggcgctttaatgagtgcagaaatacaatccccgaaatcaccgatgcttctgtaattcgcgccttcaagtccggtgttagagatcgctacactacccaggagttagcaacgagacgcatcacaactattggagactgttcgagattgttgactgacgtgcccacgttgacgatgcacttagacgcaagaacgacaagccgaagaccgagggcgagaagaaatcagccacggacacacctgagtcaagcaaaaagaaaaatcgcaagaacgcgaaaaggaaagctcaagcagaagtactcgcagcagaatatgctaaccctcccaagcgcccaaacccacaaggtagtgacgcaaggaaagcatggttcccatacacaagtcgaacagacattctttggaagactgccttgtttccaaaaaatcgctcgagaagcacatgacatcggaacaaggcaaacgagtacgcgtggtcgagaaggatacggagatgaccgctcaggagtcggacccagcgtatccagactctaacctccacgtctcacacattttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaatctcctcttcgccagcacattggacgccatgggaataccacgaagcgagttgacagccaccgatcaacccttccatggaattactccccagtcttcgtccaaaccaatgggaaaaatcacgctgcctgtgactttcggccaagcaaacaacttccggacagagtagttcaactttgatgtcgctgaattcgatacagcgtatagcaccatcatcgggagaactgcacttgcgaagttcatggccgcatctcactacgcgtattaagtgctcaagatgccagggccgaagggaacaatcaccatccaagggaacgcaaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgacatgccgggcgtccccagggaggtgatcgagcacaaactcatggtgcgacccgatgccaagccagtaaagcaaagactgcggagatttgcaccagaccgaagacaagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggcgtgccccaaggatcacttccctcttccttgaatagaccaactggtggactcaacagccggctgtgagatgctgagcttcctcgacgcttactccggctaccaccaaatcagcatggcgagagaggacgaagagaagacatcattcatcacgccgttcggggtatttttctacgttaagatgccatttggactcataaccgctgggaacactttccagcgcacggtccagggcgcacttagtgaccagctcggcaacaacgtcgaggcatatgtcgacgacattgttgtcaagaccaagaaaagcgactcattgattgacgatctacgggaaacgttcgacaacctccgacgatatcacctcatgctcaatccagagaagtgcacctgcggagtaccgtcgggcaagctactcggcttcctcatctctggcagaggaatagaagcgaatcccgagaagatcaaggcaatcgagaacatgaagtcgcccacaagactcaaggaagtacaaaagctaatcagatgcacggcagcactaagcagattcgtcgctaggatgggagaacgaggacaacccttcttcgctttgctgaagaagcaagataaatttgtatggacacaggaagccgaagaggcatttattgcactcaagcgctacctatcagatccccctgtactcgttgctccccaacctaatgaagaattattcatttatattgccgccacgccatactccgtcaacactgtaattgtcgtcgagagagagaatgtccaatgaccagtatattatgccagcgaagctctccacgacgcaaaaccagatatccacagatccaaaaactgctctacgcagtaatcatgacatcaagaaagctacgacactacttccaagcccacagagtcacagttgtctcctccttccccctcggtgaagtcgtgagaaacaaagacgttgtcggccgcattgcgaaatgggtagtcgagctaagtcagtttgatgtccactttgtaccacgaacagccatctagtaggaaatcgtccatctatgacgttttgctcatgacgttgtataatttcgtcattgaatacaacatatctatgacgaaatttcatgtttcgtcatggatcactcatggcggagggtagacatcgaaactccatgacgaaatttaaaatggtgtcataaaacaatagataatttcgtcacaaaatggtgcgcaccattcatgtaacacacttatgacgctcctttattaatacaatatgctgaaatatatttcgtcagttgtaagtaaatctctattctgctgttgttggtcccaccttgcatatgtggctatctaggttgtcactggaccccacattgtatacgtggctatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccttggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccacgacttgtgactaaccataattctagcttaaccactacgctgcaaggagctttcatgctgatgatgttttacttttagttttcctttcaattctcgaacacaagaatgattgaatgctttatgcgggcgacctagtggtttggtcaaggagggaggggggcggtggcgcagggtttggtcatagccagggagggagggtggcggcggcgcaggcggagctcagtggggacggatcctagccaccgggacggtgcagaggaggaggtttcttatcccaccggtgcagggaagggcggctccacaggctggccggcatcgtgatgtggagcatcgtggtgggtggcggcgcggtgaagtgatcttggtcggtggggctgcagagggatcccggtcggcgcgggggatcctcgacgactgagacggatcggctgctcctcgcccaccgtcttatcctagcacctcctctctcaatcctgtcgtcagcgcgcacagcccatcaccaacgccgttcagtagatataaggtatgattttccataagtacattactctgagtatgaaatgcaagttcagctatgaaagattatgctttgtgttgtatgaatagagaaacaagtcagagtgttatgaacaaatcaacatggtttaagtcatgtagcaaccagctgttccatctaatgttttagaaaatattctgtcctaaaaaatggattagctttgtttgcctaattgctttttttaacatgccaaagcagatggacagaacttggatacatgggagacaattcacacctgcatacatggagggagtgaaacagttcatggaatttgttggacaaagatttgatgaacacgttgacataccatgcccatgctgtaggtgtcttaaccacacttcactgcctcagcaagaaatgcatgaccatatacatatttttgggatgtcatcaacatacacccggtggatttatcatggagaattagttgatacagaagatgtcgaatatttggaacaggtacatgaaactaaccataatgaagggacagatgtgggcgggtatgaacccgaggatgacaatggagttccagagttaataggtgaactatacactgcggcagaggaagatggacagccaccaaggtttgctagaattcttgaagatgcgaagcaggcactttgcccaggatctaaccattcaagattttcctttcttgtgaggctgctccatatcaagtcatattatcgaatcagcaatacagctttcactgaattattgaagttgttgtcctcggcattccctcaatgtcaattaccaaaatcttatgatgaggcaaagaaatatcttcgtgaattgggccttggatatgtgtcgatccatgtgtgcaagaataattgtgtgctatttcggaaggaatatgccaatatggatctatgcccaatatgtggtgaatccagatgggaagatggggttggcgacaggaaggttcctcgcaaagttttgaggcattttccacttatcccaaggttaaagaggatatttgcatcaaaacgaacagctgaagacacacagtggcacaaaatcaagcggaagccagtggataatgaaatgagccatgcagcagatggggaggcttggaaggacttcgacagaaagtatcgaactttcgcagaagatgcaaggaatatgaggcttgccatagctacagatggattcaatccatttggcaaggtgagcaattcgtatagcatgtggcctgtccttgttatgcctttgaatctaccaccatgggaatctgttgatccatcgaactgcattatgtcattactgatcccaggtccaacatctccaggaaaggattttgatttattcttggagcctctgatagaagaattgcttgaattatggataggtgttagtacttatgatgcattcagtgctagaaagttcaatcttcgtgccgccgtgctatggtgcatacatgattatccagctctaagcaccttgtcagggcgaactacaaaaggttattatgcatgcattcattgtgacaaaaatccgttgtcacgagcaccaagaaataagataggctacttggccaccgtcgtttccttccaaggacacacgcttggcgaagaagccatgcttttgatggacaccatgaaaaccaggttgagccaggaaaattcagcacagatgaggtcctcgagcagttagagaaggtgaaagatgttagaccgggtaagcatgatacaagtaagaaaagaaaacgtggagaggatgaagggccactaatttatagccgcaaagtaagtctgtggaagctcccatattggaaagatttgttgctgccacataatcttgatgtgatgcacattgagaaaaacatatgtgacaacattttgggcacattgctcaaaatcgagggcaagacaaaggacacagtcaattcgaggatagatttgcatgatatgaacataagacataacttgcacttacagcaggatggcaactcagttcgcatcccacaagctcgctatgtcttgaagaaggaacaaagaattgagttttgtaacttcctcaaaggtgtcaagtatccacatggatatgcagccaacctagcaagatgcataagttcagatggttccaaggtgcaggggctcaaaactcatgactgccatgtccttctccaaagaatcatacctgccggcataagaggatttgtggacaaggatatatacgaagcaattgcagagcttggtaacttcttcagggaattgtgtagtagaaatctaaggatagatgtcctcaaacgactgaaaaaagacatcccgctgatcctatgcaaacttgagaaaatttttcctccagccttctttgacgtgatggtgcacttggccgtacatctacctgatgaggcactacttagaggtcctgtacaatatggatggatgtacccaatagaaagacgacttggcacctttaagaattccatgcggaacagggctaggcctgaaggatcaattgctgagacctatgtagcaagtgacaccttgacattttgttcaaggtacatggaggatgttgacactagatttaatcgggacgcccgtcatggggatgggccattggatggtaacagctctgtttttatgcatggtgttaaactcataggatccactaggatacagtacatggaggatgaaatcatggataagctagtttggtatgtgctaaataactgtgaggaggttcaaccatatttggagtaagcaccatttatgtaggtttatttcacatgtattgtattaaatataatattttcctaattg

SEQ ID NO: 64365 - DNA, 16556 bp, Oryza sativa
ttatgctttgtgtggtgttttgtcatgtaacaccttgtagattcttgtattatgagtttgattgggataacaaggctttaatggttagtgaagcacagcttactgtacgtctctgttttttttttctcccttcgattttgctattattgtgtttagttccaaataagctaagctaagcttactagtaccagtattaaacggttgaatatttcagtgatattcaagaagtggtaagcaaatgactgcgtatgcaaatacatttgtctgatgaaaatgacttttttaaatggaatttttgttaaaatggtcaatttttttcgatctatgtacttagtgttaattaataattgttatattaagataaataagattgttatatcttaagatcaagattttgttgtgatatctatttctctcaattgtgatgttaacagaagataatttggttatgagaaattggagggagtattatttatatatctatatttcactggaaaagtccacatgcatgtgatatgtcattcggaagatgaaaatgaaatctatacatggcgcaatgtgcttcagtgtgttgtgcactgttgtaaatatattgtgacgttcgaggctactgatatgatggttgaaacttgtatttgtacatttgatgttgtgattgtcagtgagaccattggtggagcttacactacaatttttttccagggatattgcattattacatatacattatccaggtactttgtacaaaagagcaagcacatcacactagcaatgtaaacatactaaaacgaggtgaggcattagcgcatgattaattgagtataaactattttaaacttcaaaattggattaatatgattttttaaagcaactttcgtgtataatttttttttaaaaaaatactccgtttaatagttcaggaagcgtaaaacgaaacaaactttcttccaatctcctggtgccgaacgcagcctaaggctgagtccgttttagcgtttaggttgagatttttagaagtacgtgaaacaagacattctattaacacatgcatgattaatcgaatattaattattacaaactaaaaatgaatagatttattagttttttagaaaacttatatatatatatatatatatatatatatatatatatatatattttgcacgacatagtttaatagtttgaaaagcatgcttgcagaggttattctgaaaagctgtatagaacactttactgtttatttgatcctgcagtgattttctagacaagtctagagatgtacaagcatcacatcattacaccatggacacacaccaataatttggagaggaatatcttcatgatctgtgaagtggtgcatccactgttggtggattatgataactgatagagctccattagttcatacaagcctcttttctgttctccccaaaaaggagatagttgagggacgggcaaaatgaagataggattggatttcatgtgcatatatgcatgcatccaagggtaggagggcccaaggggtgtacatggcagtgtttaccagggccatagggtgttgctttctttgattttggcaggtgaattaaggctgtttttggccagggatcttggcaggtaccaaaaagaatggctcacaaaggattggaatctttggcactcctgtttgttagatcctctttctcttgcaatcttgctatcatatgatgggctggtttactttgctcagatttatgattggaagttgatgtttgttgggagctagattttttgcaagttaataccgtagagtatggggttctagatgaagtgctgtttggggccttatgttggcatgatgcttttttggttcagtataaaaaatcaacacttcctcaatcctcatgcatatgaacattgtgcatggatcacatctctataacttaatacaattgatattaatacttgtatggctttagataatagaaacgtttgcatcttcagcctttgtcattaagcacagaaccagtaagttttaatcaatttgataaaacaaaagacatactgacgtgtaattcttctgcgcgttcgtggaaataaaaaaaagacataagaagctgagacaaatccagccacaacatcttataaatgataacttgctgaattaacgataattttttttatagatgccatgtaaagtggaataaaagattataataattgtttgattgattgtataagacaatgaagttgatgcgggctaccattagagaatatatcctatgcacacaagcttcccgtgcacactccgtgcacaccaactatcaaatggcatagaaaattctaaaaaaaaattgaacacacacttccaatagtattgcacctacgtgtgaaatgctatcttaaaattcattatattttagctgtaacaaaaaaagataaaattttgacagatttttacccttaaaactattagatttttcactttttttgatagggataaaatacaataaatttgaatatgagactttacatatatgtgttatactattaggagtaaatgcccatttttttatataatttttcgtgacatttgctagttggtgtgcacgggaaagttacgtgcataggatgttcccgttaccattaagctaataagaataagatgtctgactttttttcaaccaacttttcttcctagaagagagaagcagctagtaactcagtaattgtaacaaaaagaaccaaattaaaccatatatagtaagttgtttttacaacaagaatgagtgagtaatgcacggcaatggtgttttcacaggaaaattaggttgaaaagttgaaagtagcaggcacatattctgtacattcttttcttaaacttgcgcgcacagttaagtccctttccacccaaagaaagaaatcaacaaatattccttttcttttgctgggaaatcaacaaataccgggataagaatatatacggagtgatctacatttgcagacaagttatatatattcttcactcaatgcagtacacatacatcaccagatgagatcaggagggtttacgcttttttttcccatgaaaatcgtgaaattttgattttcttttttgacaccacatgaaattaaagtagattcgaagtgaaatttcaaatggttttcgagaatgcaaatttcaaacaataaaaagttgatcaaactttgctgtaatttgacgaaaaatgtcataccgtttgaggttgaaatccaacactcaatcgaaaagatgaaccctgatcagaggtagtggagtatttgcacagagaagcaggcttgcacgcatgcatgggtagcccatactgtttaaccgagagagatcgatgtgttttaatttaattttgctatctattgactggagcatctgtattctgaaagttgctgcattattgctaccctggatatattctattctactgttgaagtatttcagataagagtagttttttagataagagtagttatccagaaaatgttagacattgtggtccataaacactacagtaaattgttcgatttgagtccacgacaacgaaataaagtatggctgtacatgtatggtcaggattactgaacaagaatggggcagccatatccattaagctaggcttggtatgtttgatgttgagtttatacaccagtgttaagacatgaagttagcacacattaatactatgggctaatttgaaatagattatttgctagattattactacggattaattatctacttgattataggaatagattaaatattttaataaataaacttaacagagatatcttagaataagtggtctgagcaagttttttttttttttttttttttttacaaaacatactttatagatgtggagcaaataatctgtgttaataatatggtgaagtagctgaaaagaaatataaaaagtatagcatctctcgatacattttcaaaggttttatggatgaaaaattaaatatctgccatcaaaataatgtagtctacaaacagttcaagacagtatattatatttgaccatttgtgtatgacactgtcctatccatcatctatgagatcatcacttccaccttctcagaatacaaacaagattacttcaacttttcaagtcatacttccaaaaatacaaaaaaggtgtaggacaaatcttaattcaagatgaactgttcattcgcattttgctttgaaactgcaataggttgcaccctttcttttcatcatttccttgcagtttcagtgtaccaagcagggggcttatatctgcattcatgcataggcgcaagaccatatcaaattcatccaaattctttgctatcctccaatttgaatcgatctgtacatggagtcatcgaatttaattccgccctcatcaccttcatttgcgtcttgaataactctaattaacactgcaacaagaaagagtatcatcatcattcaacaacaaaatttgatctgatgattatctatcaaaacacaaattcaacaatacttgagacatatcgagagataccaaaatttttggtgcaaatttggtatgtcttaccatcagagatattaagaggtatcaaattttatattaaaaaatagagaaattttatggtccttaaaaaaatacctcgaggtacctaaatttcatactaaatttttttatacatcaagctacttagtatatagaggtaccaaattttacactaaaaaacatgggtactttttaaggatggtaaaatttcacggaaaaaaaatatggtacctcctgtaaatcctgaaaatcactcctatcaaaataaagcccttgttaaaatccaaactttttcttcaaacttctaattttttcatcacatcaaaactttcctacacatgtaaacttttaacttttccatcacatcgtttcaatttcaaccaaacttccaattttagcgtgaactaaacacacccaaaggaaacacccacaagagtcaggggagtctcatcccaaaataaatgtggccacgatcttgaaaaatgcgaaaaaaaattcagtataattaggacggtttgcttacagtgagtttcaggagtcggcgcacgagcgcatgctgccggtggccgccggcgccacggcggcggagcccatggcctgccggtcggcggcgcgcctccggacacaccggtacgagcacgtggcgacccagaacgcccacgggagcgcgacgagcgccagcccgacggcggggagccagtgcggcgcctcgtgcggcggcagcaccacgtagccggcgaggcacccgccgccggcgagcacggagaggagtagcagcgtcgtcaccatccacacgcacgcgctcccgcccggccgctcctccccctcctgcatcggcggcgccatcggcggcggcggcgaaagaggatcacggcactaggcggcgacggcggcctcggcggcggcgcgggtcaagaacaaggacgaggcggcgtgcatggcaatggtggcgccaatcgcctctctctctggatttgtgttcttgttcttgttcttgttcttggattttgattgattgaaaaaaaatgtgccaaaaaagttttgatattgttatgttgtttgggttttgtggatcttggaggaggagaaacaacggtgacccaaatttgaagcagaggtgcagaggaaattgcggggagttaataatagcttggtaataaaattccatttaaaaaactaaagcagcgtgtcctaattccatgcagaaacatgcaaaaactggcaaagataacaaaacatgcaaaatctgtagaataccaggtagctttatatggtattcacattaagattaaggctctttttagagggacatttaattattccctctttagaaagatgtaactttacaggattttcgtagaaatttgttcagttcttgcaaagttcttttgaaaatcttccaatccaaaggaggccagaagtgttcaccggctgtgcattctcagtttttggggggaatatgttggggcactgaacttccgaaaaacaaatctactgaaacaaactttaagttcaaacataaagtttaggaaagatatcccatgataatagatttctgaaggttgtgttgctcactttaaattgcttaggtatggttttcatcatctgtgcaatcaaatatagaaaaaaaataaaattcgagaattttcaaaaaaaatggggtaaatattacgttccactgcagagtaggctgttcatgatctgaacttctgaagatacaaacatataaaaacagtcaacttaacagtgctttacatttacacaaactcccctgcacaatccacaccaaaccagaagcagaaagaaatacaaaaccaaaactaaaaaacaaaaacaaatttgctcatccaaattgcacacaaagcagccacaacacatgagcaggttgatgagatcacacacacagagagagtgagatgacgtcagcccagaacgctgtaaagatcgccattgttgccgtagaagccatcgccgcccttgtccttggtgctcttcctcttggagaagatgatgtcgccgatgagaggcacgatgggcttcaccttcctcgccttcctcctcctcccgaccagctcgccgtcgtccacctcgccgaggctcaacgcgtggctgaacgacggcaggtactcgcacgacgtcgcgcgcgacacggccgcgccgacggcgtcgacgccggcccaccgttcgctcctgaacgtcgccaccgtcgacgacacgtcggtctcgccgccaacgctgcgccgcgccgccgctgccgtgtcgccggcctccatctccgccagcttcgagaggccgcggtggagctgcgcgttgagcgacgccacggccatctccatctcgctcccccgcttcttcagctgcgccacctcctgcctcgtctccgccacctccgcctccagcttcttgactgaccgcatcatcgccaccgtcaccccctcgtcgaccacgccgccgtcgcgctcgtcgtcggcgtcgccgccgtcgttcggcggcggcggcgacgactgcggcgaggacggtgccgagtacatcatcggcacgacggccggcgctgcatcctcctccacctcaggctcagcttccatggcatccggagaagaaacagtagcatcatcactatcgccgctagcttcatgcttggcaatggcgatgtcaacaacggcagcagcagcagcattgccgttgctgggtcgccgggagtagccgtcgccgacgaggatgcgctcgccgaagacggcgacggcctccctgacggaccggaaagggcgtgccgtgtcgacctcgacacggtcggtggccatggcgatggagaagcacagcaattaagcagcaacacgaggatcgatcgatcgatcgaacgttcttggctgcaagcaacatgcacgatcgcttggaggattatatgaaggggcgaagatcagtggatcatcgcttggctgcaggtagtttctttgcttccacttcagtagcacactggccaaccagcaactagtttcccaatagcaacaagcaagaggagtgacttgccaccaaaaagaagtcagataaaactcccaagctaacctcatctgtatgtaggagtggagctgaagcagggatgctttctgaccactcttggcaagcatgcaacgcaggcagggtatgcagcatgctattcataattccgatgctggataaaaatcactcatggtaagtgtactgattaaccgaaaaggcgaaaacaactgataaaattcagataaatcttatcaaaattttaaaattcagttttgaacatgactccagggttttcgattatgcgctctcttcggtctcactggctctgcagtccatccgctcgtaaggtcatctgtggcctttaatgggtattgctgcttttggagatttcttgggagtgtactgtggttttgcccctttcctccaatcggagttgtgtatagccaccgtatttttttcttcttagctacaatttttgttttgctttttcttccttccctcggtataagccgctctggctgattgcattgtgtaacaaaaactcttttccctctaatatattgacgtgcaattcttttactcgttcgcaaaaataaacatgaccatcaaatcgagtgtctatggtttcaacccgatccgaaaagtctgtattttacgaaatttggtccggtttccaccggattgtaaatcctattaacagcagcatgaagcataacagaacagaaattctggtgtcatgggggtggttgggagaaatcatagttttttcagttggggcatgcagttcttggagtggacaagatagggaccttgtaacaaacagcccttgttgttaaggcgattggggacataattctaagatggaaaaccacaaatgtgtattggtaggaaagtaacacaaaaaacataagcaaatcaaatcacacaaagcaaaacctagtccttctatgatcttttacagattataagtcgtttttactttggtcaaaataaaactgattattagtcttttttactttggtcaaaataaaactgctttaagtttaatcaaatttgtagaaaaaaaaaagcagtaacaattttaacccaagacaaatatattatgaaaatatactcaattatcgatttagcgaaattaatttgatgtttacatattgctatatttatcaacaaactgagccaaactcaaaatagtttgacttttatcaaaaccaaaacgacttagaaattactccctccgtcccattataagagcaaccataagtttccgcgcccaactttgatcgttcgtcttatttgaaatttttttataattagtattttcgttgttatgagatgataaaacatgaatagtactttactcgtgacttatgtttttaaatttttttcaaaaatttttcaaataagacagacggtcaaagttggacgcggaaaaccatggctgcacttataatgggacggaggtagtagaatctaaaacgaagggagtatattactacttgaactattcccaccagtcaagaatatatagagcatattattatttgggggctgctatataccggtatcccgttgggatactgtcccaacgggatcgctcccagtccacctccctcagatgcgagagcgcaggcccccatgggagcagcgcagacgaggctgacgccggtggcgcagacgcggcggccgccgccgagctccggcgtgaaggacgcggctgcctgcgacgagctccagcgtggaggacgcggccgccggcgagctccgacgtggggcatggtcgcatgaacggcggagaatcctgcgtggtgacagagacggcgccgtcgacgagctccggcgtggggcgtggacggcggaggatcctgcgtggtggtggtggcggcaccggcgacgagctccggtgtggaggacgcagccaccgctgaggcgtggacgacagacacggccgctggtgacgagctcccgacggaggacgcggtcgccggcgacgagctccgataccgtggacgggggaggatgcggctgccggtgacgaggttcgggttcagtacggagcgtcgacgggggaggacgcggccgccggcgacgatgcctcgacacctcgacgcccagctcctggtatctagtaggtatcatatgaatatgatacctcataagtatcacccccgatacatcgtagaaatcacatgatacatgatagctatcacatgatacctcacgagtatcgtctgatacgtgataggaatcgtccgatatctgatacgtggtagaatcgcatgatacctggtaggtatcatccgataccagctagttattaggtgatacctgtaaggtatcatacgattcttaccacatagaagatgatagttgcgaggtatcaagtgatacttgagtaggatcatgttaaacctgggaggtatcatgatcctccttagtatcatgtccggtttcaccaggtttcataggtgatactttgggaggatcatgtgatacctgggaggtatcatgatcctcatctgtatcatgtctggtatcatcaggtttcacaaatgatatcctaggaggatcacatgatcctcctcgaaagtatcattacgtgtgatacctgtgcagtaccgcatggccctacttaggtatcatgtctagtaacaagattctatgggtttcacaaatgatactttagtaagatcgtgtgatacttgcgtttctaccacatatcagatgatacttgcgaggtatcggatgatacctatcaggtatcatgcgattcttaccacgttgtggatgatgcttgcgatgtatcaggtcctgatacctaccaggtatccatgcgattctaccacatatcaggtgatacttaagaggtatcagatgatacctatcaagtatcatgtgattcttacaatgtagaagatgatacctatcaggtatcatgcgattcttaccacgtagaagatgatacctatcatgtatcatgcgattcttaccacgtagaagatgattctaccacactccacagccagccataaccaagttagcaagttcttttcaccccatcttgtctctttgctcccccgaagcagtagatggataggatgaaggcccggactcgcagcgggatcaacggccggcgacgaaggcgccgaccggagagggcccgcgacagagttggggcgccggcggagggcgcaccggccggccacgcggatggagccggaggtgggcgttaacggcggcgccgtggatggcggacggcggtgctggagctccaggcggcaatccggcgaccacatcgctggcagccacgtcctccgccgtcgctccctacgccgggctcgtcgccgcagccacgtcctccgccgtccgtgcctcacgccacgctgaagctcgtcgccgaagtccgcgatgccgggggatcgttgggggtggccgcgtcggagctcgtcgccggcgaccgcgacctccgtcatccacacccatgccacaccggagctcgtcattgacttagttgcagcagcacgcatgagagagatgtggtagaaagaatagctagatagaagaagagtggattggttggtgtctatcctatcccgtcgggacggtataccggtgtttagcatttccgtattatttactctattgagtaaattacattgctgatacacaaatttggattcagacggcagtggcactccggaacgatctcctacgtgcgcggacagctcacccatgacccatctacttaaacgtgctcatcgatgtttcaccccgcgtgatctgaactgagaagcgccgtcgtgtgaccaatggcgcgccccgcacgccgaccccgccccgtcgccatggccactcctcgccggagcgcccgactagccgctcagaggacgacgacaccgccagccgcggcgccgccgagaagggtgcgcaatcggcggcgggagttccgccactaggagaaccaggcgatggtgacgaaatacgtggcgctgcacctggtggtgctcgtcgacgccggccccggcaccggcaagagcagccagatcccgcgcctgctccacgccgccggccacggctgcgtcgtctgccccagatgtaccgcctcgccgccgtgctcgcggcgacttgcgccgcggccgacatgcgcgcctagctcggacgccaggtggggtactccgtccccctcgacgaccgctcctcggacgccgacacggtcgtcaagtacatcacgcacggcgcgctcctccgcgatctcgccgccgacccgctcctcacccgctacggtgctgtcgtggtggacgacgcgcacgacgggatggcgatcacaggtgtcgtgctcagctgcgtcaaggccgcggcggcgcgccgcctggaccttcgggtcgtcgtctgcctgaaccactacagcaccctctgcaagggcgttgtacacggcttcttctccggctccggcatggacggcaaagaactctggttccgtacctactccggtctaatcgaccaacattacctcccggagccggtgacagactacctcggcgcggccgtcgacgcggtgtgccgcatccacacgacggagccgccgggcgacttgctggtcttcctcccgggctgcacggacgtcgaggcagccgagcacgcactcaacgggctgtgcgctgctggggctagctacatgctgcttacacgacggcctcccgatgcaccggatccacgacgtgttccggccggcggccgacggcaggcggaaggtagtgctagccaccgacgtcgccgtctgctcggtgttcgtcgatggaatcaagtacatcgtcgactccggctactgcggaacggacaacgcccccgtacatctgatcggcggcggcggctcggcggcggcgcgcctggttcgaggcctgaaagcggtcgtccataaatggtgccacataaggcgtaaggtgaatgagtcgccgaagatgtgcccgacggggacgttcttctgcctgtgtacacgagagaggaggagaaggggtttccatacgtgtggaatccggcgaacaagatggcggatgtcaacgccctcgtcggcgtcatcctcacgctcaaggcgctcggctcgtcggcgccggaggtgacgacgtcgtggccagcttcgacttcttcgagccgccgcatgcatagttgattcattgggccgtgaggacgctcaaggcggccggggtgctgagccaggacggcgaggtgaccgagaccgggaggcgaattgcgcgggagatttcgggaagatattactaagcgaattcaaacatccgtgcgagccactgaaccgtgggcttgacaggactaaactagtcatcaacctttattttttttaataactataataaatgctcccaacagatgaagtctattttaatcctattattgttatatggtttagttacttaagatgaaattcactgtgggaattcacatgaatatatattttaatcttattattgttatatggtttagttacttaacatgaaattcactgtggaagttctataaaatcatgagcgaatccgattgtctcaaattagcatgcaagtttttttaaacagatttcttatatgattccttctatattaccaaagtgaagatcttaaaaaccgactcaaatacagatatgtatttcaaaaaccaaacgaacttaaaaactgactcatacacgaatgacgtatcaaaaaaccagcaaaaccatcttcaatttttataatagtagagaagagatatagattaaaaccaaaaaataaaattaaaaccgactcaaacacgaatgacgaactgcgaaaacatcttcaatttttataaccgactcaaacacggatgacgaaccgcaaaaacatcttcaatttttatagtagtagagaagagatgggatgaagcattccagtctttgctcaagagctatagccaattattacaaggttcacacaaaagtaaactcacatagtgagtatgtagccaaagtaataaaaccaaacaaggtaaagatcccacgactactgaattctattggtgaatctccatccgaagttgtcaaagagctgcatgatcatcgactcaagtttacgacacacatcttttattagcttgatataatcatcatgccgttttagttgagcccattcccggagctaatgtgttgtcctgaaaagaacatgcaaataagattttgaaggtgatctatcaaaaaccatttcatttttacttaagctagaggagactaacatacagcgaaagctccaacaagaataagttccttgatctttttattaccacctacaagccaattcccaaacatgtgagatatactatgtggatggtataatccaaactcgaattgtatagatctccaaagaaatccggcaaaatggcaatccaggaaatgatggtaaattgattcttttttcataaaaaaacatctcaaactaccacccaattcctcttagccaaattgttttttttgttaaaacaacaagattccatataaatatatcatcctcctctgttaagttaacatgcacaattgaagcacacaaattgtgccatctaatcaagttttgaccaactaattatcacggaacagtactcaaaacacttgtaacttagcagtttttccttctaactatagaatatgatgatgggtatttgtcctttacagaagaattacctaatcaattatcctccgagaatctaacttgttcaccattattgataaaccaggaactcatatttagaaaagaacttttaaccttcatcaatcctgacaaaaaatgggaatccccttgttccgctcaacttagttatagatttagtaccaagatatttccttttcaaaagatcttgccacacacagtgttcatttattaatttaaacaaccacttacttagtaaacactggttttggatttctaaattatgaataccaagtccccgttgatctttatgctgacaaataacatcccatcttgtcaacctatattattttttatgttcatcaccttgccaaaagaaacgggatctataataatcaatttttcgaagaacccttttaggaatctcaaaaaacgaaatcataaacataactaaacttgataacactgagttaatcaaaaccaatcgcccacctacagacatatgtttacccttccaactactaagttttttctcaattctttgctcaattgttaactaatctttattacaaagctttctaaaatgcataggaataccaagatatctaacatgaaaatctcccagtttgcacccaaaaatatttgaatattgctcatgacattcctttgcttgtccaaagcaaaataattcactcttgtgaaaatttatcttcaggccaaataacttttcaaaagcagttaaaatcaatttcatatttttagctttctgtaaatcatgctctaaaaaatgatagtattatcagcatattgtaagatagataaaccatcatcaactagatgtgggaccactccagaaatttaaccataatcttttgctctctttattatatagctaacatcaataactatattaaaaagaattggagataacgggtcccgttgccttaaacccttatatgtttaaaattttgatcccacttggtcattcactttaatgccaacctgtccaccttggataaaagacgcaatcaaatcacaccatttttgtgagaaaccattcattcttaaagtttgttgaacaaaagaccattttactttatcataagctttctcaaaatcaatcttaaaaagtacaccactctttttttcggtgcaattaatgtatcgtttcatgaagaataacaacaccctccataatattcctcccaggtataaaagccgtatgtgtggggctaataaccttctgagccactatagaaattctatttgtagcaactttagtaaaaattttgaaaccgatattaagtaaacaaataggcctatattgttaaattttgaaagcctctttgcacttgggtagtaaaattatagtgccaaagtttagagactaaagatgttaattaccactatgaaaatcattaaataaatcaaccaaatcgggcttaataacattccagaaaacctgataaaactcagctggaaatccatccggacccggagctttattatgctccatttgaaaaatcgcatctttaatttcctcctcagaaaaatcttgtactaaagcattattttctaattgagaaacctggggaatattacttatttggctttcatctaacgttaaagaaaaagcttcacgagggccaaaaaagatctttataataagtggtgatacatgcctttaaatttgcatcaccattaattaccaatcaccatcctgtagctgattaagtccttgttttcctatgcttaccatttgctaccaaacgaaaatatttagtattcgagtccccttccaaaatatctttagtattaactcgctgataccatttaatttgcttttcacttagcaaataggataacctattcctcaaataaagtatagaatcaagctctgagttaacaaagttgattctccatttttatccagaaaaacaagactttttctctttgtaataaaggccactagtctgtttggcccaacctcttaaaaattgtgttaatctacgaatcttagcctgccaacgctctaaatgagtataatcatcaacaacacttaaccaaatttgcttaaccataactacaaaaccatctcttaacagccaacctaactcaaataaggctacacaacgctaatatttttagtttattttatctgatttttcaacattattgttgacattcttatacagatatattttaattactagtcaagtgtaattgatagtaacctttatctctttctctcgtacaactatacattattttaattatgttttattcatgaagtatctttcaaaaaaaaaagtttcatgaagttgatatacactatattataacacgtaaaatgatc

SEQ ID NO: 64366 - DNA, 16300 bp, Oryza sativa
ttgacattcttatacagatatattttaattactagtcaagtgtaattgatagtaacctttatctcttcctctcgtacaactatacattattttaattatgttttattcatgaagtatctttcaaaaaaaaagttccatgaagttgatatacactatatcataacagtaaaaatgatcaagataaaattgcctagctagcatgttaatatatcactattcaaatttgcagtaacagagaaaccagaataccaaatcactgaaccggtgcaaaataccaaattactgaactagtgcaaaataccaagtcactgaacgagtgcaacattcgtaaggccatacattaatgacttggccaaagagttatactacgtaatgcaattaactataccgtactgcagaagaaagaaacaatcaacaataccacaacttaactttgtctgtaggaactctacaatatccattaacaacatcagaaatcactttcattcttcagagaactttttaggacctccgttagaacactgtataacaacttatgcctctctagttgaatttctaaattatttattttaacttcagcttcattcttcagtaagtcttgtacctaaacttcaagctgatgaagcaaagattcctgtcctggacgagatgcctgttctgatcctgaagaaaatgcactctccagctgtcctattacataagcaacaaacccatcctgcttctgctttggaggcttcattttgatttcagattctttcttccaatgcagtaactcttgtacctgaatttaaagctgaagaagcaaatatgcttgccctgaaccagaagcaattgcactctccggctgcccagtaataaaagcaataggcctaggcctttctagctatctcccccttctggttcgagaccttcattttaatttaatcaaatattttttaaagttttctctaaacttttcacatttttcacaaccgagaagcattataaacgaaggtaccataatgaatgtatgtggttgttgtgattgtgggtagctcgcttaactgtatcacttaaatcttgatctaaagcatgcttttcaaattcacgggctgacagtacatgcaatagaatttataaaatcacgggttgcctttcgaattcacattaataggtagaaggagaagataatggcttatgctaggcaaaatgcaaattaaaagttttaattggaagaaacaacaataccttctgatagaactcacagttctgagaacaataataagccattttatgaatttgaccagtgagcaacacctgcaacaacaaaaaaaaaaacaaaccataattagtgaatacaatggatttggatttcatacaagtaaataaagtgataataagtcataccgggccatctctctttttcttataggcaatttctactccttcgagatatccagtctcaagcatatctttcacatttttaatctgtccctccacataagtcatcccctcctcctcctctgtaattccagcaataagtctctctttctcacttacagtagtcagctcccctttctcagttgtgacagcaggcataccctcctcagcagcacttgcatcctcagtttcagcagccatcagcttctctttcacagctgtgacagcagacagaccctcgtcagcagcattcgcatcctcagtttcagcggccatcagcttctctttcacagctgtgacagcaggcagacccttgtcagcagcattcgcatcctcagttttagcggccatcagcttctctttcacagctgtgacagcaggtagaccctcgtcagcagcactcacatcctcagtttcagcggccatcagcttctctttcacagttctgacagcaggcagaccctcctatcagaacgcaaatgacgcatcctctgcacggcgcgttctcgtcctcgcatctctcatcagtgggccccgcgctcgactttttgagcgaggttctcgatccttcgctaggaaccgaagaagctagtgaagctatgggcccaccaacttttttcaacacataggacgaagtaacgctccacgtagacgaaggaacgcccactgtgaagggcctaagcaacactcgcatcctcattttcagcagccatcggcttctgtttcttaggtgtgacagcaggcagaccctccttagtagtcgtcgccattccatactccacagtcatctctaccgcactgtagcaatttagtggcgtttcagaactctctaagtgttatggaaatatatataaatagagattattttttacatagaaaacccttatgagagtatactacaggcgcgctgactgacaatgaccactatatattgaggattcgattaaaaatgcaagaaaacaatgcgttgtcgcacccttccagtgtggcttacgagagatatataaattggataaaacctagtagtgctaataggaaaagacctgaaatctactagcaaactaatctaaccactaggaaacaaattcaaatatattgcatgctgaaattcagatcacgtatttaacacaaagcatataaaaaaatggtagaaactgacatgctttgatcagtaactttgacattgtaccctcagagctatagctggcatgcgcatttcacatataagaaaagaacagagctaattgcactgtaaaaataataccttgctgttacaagaccacatatctcaattcctattagcactaactatagatggccatgtgggccgcccggcacggcacggcccaggcccggccgtgcctgggccaaggcttgtcgggccggcacggcccgaccgacacatcgggctgtgccgtgccagcccacgtgccgcactcatggcccaggcatggcccaacacgccttgggccgtgccgggccggcccaaaggcacaatgggctatcgtgcttttcctcggaaataagtctaattttcctccctcctattggactgtgacacatatatatatatatatatatatatatatatatatatatatatatatatatatatatatagctaaaaaagtctattttacctctctcttctttgggctgcggtatataaatagctaaaataagtctatttaaggtccctattcttaggacagtgacaattatatgtctattttagtccctatactttgtgtgccgagcctggcctgccgggccagcccagcgtgtcggtggggaggcccaggcatggcccggcggtcgggccgggccagcacaggaccgacccaagtcgggccgtgccgtgcttgggccgggcaaaaagccgtgctgtgggtcgggccttcgggcctagtgctttatggccatctatagcactaaccatacgatgcagatccccacataaaaaatcaatagcattccacgcaaatcacaaccccggcaccggcaagagcagccagatcccgcgcctgctccacgtcgctggccacggccgcgtcgtctgctcctagacgtaccgcctcgccgccgtgctcgcggcgacccgcgccgcggccgacatgcgcgccgagctcagagtctcggacgccaggtggggtactccgtccccctcgacgaccgctccttggacgccgacacggtcgtcaagtacacctcgcacggcgcgcttctccgcgagctcgccgccgacccgatcctcacccgctacggtgccgtcgtggtggacgacgcgcacgacgggatggcgctcaccggcgtcgtgctcagctgcgtcaaggccgcggcggcgcgccgcctggaccttcgggtcgtcgtctgcctgaaccactacagcaccctctgcaagggcgttgtacacggcttcttctccggctccggcatggatgtcaaggagctctggctccgtactactccggtctaatcgaccaatattacctcccggagccggtgacactacctcggcgcggccatcgacgcggtgtgccgcatccacgcgacggagccgccgggcgacgtgctggtcttcctcccgggctgcacggacgtcgaggcagccgagcatgcactcaacgggctgtgcgctgctggggctagctacatgctgcttacacgacggcctcccgattcaccggatccacgacgtgttccggccggcggccgacggcaagcggaaggtagtgctctgctcggtgttcgtcgatggcatcaagtacatcgtcgactccgtctactgccgaacggacaactgccccgtactcctacatctgatcggcggcggcggcgcgcctggttcgaggcctgaaagcggtcgtccataaatggtgtcacataaggcgtaaggtgaacgaatcgccgaagacgtggccgacagggacattcttctgcctgtacacgagagaggagaaggggtttccatacgcgtggaatccggcgaacaagatggcggatgtcaacgccctcaccggcgtcagcctcacgttcaaggcgctcggcatcatcggcgccggaggtgacgacgtcgtggcgagcttcgacttcttcgagctgcccatccagaatcgattcattgggccgtgaggacgctcaagtcaaggcggccggggcgctgggaaaaaaaaattctctgcggcactgccgcaccacgtctcgtgtgcaacactgcgtagatacctgacgcgtgtccatctcccgctgtagccaagcagccgtttctttggagccgagccgctgtgccgaaatactaaagccgattgggatttgggagccgctgttcaggagtacatcaaagctgattgctggagagatttaatttgtccagttcacaactttagataggaacctattgcattgcgacacgtcttaaagccttgaaacttgatggtttggggatatgaccgacattgctaattagcttgtactacttccgaagagttttggttatctttttgcttctgcaaaatataaacggatttacatgcttcaataacatggtgtttgttgtgacttatgaacatggtgttgtagacatggtttaatttttcggattggccgattctatcggacgtcactgatataccgaaaatttggaaatttcagtccaaaattttcaaaattttgagcaaatattggttaaatttaaaaaaaaatattaccaaattcacaaagaataaaaaaataaaaaatcagccgaaataatatcgtatcgagagtccgaaatgaccaaaattcatttcggaattcctaaccctggctgtagacgtacggttgtcttttacaatctatatactattcgtctgttcttcgttagcggcagatttactatctgttctgtcttctaatgaaacaacagctcaactccgcgtgcagtcgctaactgcggcttgatgtccgttccaacgagctgaggaagacatcggcttggctcaaggaaaacgcttggctgcagtaatatgacgggacacgcgtcagatgtgtacgcggtgttgtacagggggcgtggtgcggcaccgccgtagagaattttttttccggggcgctgagccaggacggcgaagtgaccgagaccgggaggcggattgcgcgggagatttcgggtagatattactaagcgcattcaaacgtgcgcagcacatcagtgcgagcctctgaattgatatttttagttttatctgatctgatttacaacaaggggaagattttagtagagcatctctagcaggtcctcaaacataatccctaaatcattattgagagttgattaaaaaaaatatggatctagcagagtccctactaaagcctcagtctaagtaggcctctagatttggctgtgtatatccttcgtagatatagagaccatattaatgaaaatcagcgtcatcgccgtcctctcacaacctcctagcaagcaagccaccaggtcatttgctccggccggagacccatgcctccgattacgcccaagtgagtctggacgccctccccgaacttgctgctcacccgctggccacaaggcctagcgcggcccatcgacagctacctgtcaccggccgcacacatgctgcagtaaaaaaaatcagagatgatggtaattaaaacaaatcacagcactaaagttcagtttcgtatgtctgagtctcgtttgattttgatctttatgggtccatggccattagctgcagtactaaaatatctgtgcaaaaggacaacctgtacgtgcggaagattctttgactaaggacaaaaaaattcagatttgcttcatcaattgcagctagaggtgaaaacgatcgaaatcggtagcatctctttcgaaacaatgctcgatcggtcggtaatcgactatatttattattaaactactcagtatcgatatcagtacgatgcagaaaaaattgtgataaaacaaaatttaaaaataataaaaaacggtaccctatatacgaaaacggcgctcggtcaatcggcaattgcagcagttcatttcctaatcgttaaacacagagggattgtggccgtgtttagttgttttggcaaaaaaaaaattgacgtatacggacacacatttgaagtattaaacgtagactaataacaaaacaaattatagatgccgcctgtaaactgcgagatgaatctattaagtctaattaatctgtcattagcaaatatttactatagcatcacattgtcaaatcatggcgtaattaggctcaaaagattcgtctcgcaatttacatgcaaactgtataattggtttttttatctatatttaatgctctatgcccaaacatttgatgtgacggaaaagttaaaagttcgaaggaaactaaacacagcctgtgtatgttttttttatgtgattggattgaaaaacctgcctgcaacaagtgcccaatgaatgggacaaagaaaaaaatatattactttttctatctttacagcttattatttttttcttgattaatcaatcgcatatgcatattttgtaggaaaaggcaacctaggaagaatgacagaaagcacccacctgaaccttctacaccaataatgatcacaaataggtttacactaacgcatgatagcctaggaatggtgacaagaaggtaaccgaagtatttgtgtgtgcatatatctcattcaaattgttgcttatctttcgtgcttgtgtgtaggcgcttgcaatgctgctaggagacagatcaggcaccattgaataagggtgcaagcggctatccgcgaaaatccacttataggctaaaccaaccctcaaactcacttattttgaattataagtgagttcgtgggtgacccacttgcatccttacgggcactggagaattagcaagaggcctttcgggagcaagcacttgtggaggcggagattgcacttttggagctagcacttctgtaggagctggttgcactttggggtaaaataattatgctatccctaagaagaaaaaattgactcaatttgaccgagattgtctactcaatttatccttaaaattatgtagcttggttgaacaatttgtgtatgcactgtattatgggttgaatggtttgttgaacaatttgtcgcaaaatttgtgtatgaactggattgtgcgtttgaatgcttcgtgaactttttgtttgctgatactcatgaaaatggtgtttgatgctcgtatgttgctattcaattttgatgcattgtcgttggtacagaactacagagagaccacagatcgatctgatctgtttaggaacagccaaaggcatttcggttagttcatgaaagaaaaatgaggagaaaagaaaataaaacagctaatggagtggcaactatcttgaagtggtaattaaactatatatcccgaaggcaacacattgagtggcatttaatcatttgcatcctaacgagtgacattttgttgaagccatacgtatagagtggcatattgttctttttctcttatattgtaatttttacattgaaatccttatgcttgcatgaaatacaatactgtaataccccgaatttcgaattaatatatttcggagaatattagaagaaacgcgcaaaattttaacttttaaactgttgttcgaataggcgatcaggaaccgtggatgcgtagagctcgccgagtagtacaaaatagactataagtttattgtaatcggagtccgaacgaaatccaggtgatcaaattaatatgggtcgttcgatattgattaggctctcggctctctatttaaccaactgaaaaaaagaagaagaaaaggacaccagcagctagccctagcccgtcgtcctccccaaccctgcctccgcgccgccgctgctggtgacggcgtcgccacagccgtcgtcgtccgccgccgccaatcgattccctgctcggctgcctcttggtgtgctactgctgccaaattcctgttgttgctgctgccgatccgatcttttaattgccgctgctgctaatgcatggcttgatgccttgatgtgctgcgatctggtctcttcatcgctgctgctgctgactgctgctgctgctgctgactgctgctgactgctgctgttagggaggagaagggcgcaggagagcaggaggaagaaggaatttggggatttcggtcattttgcaactagcgggtttgttctcaaattctagtatccacgctgcagcggtacttttggctactccctagaagtataagattcaaatagaaatttattcgatagtcgtttgtgcaatttttgaagttattgattataggctaaaaccgtattttcaaatctgatattaaaccgtcgggattcaggttagttgtcctaaataaagtttgtagccatcgtcgatatctttctatcgattccgataaatggtttaggagaaacaacggagacagtactgctgaccgggtccttattttcacgtggaatttatggagctaggatggttagcaatgtgttggttaattcgttattgatctatcatataactgtctgtcgtggatgtccgtatttttagaagagactctgccgaaatttctaataatttcgggagttagtagttttgagtgtttttttagtgtggcactctaggtacgtggctactagggatggcaacgaggacatccccggcggagagtggtcacccgtccccgtccccgggcgaactgaaatcccccactccccgtccccggccccgtcgccggggatgatttttggccgtccccgtccccaaccggggttccgggggccacacaccccgaaacgaggagaagaactatactagtactactcaacgagcaaaacgccgtgtagtcgcttgattttttatcctatgctgcatcttaatactggattctccactgcccctgtagtcgcttggtttgccgtgtttcgatcatatacttgtttgagctgaaattctacgtactttacactcttcattcgtggaacgggaaaaaagaaagggagaaaacgaacttttcctggttttcatgccgtttaggccaaactggagctgtcgaaccaaactccaagaaacactataaaaaaaacattttttcctggacgagactcccttcagtttacaggcgaaccgtaactaatcgcctctgcaaaaatcgacctgcattcgcatacggctttataaaagacccgcatgcaaagatcgatttttacaagtggatatcttaacaggcccacctacgaaaagtccaaccaacctccctccatcctcattctctctcctcatgctcccaccaccggcgaagaagggcgggctgccagcggcgggcggtgagtgaaccgccgccgccgacgggaggaggagaagggcatgagcggctgggctcgatgggtggcaagcgggccgccattgacgacgggaggaggagaacaaaggccggagcagctgggctcgatgggcggtgggtggtgggatccggcggccccgtgatagccggatccgcaccgccaacggcttttagggttagggtctcgggatttttggatttttattttttgcatacggacgacatacgcaccagcgtgccaaaatcttattttcgcgtgcgggtgcgctactcacatgaaaaaagaaagtagcaaatttcgcagatacctgtgtgtgtgcggggctgttcagtcgcctaaaaaatcggatttgaccgcatgaaaaacgatttggctaaaattatgtcgataggttttttttgcctcagttgatttttgagccacttgatattctcctatattcgtgcaggtgcggtacgggtacattgtaaatacatgctgactattttttggtaaaaaatatggcgccataaatatagctgctcccttgattaaagtagaacaaacatgcatggccgtgggtccgtacgtggcacaagctaactgtgagcgatcgctgcatgaatattagtagtacgagacaaaagaatgttactcctttctcagtactgccaatgcagtgaatctagttgattcatttcttttaacaggaagctagtgagtagggaacaaatactcccaaattatagtgtatatacttgagttacatctcaattataatataattatatcctacttacatattaattacatagtgttaactaagatataattacaccgtaagtaggatgtaattacaaaaataggataagaataagtaaacaactgatgtgcacgttaatgatccaccaagattgattaaattaccgctggggaagagctttacttctagttagcaaccttttttagttttggttgtgcaaccggatgccaatccgaaactaaagatgtatatctttagtcctggttaaaatgactaaaaatatctatctttagtctcggttgaaataatcaagactaaagatatataccaagaaaaaaaaacatatatgtgggatgtgagattagttgtccatcataccaagttaaaaaaaaatatgtgggatgtgagactcaaactcaagatctctcacttcagccctcactcgcgttatcatcccatctactacacacatatgatgacttggatacttttgaaactaaccatggaagcatcttttatctgggttggtaacaccaactaagactaaagatcaatttttagttcgaattggtaagtggggggctgacatggcccgacagctattgaaccatggctaaaaatgatctttagtcccgattggtgttaccaaccgagaataaagatcataaagtgccattgggcttttgaaccggggttaaagatattatttagtccttgtttccattcgaaatagaacaaatgtgatttttgccatccgagcaaagatcaattcaacagtaatgaatattgctattatgtattcatctctactatagtggaaaaaatcgaatgatttttactcaaaaattatgtcggcacatatttagatactccccaaaaatgcttttctagaaatggaaaaccagatccaaacagaaggaacatctaatgtaatgtggaataactcatagtacatgtacaatggaaactaataatgcaaaatgcatcgtcaaaggaatggtccgatagaaatttagtactgaggcgttctctctgtgtttttttttttgatttgatgcgcgcacgcacacgtacacatcaatccacacccataacaagtgcgtgcgctagatacaatagatgaaactacagcaaaatttcgttgtaaatgcgatcatgcaactaaattaagttagaaaaagtacctgctttcatgagcaaagcttctaagacaatagtctataaaaattgatttttacatatagtcctttgagctatgcatttccaatggttcattgtttagactgcgtggaaaacaaaagaagtatctacgaaaatagttatatataatacaccatatcgcacatggattcagattgggtgacatatggtaggaatatcacatggtgacatagggtgaatctcggccctccaaaacaaatacaacggctgagattcgtccacgtcatcacgagtaaaaattttactccctgtaaaacttttactcctgaaattttactcccaataaaattttgagtaaattacacttttcaccacttattattgccatagttgcagtttggaccaggtccactgtattcttttcacttaagaccatgaaaacttaccactcattgcagcttggacctaccatatcccttcttctctaattactcctgcaccaatgatggctccaagctccttccgcctccacccattccctagctaggagcctaggagcataggatagcaggtgcaaggacttgccgactactcgactttctccacggttccaccaccttcagccgccagtacatcattatgcagttattcatgctccaccggtccacggacggagcagcacagattgacaactacaccttctaactcactggtcaccatagtgttcacggagttgctcatcgcgctcaagcgctacattgctccaccgcgacaggacgtgcctcaatgtagcaatgcgtagcaaacagtgctcgacgcgagagatctattggcacacaccgcgcatcccctgcaaccagcccgatgacgctgtgctcgtgctcgttgccgccgcatagccataaccatcttctccgacatgttatttgcctatgtcgagttggctgcgagagcttcaagttcaagcctggtccctatctctagcatcttcaagctcgatgacccagcacccaggcaccaagcagtaggctctttcttgcatatctatgttcgacaagctatccatagcaggcaacaacaagcttgttctgtttctcgaagaactaggagccagccatgggggcaggaacgcagcaatggccgctagaaggaactggtccagtccaatgtgcaacaaaatgtaaatttatatggtctaaagtgaaaacagtactatatgcctagcccaagttgcaacaagggtaaaaataactggcccaatgtgtaattgactctaaaatttttactcctgagtaaatttgtgagtaaaatttttactcatgatgatatggacgaatctcagccgttggatttgtttccgttggatttgttttggaggaacgagattcaccctatctcacattatgacatgcctaccctatgtcacccaatcccaatccatcgcacacatataaaaacacatttccctaggcgaacagcttaaccagtccacctatatggcatgtaagtatccgtcagataaaattaatacatgttttcataagccggcgcttaggtgatccatccgtgtaaatcggcctatttcacatgcgggtctttcacacgcccacctctaataatgtatttaccgaggtgcgtgctcattagaagatcatcatgtaaaaatacctactacttaaaggacccatttaaatcgcaggattgagaaaacatagtaatagaaaaaacgttggattttgataggaatgtaaatgtaaaacagagaattgcaaaacgcaggaaaaacacatgaatgaccgtttaattgaaccgcgagaaagatgcagaaattggatgagagagatagactcaaaggaaagttaccagtgcaagaggttgaaacttttactaaatttcctccaaaatatctatagaattgtcaattccatagaaatttcaaaggattggatatgattcaatcctttgtttcataggatatcatagaaaattttcctataggattgaaatcctccaaaatttctatgttttttctccaattcaaaggggcccataactcttgtttctcacaaggcgctccctttagaataatctatccaaccgaaagaagcaatttcttgcctgagaaaataaagttttgctctcgatttactcggaatgggcttttacaataagagcatgagattccaagtgttattttcaagtttccatctaaattgttagctagaattttgcttggccatggacatggagtttttctttaaaatttagagttcaaagctcaaaatttatggcaagcattcaatatatgaagtttcacatggttatttgtataggatcatatcttctaccacaagctttgcgtgcaaacaccatatgaaccaactaaaaaatgatttcaaaaaattctaaaaattatatactcaaaattattatattttggctgtaaaataaataaaaattctaacacttttaagagtactttttatctttttgttgttctctaggtatgatgaatttgcaatataaaactttccacatagatgtaattctactggaagcacatgctaggaattaaattaatccactaacctggttgcctctataacagtaattactgttaagcactggaaatcctttctctgcagcgagctgacgtagccgcccaagaggacgactgtcgaccatgtaaatgcaaggtacgccatgatcgtacatgtgattctgatgtaggcctgcacggcgagagtgcccttgattgccacttccaactcggcgcgcctcttcttccgtcggtcagacccgccgtcgtctgctcctccgccgccgatcatcctccaccaaataagcatgtttttagcttgaatgctaggtatgggatcgatcgacgatgaatcgacaatgacgtgcaaatgtggaaatatgggagaggcggtgctgctgcgcttctcagttttagctggtgccagcccgtagcttgcattgcctagctatatatatacatatttgtgcgcacttagtcaatggaatctcatagtttaaactaaaccgctgttactgttatatatgataatacaggctgccaccaaagcatccgatgaagccaagttaattattaagtatcacctccatatatcccacccgttaaattcaaattttaatgcccgttcggtttgaaagaaaagcatccttcctaatgattaatttctctaagcactactgtattagatttgtaggaattaatgaagtatagataaactaaaggaaattttttctcccctacaagtcatagcaaagaatttgttatttttattacctcctccgtcctataatataagggattttttgtgaatgcgacgtatcctagtacaatgttgtactaggatatgtcgcatccacccatatattatgcgaaattgctaattggcgcatacgcgccatcagcctaatttgccatcagcctaactcgcgcgcgtttcaggcccaatgtctcgcgcgcggcccacatcctcgcttcgctcgcgcagcccatctgttccctttttcttttttctcatttcctttttttttgccgtggggagtcgggcaaaacaatcgtgaattcacgttttgaatagtcaccaaccgaacattatcctcttttttttctttttttcctcccgtgattcctcctccgcgtggcctcgcttctttctttttgtcgcttttttttttgcttttttttccgtgattcttcactttctcttttttttttcttttttataattattaatctacagcaaaacatatttttgtgttaaaagttcttaaatcttgtcttgaaaatattcaaatcttaacttaaaaatttttaaatctcgaattgaaagttttcaaatccgagttgaaagttttcaactccgagttgaaagttttcaaaccctagttaaaagttttcaaatttgagatgaaaagttgaaagttttcaaatccgagttgaaagttttcaatcccgagttgaaagttttcaaaatctcgagttgaaagttttcaaaatctcaattgaaagttttcaaatccgagttgaaaatttttcaaaatcttgagttgaaagtttttcaaaccttagttgagagattttcaaatttgagatgaaaagttaaaagttttcaaattttgacttcaaaaattcaaatttgagttgaaaagtttttaaatctggattaaaagttttcaaattttgacttcacgtatagatttgttttcaatctgttacttaaaaaaatcttatcttaattaccatcgttatctaaaaataacgtgttagttacattagatatactcggaaaaaaacacgggaaaaaatcagtcgcgccacattcgcgataaaaaaatcacggaaaaaaggaaaatccgaaaaaaagagaaattcacgcggtgaaaaaaaaaacaacgaaaaaaagggaaacccacctactgggccgcgtgcgtgttgctggcgcgcacgcgccagctaggagccccctatattatgggacggatggagtacaacactaatagaaaaagtatttttgcaggcggccaaaagtgatttttccagacgggggaggatcgccagcagcccaacgactgtgaaa

SEQ ID NO: 64367 - DNA, 25496 bp, Oryza sativa
tcctcccccactccccacgttggccggcaaaatctcgcccctaccggccacgtccggggctcccctcccctatttaagcttccccgtcgccccctctcgctttttccccatctcgccgaactccctcgtgctccccatcgctcccgcgccgtgcaaccacccgccgccgccgtttccgccactccggccgccgctagccgccgctagggtcgccaccgcaccgcgccgtcgccgccgtcgggttcgcgaggctaagctccaccccggccgccccttccctgtcgggattcatcgccggaattcgcatcccctcgcgctccggtgagttcaacctctaccgccgccttcggccatgaatgccggtcgccgtggttcatctccctccctctaatctctctcttctccttccttagggcaccccgaatcccgtccgtcggttgccgtcgtcctcccgtggctcgtcgtcgccgttcgccgtcgtcttcctccgcgccggccaccctcggtgaggcatccctcccctcttttccccttcctcccccttctagtgccgcgccaccgctttaagtcgcgcgctgacgccttcggccgccgccgccgtcggccgcgtgccgtcgccgctagccctggccggccagccggctttgatgccgagccgagcccggcggccgcctctatcgccgcccccgatcggctcggggccgatctgggccgtcggtcccgtggaccggcggtggaccacccgcgtggtcccggtccacggtgaaccgcccccccttgagtcgctgcccagtggggcccgcctgtcggcgccgcgcctcccccccgtgctgacgtcagccctggaaaatattgcgcaataaattatttaaggatttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcattgtttgccttgtatgtcgctagattccggctcttccgacgctccggtgtacttcgaaatagtcgccgaggttcctccagcagcagagcaaggcaagtcatgcttgtcacttgatcatattgatcctatattgcaaatgtcctaatgttttctttcaaataccgcatttgttttgcaattataccatgctcctttgttagcttgggttataacatgattaaactttggactaggaattgcttagccatgcttagttcaactagcacacaatgggaaaatctcatttaaaacctagactataggtttatttgataatgttggattagtaccaccgctctggtgttggttaaataaaatgaatcacatggtgggctgtgggtgtatggttttgctagtcgtgcccatggcaattaaggaccggttcgcgggaaaccctggaagaacttatcgtacttaccacaaaccagcgtgggcaacggctgggcttgtagtgtagctttcctctagcagacgcatccaggcaagggtgggcatgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatatccgtgcccgcggttatgggcggtcaaccagactcaccgtgattagactcaccttagtttagtctaatgaaattggatggtataggtggatggttgggcctgttgcaacgtggtgtaacattggacagtggatgattaatactgcttaattattacaactgttttcgcattcaattcctgtttataaatgctagtatttatgcaaatgaacctgtttagctatcccttgttgaatccctgcatcataccccccccattccggtatgacttgctgagtacagtggatagtactcagtcttgctctattttcccccaatcccagagctcgagtatgtgtccgatggcgggttctccgaggagtaggcttcgtccgtgccgtcgaggatgcctgtggagtggtgttcccgctgcagttcaagtcaaggattagctccagttatcttttgtttttccgctgcatttatgtaagacttttatattgtttgtaaggcgtggatctgtatgtcaacattgtcgtttgtgtaccccggccggtcctggacgggggttttaatgcacattctgcttggaattctattcgggaatttctaggcatgacatccctccctcctccggccagatctgggagggagggggaggggagccgccgccgccgccccgcgccgccctcgtcgtcaccgccgccgccgagctgtcgttgtcgccgccccacgccccaccgccctttctaggcctccctccagccggatctgggaggggaggggaggggagccgccgcgccgcaccgggagcctcgtcgtcgtcgccgtccacgccgccgtcgccgccccgtgccgccgccggtatagggagggaggggagaggaggggagggggacggcccgcccggtgggaaatgttgagggagagggagagttgagtgagggaaatgagtggtggggagggagtgaagcagaagataagacttagatttttttttctgtaggtatgattttcgcgggcgtcgcttaagtggtacgtctgcgatagcaaacttcaccccgatttatatttttgtaggcggttatttggcttcaagggtcatgttcgcctacggaaatcagacccccacgtcgggaaaaatgcattttctagtagtgcaacttaaaggagtcaaatttgaccgtgcttgtttgtggtgcaactcttttttttaactatttagatggtacacaagaaacaagcgaatgtccacttgattaataaatctaagggattgtttcttcggcacctaactatcaatctgaccctatttttgtagtttgctcattggaccatgctttttaaaaacgaagagtaccctcttccgttaaggcaacgtaatgacattaattcagggcaaaatggcttatatgaaaatgcagtcaagttggagctccgctctccaacctgactgaatgctgctagtggtggcgtggtttggacgaaaatgctcacacccggacgaccggcggggtggagaaaatcggacactgtctgccaccgcagcatgatgcatgcaaagaatcttttcttttcttatttcttcaaaagattttttatcgtaaaatatttatctaatctacgatctgattgcaccactaaattcgttacaattaaatctttataacaagaccacacatgattatatttcatcaaaaaaatattttaatttttttattgattttttttaatgttgcatgtggtctcttttgatgtttcaaccagtagttttacaatgtttcagctagtgtactcatgatgtttcactgtgtacggatcaaatgttacagtggaatgcgccgttgcaataaatcacccacatattttggaaaccttctattaagggaatttggtttatttttttgttccacaaaaaatgtttcacctagtgcactcacaatgttccactatgtatagatctaatgttgcagtgaactgaaatatttcattgcaacaaaaaacccatatattttggaaaccttctattaaggaaattcgtttcattttttgtttcaccgaaaaatgttccacctagtgtacttataatgtttcactatgtatagatctaatgttgcagtgaactgaaacattcttccactatttgttgaaacattgtttttatataaggtgaaacaacaccagatttaaacgagtgaaacattttcgatctacttagtgaaacaattccgatatacctggtggaacatcgtgcaacattttaaaaataattcaataataagctaatttttttcattggaatatatccatgtgtggtcttgttttgaagatttaattgcaacgaatttaatggtgtaatcggatcatgatttggataagtaatttaagagaaaaatcagtttaaaagtagttttgcacgtaaatcgggcgctgacgtcatgctgacgtcagcgtccgatttttccctaaagcatcggacgtccgacgcgcagccctctccggttttggagggaggcctgctcggtatgacgccctgctgggacgtctcaccatggaaaggggttgctgtgttttttttttcctttcagttcgtatatgaaagtatgcaaccttggattcgtaaatttttttgtcaattttatcaaaaatctgtcaaatgtaagttatgtttgtaaagaaatatatcaaatctaagtgaaattagtcaaatttctaaaaaaaatacaaaattcagcaagcaaaaaactttgaaactttgaaaaagtaaagtcaaatgaacaagggcatataagccattttcccctaaattaatgccattatgttgccttaacggaatagggtactcttcgtcttttgaaaaacagggtcaaatgggtaaacttaagaaagtacggccaaaatagtggttagactttaaaatatggccaaaagtacaattgccccaaaatctaactactcaaacctattgaaaaattcatatggattgatgtttgcatgccttcattttttttatctttcctattcccataggttaaaattcctccaaccaaacatgcactaagtgattttattaaaatcgttgtttaaagggacttcctatccatctctaaatttagggtcccctatcatgaccttctttctcatcaaatttggtgagcctatgtcccactcgttatcgggtcacccatctccctagttagcttgttcactgtcactgtgcctgtcagtgccattcactctagattgctacttattgtgatggagggagtagatcttaaaaaaccaaaccctatcattattagcgctaccattttttgttttaaccgtcacccccttgctcgtcccccggccatatcttcactatcacagatttttttaaattatttctccagttacaaccttccgttccgagctattatcgcgtaccctatttacccgaactccatggcccttcctatgttatctattaaaaatataaatatcaatgtacgtattatttcataaaattagtaaaatatggtaaatgtgaaatataaggtgaatcttaggtcgtcagttggagagcaaaggaaaagaaatataaggagggaggttttttagaaagctatctctaagggtgtgaggtttagggagtacgttcggaatgctctagtaagaagcctttattattagttgacaattcaatgtctctgtgtagtttttcgaacaaaaaaaagtattttgcgtagcttacattggggttactgatcggatgaacttagctagctggtggcagcacattggctatatagttagtggaatcattattaactagctagccagcactccgttcttaattatactctctctcggtttcataattatgagacgctttataattttaaatcaaacatcttatcagtttaactaaatttatagaaaaaataataaaacttagaacaccaaattagtttcattaaatttaacattaaatatattttaataccatatttatctagtgttgaaaatatttctatgttttctataaatttgatcaaatttataaatatttgactaagaaaacaaaatcaaaatatcttcactactaaagattggaaggctcccgtgtgcctacgaatattactgggtgtttctctaaacacacggtaacttaccgtgcgtagaacaataaattcgggaaccatcaagcacataccgtgtgttaggattcacgggagcaccggaatccaccgctttccatctgtgcgcgtcgagctctattggcgtgtcgaacaaaatgttaccgtgtgaccccagtgcacggtaaaccaccgttctctgttacgaccgccgttagcccgttacatcgtgagtgctaccgtgagtcccgaatttttagtacactcggtaagattttcaaccatcctgtgcgttttcatgcaaactcacgggccacacggtaaaccgattaagccaccgtgtgagcgttaccgtgagctagaactcgataacggcgttgatgtgtgtttttgcctgttcccgtgggttttgagcacacggaagccttcccatctctagtagttagcttataatataaagcgcaggaaacataattttctcaagtgaatatatttggatatctgaaatatatgaacatataacatggattatatttgtagggcataggaaaatatattgttttacagtctcatattttgcattgtacttcctccattctttttttttttcatatatagtactagttatggacatcgctatattctccatcgtgtacgtttcatcattacttttctaactctatattcctgctggaagtggctggatgttgatattaattatattatattctagttacgtatataagctggaagtggttttgcatatcaacttgacaacaaagtttgctttatctaaaaaggctgcgggctgatctgcttgtatttggtagatttttgtttcttccttctttatgtaattcttttgaggcttgttaaagttttgctttatctatgtgtggggaataggctaaatgcctcaattacagtggatgcctacaacagaatggtgtagcattcagccaatagaatgatgaccatattgttcgtttctccgacaagacggagatgaaattttggatactcgtggcacgcttttcaaactgctaaacggtatattttgtgcgaaaactttctatatgaaagttgctctaaaatatcagattaatccatttttcaatatgatactgataggtatcaggttctgatgtcagcattgatatatctctaaattgttttttatatttatgtgcattaaaatgcataaaactatattaagacttgctaatcattttcatctattatttagtcaactaaataattactttggacatgtttatcatgaacacactagcgtgtgcgtctagcatcgtacaaaatgcacatgtcgtcattgttcctaaatatcccgatggacccacaggattgtttcctttcgaatatcgacacaaagatctccttgattatgttctacgaatgatagatccattagcacccatggtttcatcgacttgcttgtttatttactccctcctttttatatcataaagtcaaacttctataaatttagtcaaatttgtatgaaaatatagcaactctataacatcaagttaatttcattaaatctaaccttcgatatattttgatattatgtttgtttagtgttaaaagtattactatgtttttcctataaatttgataaaacttaaagaagttgattaagggtgtgtttagattcaggggtgtaaagttttggcgtgtcacatcggatatatggatacacatttgaagcattaaacgtagtctaataataaaataaattacagaatccgcctgcaaaccacgagagcgaatttattaagcctaattaatccgtcattagcaaatgtttactgtagcactacattgtcaaattaaggcgcaattaggcttaaaagatttgtctcgtaatttacacgtaatatgtgtaattagttattttttcgtctatatttaataatccatgtatgtgtccaaacattcgatgtgatgggtaggtgaaatgttttttttaactaaacaaggccaaaataatccatatatatagtccataatgcatccctatcattgatcgcatcacatgtctaggtttttctttttcttgagaacacacatgccggcctaggtcaaatattattttgtacgttgcatctccacgcccacgcaacgtaactgcaatctgaccaatcaattctaggattacataactccgtcaacttaccagaactactcactaattaatcacaatcacagtattcgaaatcctacagccactgcttgaaaaatgtttttttcgaataaacacactagttctgcacatgcaattagggacctggggaaccaccgtgcagcatacacaagaatgttttcgtagacggacaaaatcgattttcccaaattggtggagcactcgcctggccgcctggaatcaaatgtactatttgaaaatgaggaatctcacgggtaggccttgcaaccccatgcgagaattaatttttgcagaactctacacaatatttttgatagaaaaaacaaaaataaaaataaatctagaaactcctgtcgtcgtcgtcggatctggaggcacaacatctggatccggcctccccgccactccacggcccaccaccatcgatccgtcacccagccacaccgcggttggcctctcgtccccaataccgtgctacgaatggatggtggtgggcccactgcggtgtggctgggtgagtgaggcagcatgtgtggaaaaaaaaagttgaaatatatatatttttaataatttacgtttatatatccatagagagcagaaatacacataatccgccaatccgaaacgcgggaagcgcagctcggacacgcgggaacggcgaccacatcgtgccatggagcagaagcgcagaacaggaccggatgtcatggagcagaagcgtggaacaggaccggtcccgtggagcacaggagcgggaccacctcgcttccgcggccctgtcctgcgtggtggagagtggccgagtggggccacacgggaccgcctcgctcctgtggaaccgtagcgcggcaccggcgtggtttcgcgtctggatgtgcagctcagatctggtcccatttctccgcgcacgctgcccccttcccgcataaccatcacgtgggagtgtgataatcacttcctaacatttactccctcttctaacatttactccctcaaattcgtttcgcagtttacatacaggcggattcttgttttgttattagaatacgtttaatactttaaatatgtgtccgtatatccgatgtgacacgttaaaatttttttacccctccatctaaacaccctaaggtgtgtgtcggtgcaagtcaataggtgtatgcgtccttttttgattttgtatcagctattacattcaatcgatacctattttacaagcgggcctaatagcataaccgtccataaaaatcgattttcacatatgggccttcaccaagggaatcctacgcattttcacaaactaattttttagcccgcttataaaaataaagggagtgtgtgaaaatgtttttttttttaagtagtgcaccatattgcctgccttggaaatacatttgaacgggcggacaacttaaccggcctacctgtgggccacctaagcacctgcatgtagaaatacgtgtttccgtatgctggtggttatgcagaaatacctgcatgcagaaagatgcaatatttataaaatattaactgcaaaaatgataaccattgcacaaaacattaagggcccttttaaatcaaaggatttttataggaatttcatatgattcaaattctataggaaatttttctatttgaccttttgattcaaaggattgaagcttttcaaatcctatgaaattcctatggaatgatacattgcatgtggattttagaggaaatttagcaagagctccaacctcttgaaaaatttcctttgagtctatctctctcatctgattcctacgtttttcctgcgctccaatcaaacgaccattcctatgtttttcctatgttttgcaatcctctgttttacacttcaattcctatcagaatcatgtgtttttactatccctccattttttcaactctgcgattcaaaggggccctaagtcctaacaagagtggaacacataaaaaaatctatatattttagagaaagtttcataatggaccagtttttgttacctttgttgcatgatggactaagtggtagcacaatttttcattttgggctaggtattattaccaaaaatttagtggcccacatatcagtcagtgttggtatctcttatctccctcgaacactggtggccaacaattaacagatatctacgaaggagcttagccaacgcttactcaacgtctcaacctaatcgtagctgctcaccatcaacttctcccctgcagcaacttgtcggatggaggtttagcttgagagattgtaggaccaggagggttgagcttgatgcagggacgggtgcgggcgagatcaaccgattggcctgagctgacgaagatcgagctcaaacttgagctccagtgcgcaggcagagattggaggaggtcaagctagattggtggcgcaatcttgatggtctgctcaccgccgatagtgagctcgagcgcggcccgggcaacgctcaatgcagctccagtgcaaggtggtactggtgaaggtcgagctcaatgcagcgtagggcaagggcttgatcaccagccggcggcagctcattcgaagtcctagtctcccggagccttgctcatctgtggtagtgagcttgagctagatggcaggtgtggagacttctacagatcggatacaatacaactcaacggagaagagagttggagaagaacaccgattcaatgtgcaactattatagagttagcaggcccaatgtgaaaaggtagatttacctctagtccaatgtgcaaacaaggtaaaaatattagtggtccaatatgcaattcactctatattttataaaaatgtttcatatgaattttttatgtattcatatatatatatatatatataaggacaattattaaaatatccaaaagcatcgctgtaacatttacaaattatatagtgaaacataagagaatacttatcaaaacatctaaatagcactaaatgcaacatttataaaagatgcattgtaaaaaaatcatcgaaatataatgacgtaggatcttgttaaaaaatttaattgcgaccaattcagaagtactcctgctatctagtatttgtctctgtcatgggccccatggtttcgcttattcggaaaataagcgaaacggtatatttacaaatgaaaaataatttgtggataaaaattttatatacgtgttgtgatctaaaagcaaagactgaaaaataaacttcaatgaaaaaacatcaaaatcaactccaaatttaaggttgaaaatttaaattttgactgataagtacaaatataatcgaaaagatgggggccctaatactctagcagaggcagatactagccatgtccgattctttttccccttaggctcgggcgttggagggaaagtattctccacgtagttttacacctatatataaagtcttaaccataaatttattatattttagtctaaaaaataaaaattatgtcacttataaatgtataaatatgttagaattttatttttgtttttgctctttaggtatgatgaatttaaatataagactttgcacatatacgtaatactatatctaaagcacatgcacatttttttttctagaactttcagtggtattcattacttggtgtgcacggttgtgtgcatgggcatcctctatttctttacttaaccccaattagacatgttgaaagcctctatagtgtgttattaagggggatgtcttttggatcatcccaaacgggagttgagtttggacttaaattttagtaaaaatatctcataccaatacctatctctaataatttttcatgaatttaaaaaagaaaaataggtccgattttcatgggatttcacttattctatggttatcggtagatatttcccatatttattgtcattatgaattctatagatctagtctagaactattttttaactaactctagagttggttagatccaaaagtaagtctgtgtacacgacatctatagatcttgacctactttggatagtgatcttgatgagaattaatttatcatgaataattggacttcttaagatttgtacattaagtttaattatgtactaatggtaatattagaatcaatggtattaatactgtcaaaaaaagaatcaatggtattaatgaatatttaccaaatattaatggtactctttgtcagtgcacttaaatatatggtactccctccgtcccataataagcgcagttgtggatttcagtgcctaactttaaccatccatcttattagaaatatttttatgattagtattattattattattattattattattattattattattagatgataaaatatgaatcgtactttatgcatgacttaactttaaaaaaaattcatatttttttaaataaggacagtcaaacgttgagcatgaaaatttatggatgcacttataatgagacagagggagtatatcccgcaacattaggaaacactgttaatcatatagaatactacttttatgcaaaggatactctcatatgtaatgaaaccaacacctgcttcgaaaaaggtaaaatctaattaggaagcagagggtaaaatctaattaggcccggtttagtttcccaaaaaattttcacataatatcacatcaaatctttggacacatgcatggagcattaaatatagattaaaaaaactaattgcacagttaggggaaatcgtgagacaaatcttttgagcctaattagtccataattagtcataagtactatagtaacctacatgtgctaatgacggattaattaggctcaaaagattgtctcgcatttccagtcgagttatgaaattagttttttcattcgtatccaaaaacccattccgatatccgttcaaacatccgatgtgacacccaaaaaaattttttttgccagaattttgaggcttcgtcgtccggctcctcaaaaattctggacaccagaatatcgaaccatgaacgcggaaaggcacgagagaaatattggctagaatatgatatctatctaatgtgatatatggaatatatgacaaaggtggagtcttagagtatttcgatcgatcggtcatataggcctgagtcagacatcaaatagctttgaccctgcatagattagccatacaggctttccaacccactttagtagaggggcgtactatttgtttacacccattagtgtgtaaaggtttcaatgcggattttgatgggggatcaaatggctgttcatctacctttatccttggaagctaaagatgccctaagtacacgtgcactgtttagacttacagcgtgaccctggtgtcctttttccgattcgaacgtttttatcatccgtgcacagtagtgggtagtgtgttgtctaaatatttctctagctagctatataccaaataagacaatggctagttatatactccctccatcccataatataagggattttgagtttttgcttgtactgtttgaccactcgtcttattcaaaaaatttatgcaaatataaaaaacgaaaagttgtacttaaagtactttggataataaagtaagtcacaaaaaataaataataattccaaaaaaaaaatttgaataagacgagtggttaaacaatgcaaacaaaaacttaaaatctcttatattataggacggaggaagtaccaaataaggtaaatggttggtactgagggccaacactaatctatttttttcttaataccaaaccttttgcagtctatatattttaaaccatgcattatttttaaattccgtttaaaccatcatactcttcttaaaatatatgacaaaatgtacaacattaaatatattcaaatacttgaaagtaatttatttaaattatggaagtaacttagtttgaaaagaagtaacttttcataaaataacattaagttaattatataggagtgaattgaaaataaagaactacgtgaaggaaattcacatataaaatatgggagtacctatacatttgtcgacaaattttctcttaaaaatttgtcaaatgtaaatacaatataattatactgtaattacgttataagtatagaataattacactgtaacttacatgtagttacactgtaactatagtataactacactgtaactttagtataactacactgtaacttatatgtaattacactgtaactataatatgacttgcatgtaagtgagatgtacctttagaaaacttatgtttggcactgctcacgtgaaagagggattacgaactcgcaatgtctgtttgtacgatgcgtgtggaggccatcgttcatgcatgcatgttcggctatgccctgccgctttatctctgcccttcgtctgacatctacgcgtgcatgagccgcgccattgccggcagccagcggccctcgaaagaaacaaatcaaagcgttgacgcaaaagcacgaatcccgaggttcatcaagcgggtcaaaaatcgataaattctgaggaagaaatttgtcaacagatttatagcaaaatcgtaaaatatagagaagattcataagtgaatacatagactttcttatttaaagtaatcactatattattttaccttatataagaactgatataagaagtaactcttcataacactaaaagtaactacgttgttatagggaagtaattatgaaaaaaggaagtaactttcaatggcataagaggcaactacactgttaagaaagtaactcatgaaaatatatattcactagtaatatatattcatagtattagaagtaaccacactgataatttattcacagtattagaagtaactacactacaaaagcgaagtaactctttacagtattagaagtaactatattgtttcatgaaagtagcttttcggtactagaagtaactacactgctatataaaagtatttttgcgtttgcaaaaatataaaagtaattttcatggtacctgagacggagagggctcgtttggatgggccggaattctggcccaacccatttacagtaaaacttgaggagatatttccggcccaattgctaattcatttctcctccttcccatttgcatcatttcatacttcatactggcatatgccacatgattacaaatatcactagtagtagtcctcagaggaacaatttttaatcgctcgaggcaatgcctactcatttatttaaacaccatttaaattgttatagaaaatcttaaaagaattgacagtattcatgtgacatacctatacaacatcacaaaatcttacatctaaaatcaactcagacataaaaacaaaagacacattgaaaaattaaaaaaaaaacagattcagtgtatgaatgaatccattcgccgttatatctgaaggaaagtgcactgctcttcaatgtcattgtagtgcctcgatagtcgtcgttattgcaacttgcaagggctaatacgtctatggtttatagccgagtgttagttgcaatgtgttacgataccatatcagtatatcacaaaacaacgaagataacataatgatgatacaatatatcgtgaatttgtgctgaacaacaaagatacaatctcctaaacatttaacatgagtctatagttatctctttatgtttatatgattagtatgtaccaatcattttagaaattagaacaattgtagcatacgacattgtgtttgatcactgaatgacagctactaccattttacaatttctacgtgtgcgcgtgcttttgtcaatcgtgacagcatagcgtcttgatgatgtagttatccatctccctgtcgaattttaattcttttgggttgcaaatctcattcctctttcctgcaaaccagctccatttgctcgaacgatttcagtgtttttgccaactgtgacaccgacttgtggccacatcctgatgcccagtaaaaaccattgcaagtcaagacgctgcacgatgaatggtctctggggttggttgacaaatgagaaccggtgacaacgaatgctggccgtgctcagtcagtctgctggaccccttcctacatgtgtcaccgttcttcaacacaacgtctgaagtttgaacattttttgtgttgaacattgtgcttctctgtcttcatatgttgcaggaggaaagatggagaaagtgctgagagtagccatggaggtgatgagtcggcaccatgctcccgatagaagcctgtgcttactgttactgctgctgttcttgcttcttggtgtgcccatggcagcgtccaccgaacaatcgccagcgcgactgaacaaggcacacgaggacatcatgcgagatattctgagctcggtgggcagtaccaagaactggaacacctgctcaaatccatgccaatggagtggtgttcattgctcttcagttgcatcctctgcgtttgtcactaggctatccctccccggatgtggcctctccaatgccaccatccttgcgtccatatgcaatcttcataccttgcgatctcttaacctctcgagaaactcgttcaccgatttgccaagccaactctctccgtgccccatgaaggctgaattgcaagtgctggatctcagtagcaatatgctgtctggtcaacttggtgatttcgttggttttcacaagctcgaggttcttgatttgtcctccaactctttaaatggcaatataagtacccagctgagtgatttgccaaaactgagaagcttgaaccttagttccaatggttttgaaggcccagtccctacaagcatcgctacctctctggaagacctcgtgctctcgggtaataatttcagtgatcatattccaatgggtttgttcaggtatggaaatcttactctgttggatctctgccgcaataatctacacggtgatgtcccagatggcttcttgagcttcccaaaactcaggattttggtcctttcagaaaacaacctgacaggaaaaattccacggagcttgctgaatgtcaccacactgtttcggtttggaggtaatcagaataattttgttggctcaattcctcaaggaattaccaggaacattaggatgttggatttgagttacaacatgctcaatggtgatataccctctgaactgctctcacctgatactttggagaccattgacctcactgcaaataggcttgaagggttcatccctgggaatgtttctcggagcctccatagtattcggcttggtcgaaacttgctcggtggaagcatcccagaatcaataggcaatgccattgacttggttaatcttctgttagatggcaataagttggttggatatataccttggcagctcagcagatgcaagaacttggcactcatcgatctgtcatcaaaccaggtgcagggtaatatacctattgggctgggcaaccttgagcagctcgtagtcttgaagctccaaaagaacaatctcagtggagatatcccaagttcattttctgacatgtcagccctggaaatacttaacctgagtcataactcattcactggagaactacctttcacaaattctactcagtcactgaagctctgctacttaggtttgcatggcaacaagctcaatggtgtgattccatcgtcgatcagcttgctgcagtctctgatcaccattgatctggggaacaatgagttgattggaattatccccacaaacattggaacctttctgaagttggagcgtcttgatctttcaaaaaactacttgtcaggtcaggtgccatcctcagttgcaaacctggaaagattaatgtgtctattcctttcagacaataacctttccggaccattgcctgagctacctaaatgggtgatggtcaatgtaactggaaatccaggcatcatactagacacggaagaaaatagaacttcaggcagtatgaaaggctcccaggatgatttcagatcagctatatgggtcgcagcagcttcttttgtacttggattcagcttgtccttctattgggctggaccaggggaaaaattgatgccaaggttggagactcttcactgtgacgattgatgatcattaaatccatacctgtgtaggtgacaaagttgatccatgtattagtaatagttgcagataccttcaagtcactacgagatgtactaggtgacatgaaaaaggattaaaggccattattgtatcatccttaatgtacaaatgctgaggtaagcctaaggttgatttgcatagtcctattgataaacggaggtggctgtttttataggtggttattttcaagttgctttggttactgaattttttcttgaatttatttatgcaaatattgaagtctttagttctttacattattcattctggctgaatcatcacaatccagtcactatattaaacccaattttttattgaagcattgttggtgtacctagccaagaagaattaatttggtagagtttatgagtgagcaagtagaaatattagaaccaaagcaataccaagtttaggaaggaaagatcaagaaaaggaagtagtttagattgcgaagagcagcctcaaatttaagaaaacgtacagttcactggaaaacatgttctttgtcttctgtagatgacaaaagtagtagcaggattttttagaagaggctttgtcctatacgcaccagccatttccattcatttctgtaatcaggccttctccgaacataaaaggaatcacaaacaccacattaaaataattcatgaacgcggattgtgctgtgtctgaagagcatgtgcttcattttatcagatagaaacaaacttttgcatctatcctaaacatgtgcatcactgcatatcaaagggtgattaacagagtagtatgagttgggccagcaaatgttcactggaagtgctcctaaggcagtatgagtctggcttctccatcgttcatctcaaagggtgattaacagagtagtatgagtctggcttctccatcgttcatctctaaggcagtttcttttcagttttcacaagcccttgtcatgtacgctaccacctttgggattgttgtttggtcaggaagccttgttgggtttgttttacagcggaatatgatgcactttgctgaacgatatgaatattcatctgttgttggttgcattgtactactacacaattcttcagccaaattattgtcatagtaatcaacgcatgatccacagatatgttttgctgtaaaagggtgtatcattacttctttagtgcttgtaccgtgtgcagttgtgcatcaatttcaagaacatggactgcttaattaacttttgtcaggcaggagggccattgctggttgcaacttaccttgttctcagaatggttgcaacttaccttgttctcagaatggttgcagctttctttgatcatttggcctccctttatgcattcatctgcacaagcacaacacaggatagagaaataagtggtgactgatgaatgaggaagagcagcaacgcaggggggttaggcggatctgatgcatggtcacgccggccgccggcgtgggccgctccgaggctgccggtcgccggggcggaggcgccgcctcgctgacgagaacccgcgggcgcagagctgggaattcgagagatttgttgcaaacctgattacgaactgaagctttggttttctctgaatcttcggaggtggaagacgcggaggggcgcggggaggcggatttacaccggagacggaggaggcggccagcacgcggcgacggctgtagtggagtcgtcgccggagtttggagcggcggcggcggcggtggatttcgctccgaggaaggaagaaagatgggctgcttgggctgaagcgggaaacctgaaacttgttagcccagaacggggaagcggcccacgtggtgcctatactagttgggcccataacgggattgcggcccatcctacttgggctggaaggaggaattttttttatttataattttttttattaaaagttttacaaaaataattttccaatttgaaaattaacggaagtagtcgcctaccgccctcaaatcgccctcccagagggcggcgaaaatgacatggcagacggccgttcgctctcgggcgacggccgtcaacgaaatttgcaggcggcccccttgccgtcctccgcgagggcgattttgtactgtgcggggggccgcctgcaaatgggcggcgagggggggcatggaattttgcaggcggcccccttgccgccctccgcgagggcgattttgtactgtggggggggccgcctgcaaatgggcggcgagggggcatggaattttgcaggcggcccccttgccgccctccgcgagggcgatttttgcctcaccccctataaagcccagtccctcctctgtaaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaacagaaagatataaatgtttcaatgcaaaccgaagatgtagagggttctatcaatgcaggggatgttgttggaccatcgatgcaaaatgaggaaaatcaaccaagggaggagcaggctatgggcatggcagatgagggggagagagtcggtataattgttgatgaaatggagagggaagattcggagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattacttcatttttgtttcagcttttgcacgattatgtcaccatgttttaactgcacgtttcctcatcgcaggacctcgtctgccttcgagcgcgttcgtaagcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcaatgaaaacgacgttatataattgacaatctgaaggcaacctcttaatattttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcgcggtgggcggcaagggggccccctgcaaaattccatgccccctcgccgcccatttgcaggcggccccccgcacagtacaaaatcgccctcgcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcccatttgcaggcggccccccgcacagtacaaaatcgccctcgcggaggacggcaagggggccgcctgcaaatttcgttgacggccgtcgcccgagagcgaacggccgtctgccatgtcattttcgccgccctctgggagggcgatttgagggcggtaggcgactacttccgttaattttcaaaatggaaaattatttttgtaaaacttttaataaaaaaaattataaataaaaaaaattcctggaaggagagagcggcggagtgcgtgcccatactagttgggcccataacgggagtgcggcccacgtctggctcatcctacttgggctggaaggagagagcggcggagtacgtgcggcccataccagttaggctcggaacgtggcttttgatgggcccataccggttcgctgtctgcaagaaccgggtgttttccggtgatcatgtcagcggtagcattcccatgtatggaaatcttcctctcttgcatatctcaactgcctccgtcccagaaaaatctaacctaggccttttttttttttaccaagagagtagtgagcaatgaaagttctaactttttttttaaaaaaaatgttcctctcttggatgacctcagccagaataatctactccagttggtgacgtcccagacgggcttcttgagcttccacaactcaggattttgctccttccatgaaagggcaacctgacaagcaaatttcgtttgcatgtaagaaagaagacttgaggtacgacatgattactggtgccgaatttttttcattaaaacaaaacagaaaacaaattaaatgaataagacacgcatccccatatctaaaaacaatttgagctctaactgtgatggcgggtaatcattttctatctagcctcctctagcagcaaccaatagaggccattgcttcatttatcagaagggtgatctcatgcaccatattcgatcagttttcatggcagtttacatcagaaaaaaaaaactctggacggatctgattctggtgggtacagaagaacaaggttttctacttttcccttcattaactaataatttgatagattttagagggatgcaattaacaatcagcattggtcattttctattccttctatgatgcctaaatatttcccctagggaacacttaatgttcagactgaaaatatcagggtagagtacataatccctcctaagtttgcaaagctacaacagtttatctagaaatacagtattgtagcaaagtaatatttcatcgatcacaccctcataaccagaaaccatatattgataaaaatgtaaactacaaccggcattaattgctcagcaatgattattcagtttatttaacatttgaccacccaatttctcaacttatactgtagatgataagttatccagcgccaagtttccagaagcgatgcatatttagtttagtatgtaacgctattagcatctagtaatgggatcctctagagtcgacctacaggcctgcaagttaacaaggatagagaatatcctacggttataaatatg

SEQ ID NO: 64368 - DNA, 26578 bp, Oryza sativa
tatatatatatatatatatatcagatctggaagctgaggaaagaaaatccaggggtggtcagtgaagcactatttgcattgtcatgtggtcctgatctccgagtaaagagttgtgcatcttgcattgtcaacggagtccggtatagcactgttgaccgtgagaaatacctccaaacgcagaatagtggtgtaatggttgatggtacacatgaaggggataacattgaattttatggtgtccttagggagattcttgagttgcagtataactctgatctagatatctatcgatcggtggttcttttccgttgtgattggttcaatcaagttggcaagacaaaaggagttagggatgacgggcatttcaaatccatcaacatccaatcattttggtacaaggatgaccctttcattttagcaactcaatcgaagaagatattttacttgcaggacacctctttgggcaacgaatggcgaattgtgcagaaattcgaacataggaacatgtataatgtgtctgaaaaagatgaccacatttttgatgtacaccaaaatgataattgttctgatacagaacatgaagtgcatgaaggtaatgctgatgaggatctagaccatttgcaggaagatggagaagttactattattgaagctaatttagaagaccttaacaaccaagctaacttgactgaagacagtagggatgatgcagatgaagatgacacaatattgcagtactgtagtgacagtggcaatgggaacgctgaagatgacatgccggaagacaccgatgatgattaaattatatcttgagttgtgtcatctatctgatatgtcatatgtaattgggatgagctataaactcatttattttgtgttatgtaactgagatgtcacaactgatttattctgtgaactcatttgccattgcagatctgaaacacatcgagattctgagctagcaattttaagaacagagttgttaccagcaatgatttgcatttatttgatttctttcccaggttcatggtgctaactcatattcctaacaatatgtgaagcagttgggtcaaaaatttcaggagaagagaaaatattttacttctgttttttgggcaatccagtaagtttcctggtgaaacagtatgcaaagtgatgtacatatatatttgttccaagtgacatactgcatatcagtctaaaactgtacagaccatgacatttcaagcagcaaaaaccaatttcaatctgtacaaacacaacttacacttcaagcatctgttcaaagcattacacttttttcttaattgtcatattcaattgacataaaaaaatgacacaaatatggtcttcacattttcaaaataacacaataatcagccataagtttattcacattcacgatctcaacctgaattcaccaagctgtacaaagaagtatcatttcttctcaagctactgttgtcgcccacatccaggaagcaagcagcataagcaccagaagcttgctactcgatcatggccagcaccaggtcctcttcaccagcagcgctaagagcatcggccttggagatgcggcacctggaccagctgctactgcggcgatgcggtcggagtcagagacgggatgcggtcgcacgtgtggtgacgcggcggccgcgctccatcggcagcagatggcgcggaggcggaagaatgtgtccggcgggaggcgtgccaggacgcgctccagcacgccgtcgtggaggtccccagcccacgcgtcggcgggctcctgcgcttcctgctaattctcaccgccatggaggaggaagctctttttttttgttacgatttggtttggtttggatctgaatccgttgttatatgtgtgttgatttacgattgtaccctcgttatatgtgagttctaccgataagaatgaggggtaagtcggtccaaaccacccggtccgttctattaaaactggccggtccaacatttttcctacaaacaccgaccggttcacccagtttaaagtgaacataaaatttttaaaattcaattttcaattggacctatatactccctccgtcccataaaaaaccaacttctgactataaatctggacgcaacatgtgtccaggttcatagccagaagttgatttttttatgggacggagggagtatccatgaatggtaaactgagacgattttatcacctgcctggctcaaatcctccgtcgccgatcatcctccagcttggctttagatccaccggcaacgccaccgaggctggaaccaggttcttgcattccacggtgtcgatggtgaatggcgaggtgagcaaccacgaggatgacatggaggtctcgatgacatgggagacgacgaccgcgcccctgtggtagacgtccacagcagattttgactatagaagagccgacaccaatactataggtgttggttttcttttttttaaaaaaaaaccaacacctttaatttgtcataggtgccaattaattaaaaaaagacgcctataatatattataggtgctagtttctaaaaataaattcagtcatgcttaaagtagtgttgtggaaaaccgtattccgtctgacaaccgtattccgattaatcggtgaatgcttcttaaactactaaattgtctgtgttttccaaaaagtttttataggaaagttgctttaaaaaaataatattagggggtgtttagttcccacattttttttccaaaaatgtcacatcgaatgtttagatacatgcattgagtgctaaatgtagacaaaataaccaattacacagtttgcgtgtaaattgtgagaccaatattttgagcctaattgcgccatgatttgactaagtggtgctgcagtaaacatttgctaatgacggatgttttaggcttaataaatttgtgtcgtagtttacgggcataatctataattagttttgttattagtttacgtttaatactttaaatgtgtgtccgtatactttaaaaactttacaccctggaactaaacacccccttaatccaaattttcaagttatataatattgaacggagggagtatatttttaaagtcaaattgttaatccagatagattagtataatttgaatgtttttgatttatggataatgttaattactcatggatggaggatttttcgttcggcgcctaaacctaccgccaatgacagccccaaaacattccattgccgcccatttgcccaaatcagaatgggaaatgtcacttttatcctccatctaacgaagagcaaaacaacacccaggggcatttgtgcaaccactatatatttacaaagcctctcacccaccaaaccctaatccccaaatccagccgccacaccatcggggcgccgctctaccagagccgccgccgactaccgccgcaccggagccttcccccgcaaccccgtcgacgacgaccgctgcgccggagccttcccgtgcaaaccgatcgacgacgaccgctgcaccagatccgtcccctacttcctcgtcgtcgacagccgccgcaacgacgccttccgctgcaaccccgtcgacgacgaccgctgcaccagatccttcccccactacgccgtcgacgacttccactgcatcggagccggtaccccgtcgacgactactgccgcaccgaagccatctcccacaacaccgttgacgcctaccgccgcaccggagccgggtaccccatcgacaaggtccctgcaccgtcgccgtacctagctgatgggaagacgtcgacgtccagtagcacgaggtacgcaaaattatcttgtcgtctcaagctcagatgtttatgtgtactgtctcaagctattagatgttatacatcatgtggattgatttgccgtccaacttctattaagaattttctgtgtgcaatccgattgaggtcactatctacaataacagttgatgctattgctagtttgctactgcatatggcattgtttctgtgttattcaggcgcacctttaaattaatcatgctatgttgattctcaaataaatttgtgcctcaagttgccataagcatcttccagagtgtggatttcagatcaacaatggaaattttatttagattctgctttgtttgtgtttatgaatgtaccaataatttgagttagtcgtataaatagatacagtttattaggtgaaagagaatgatataatggctatatcatttatatgaccaatgttgttcactgtaaaagtgtttccagagttctcatcaaaattgtcttttaaaatggaaaagtgaatcaccctgttgtttttactagatattgaagtaaagttgtttttcaccattgatcattaaatccccaatgttgatgagcatggtctctttttttttcatcccaaatgcctagatactttattgtttctatttctgaaaatgcttatatgcttaggaaatgccatcaaaatgccatctagtattctgaccattaaaatatgtgtattcatgtaagaacctgcacaaaacgaatatgaaagaacgcggcaagagaaaatcttgcagaatataagaaggatggatgaacttggcatcaaagacatagctgccactattaaacatatcgaaacacaacatgcatcttcaaagacaaaaaactcaggcaccaagaaaagtcatggagaaggttctgatacatcagagtttctccctgaagatgatgaacaaggggttcagtgtgatgatgattcatatttagaaccggagcagcccatccccataatgattgaggtgcttcttctatcttggctgttggggggggggctaggatatctgcaataatttttccgcatttaatttgtgcagcatttgattatttttttaatgattgttgctaatttattcacatgcttacaacttttgtgtttattattgtagtaccctcgacaaactagacgaaagaagtgtgcgacgaagaagaaacctaccctcaagatgccaccaggagtaaggatatcaaagagagtgagggcgggtgctccaaccgaaatgcctcctggagtctcaacaaggtcagcgaaaaggcaactcatagcagaacaaggtaaaggtaatggccatgaagaactgcctctagaaacagaaaacaatggtgatgaagatgtgggcagtggacatttgcttcaagataatgatgtgaacaggcccccgagcccggtgatggactggtcatatggacatgatgccaaccataaagagcaacctgcacagcaaaccaattctgatgttgaaggcaagttagttcaacgaagagaaatttattatttttaactatttgatgaatgctaacattgtaattgaatactctgtagtacctatacgaagaggcacaagaaaatcaaggccaccaactgcaggaataatgcttgacaagatgaccaaagctatgggaagaatgcccattgctgttgccgaagggaagaaaaggccagatgaaccggtgcaagctgccaagtttgcatcagaggctggtgttatcattaggactaaagttcctgtcttccctcattggaagcagtacaaggatgatgaaggctatattaacaacttcatgggcaagttatctgtaagagcctatctatattcttttatatttcatctattatatgacctagtgttactccttaatgattgcaattcaaaccatcaggtcaggttggccattaaccaaaaaaaccagccaacaagggatgcttgtgctgatgtattgcagaaagggatacgacaaacacggtataatttgaagaaggcctacttcaatggagtacctgctaacgagattagaactacctctcccataagtagcatgactgatgaacagtggctggaacttgttgcaaagtggtcaaatccaaagaatatggtatgtcatctctaatgacatatttgtttcatttcatacctgcgactatgtctaacacatacatcttttgtagcaaatctctgaacagaacaagcaaaaccggcttaatgttaggttccatcaggctacgggatctcgcagctatgctgcacacttgcacgcttacgtaagttcccattatcttttagcattaattgtagttaagaaccacttatctaatgtaatagatatataaaataattgatctgcattttctgtactgaaatagaaggagaagaacaaggttgtagagcttgatgttgtggatgcctttgaggactgccataccagtagggaaaaaggtctaagtgatgctgccaaagatgcaattgtaagtcactctgtatattcttacaacattgaactcaattccttgttacctatgccaacatattattaattcagctcattttatatttacatccataggataatttctgtccttagtgtgcagagatatttgcagctaagatcattacagacttaatggaatttatagactctaacaatgttagaatacataccaaactaaatttgtagctgctggaaacttgtcgctagacaacttaccatatacaacataagttgagattgggttaaaatgccaaataagctacataaacattttttcatcaattgatcctggttgcagtttgtatttttatcaatatcccgggtttgagggtgtgattcatgaaaactcatttttacctaagctgctgtagtggtgtttgcatgtattgaggttttgaatcatatgaacataagactgaatatatttcagcctttactacttcaaaacttatttcattgtaacttggaaaagtaaacttaattatgagggattatgtactccacactagtattttctttctaaacattagtggtttctagggaaaatatttaggcatcataggaggaatagaaaataaccaacgctaagtaacattgcaccccctccaaattttatgaaagtagttgaggggaaaaccttgttcttttatagctaccagggtgttccatcaatcaaaagctgccatgaaagctaatcaaatatagtctaaagtcagccttctgatatatgctaaaacagtatcctagattctgtcaagaagcatttggcctgcattgttgctagaggctagatagaaaataattacattctaccatagttagagctcaaaatgtttctggtctctttcacagttaagagggcaatgcaatatttctaaatatgggaatgcttggcttactcatataatttgtttctgttttggcttatggaaaacaaatttggttaaatttgcattctatacaagtttccttacctctagtttgtgcttcctggtagctttccatcagttttcagtgactttttgaatgtgttgtgcagctgccagtattttgaatgtgttatgcagcagccagtttttcatgtatctaatttcatagctaatgttcaatcattgctgcagtcaagtatgaaagctattatggaagaacctgtacctgatggtgagacaccaagaactagtgcagaagttgtgtccaaggttctctctcgggacaattccaataccacgtttttgaaaaatgctggtctgcagatgagctccaagaaatcagtgacaccgacagaagcagcacttcaggaagaacttgcagctgaaaagcaaagttcagccattctccatgcagaagttgtcgaactaaaagaacaagcaaatcttgcaaatgaagcgctggcaaagactcaaaaggagttggcagagttcaagcagcagcaggaagagaacaatttgctccttcgacgtatcttgagcctttcccagggtaacttaaatctgtcctagtctcctttatgatcttctgcactgtgatgaactccatctacttatattagttgtttgatggttctgtgaacttattgtcatgtggtggacttgattatgtgaaatgatgtttggtgctatggtggacttaatgtcctcctatggcaaacttttgtggacttaatgtgaacatatgtgtgctaggttctgtgaacttttttgtaatatggtgctatgtgaagttggtatatgtgatatatgttgatgttgggcctatttgtaatgtgctgtgaagttctgattgtttgtccatgtgatcaatcttgatgttgggcctattttcttatgtgctgcgaagttctgattaattgttgcttgaaatgggtgaatgctaaaaatttcctagatctcatagtgggatgggccacaacaatatgtgaagtatgtggccaaatgggctgggctaagaaaaaaaaaatgagcgggccttcatccctactgtgctaacgtgtcatccaaacaaatcaacacgtggcaacatcaggtaaagacgtgtgtcacaaatcagatatgtacacgtggcgcttcaaaatgagagcacgtggtgcctccaccttcggcaatgtggcgttagcgtacaccaccacgtggacatacaaaatgtaaacacgtggcgttaaatatgactgccacgtggtgtctccacctttggccacgtggcatcagcgcgcaccaccacgtggacataagaaatgccaacacgtggcgttaatatggctgccacgtggcgccaccacgttcgaccacgtggcatcagcttgcaccaccacgtggacataccaaatgccaacacgtggcgttaaatacgactgccacttggctctagcgtacgggagatgatgatccagcgtggcgtacacgtcatccgccacatcacagccaacatggactccacgtgtgatagccccgtggcatggacgacgtctgtcctagccagctgaaaagcagttctatgacgagcaccttcgtcatggatataagcatttctatgacgaaatctactgtttagtcatagaaaaacatatgtgacgcgacttctatgacgaatcccatttcgtcataaattcgtcatagaagttactttatgacgatttgcgcgtcttccatgacaaaagtagattgtcatagatgtgcctatctccactagtgaagtcccaagtactcgccgattttgtagctgactggaccatgcctgataatcaatcagacaaccagatcgacaacgaaacgtggatctcacgcccagaaattcccgaatagaattccaagcagaatgtgcattaaaatccccgtccaggaccggccggggtacacaaacgacaatattgacattcagatccacgtcttacaaacatcataaaagtcttacataaatgcagcggaaaaacgaaagataacaggagctaagccttgacttgaactgcagtgggaacaccactccacaggcatcctcgacggcacggacgaagcctactcctcggagaaaccaccatccgacacatactcatactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacaattgtaataattaatcaatattaatcatccactgtccaacgctataccacgttgcgacaggcccaaccatccatctatactatccaatttcaaaagactaaactaggggtgagactaatcacggtgaatctggttgaccgcccataaccacgggcacggctattcgaatagttttactctgatcagaggtgtacaactgtacccacaagacacagccccacgacacgtttccgtgtgccgacatgccaccacgacataccggaaagaggccgtgacaggacccttcgcataaccccctctaaccaagcacaccacacctcaggtttcacccccactcctcgcaaggcaacgggcagtcccctctcgtgcctaggtgaatccggaagcgacagaggccgtcgcagggcctgccccgctccatcacacccacccttgcctggatgcgtcagttagaggaaagctacactacaagcccagtcgttgcccacgctggcttgtggtaagcacgataaattcttccagggtttcccgtgcagcaactctttagataagagtcgaaccacacctcgcgacccctgagtgcctccacggcctggtcttttttcacctccaccatcgccctctcgagttccgcgacttcacacttcgtcttccaatattggatgcaacggtcttggccggcaagtctactctcgaggtctgctcttccattccgagaacataaaaaccaagttactccgggaagaagaatgaaggagatgaaaacaaagatcaccaacctacggaggtcatcgccatgcccatttccacgggtgagtttcgtcccatatcgtcctgcgacataggcgtttgaagggtaatcgccggggcgaccaccggtaacttgggctgcccacgctgctggacatcctcgacatcgacatccctacaaacgacaaccaaaagtactcaggaccagggtgccaacagagatcaaggcagcgattgcacgaataaaggcagttgaagccgacaactgttatacaaagtgtagtcgattacaaatgatctgaggccctactcttcaaaaagcgggagaacagactctcccagttcgccaacctcctccatcacgcccttacgagtgtcgttggcggcccccctgtccaagatctgccgaagatcgagttcgggatgcgccagtcggacacacgctaggacgtgacaggccccggtgtaaatcccgtttgacgcctcctccacgatcctggccatatgcttggagggtattgcctccatcgccgtagccagttccacaagtgaggacgtcagcgagaactcgccggggttcgctgggatggttgacgtgatgccacactccccggcgagctgatgaagaccggtgtaggtgacccgcagcgacccacggatccccgacaggttgttcttgagttccgacatccggtcctcgagtccccgccattgccgctcgttaccggccaccagctccctcatcttctggaggtcctcgcgaacctccgccaggtcgcgttccagcttgtcggcacgctcgttcgccgacgacgctgccgctgtcttcacctcctcgatctcgcgacttacgccgcgagcgccagcctcgaggatgcgttgcatctcagcttggagctccccccaggtgaggacattagcagatggcccgcgagtaggtccgagggcactggacggactgcttggcgtcgcttcacggctctttggcgcgacaacaacatcggttgaggttgctgcaggagacactccagaggccccttcggacttgtcctgcgccgctcttgcctgcgccgacctgcagaagatcctcaaatcaagccatcagaagacaaacgaggagaggatctcgacttccgcttacttacttctcgcctagcgtcaccagcttcctccgccgcggaggtggcgaagacgcgtccatggcctgggtaaatcaagcacgagttgagggtgacatctcttgaatacgagattaacgaaccaagggacttaccgatggggaggatgctctctggcggctgccgagaacggaggtgaacatccttcccgttttcgggacacggctgccactagtcgtggcagcagcggcgacggccacgtcgggcgtctcccgagcgacgctctccttcagtgaggccgccgcctggtggtccgcaaacggtccaataacgtcagtcagagggtgagcctacaccgcatgaaatcattttccgacccgggaagcaaaaatagcgaggttaccgagtacactcacgttgattgcggcttcgcgctcggtcacctccttatcacaaagaggcatggggacgtcgcttgccgttgtcgggccgttgatcatcaattggccgacgcggcgctccacagtggcgtcactcaagcctgcagatcaagaacagagttcaataaattagggagaacatgcacagaagaggatcaaattaaacacaagaaaaataccccgaggagaaacccgggtcgcgtcctccggcccagagtagtcaaaggctgggtgggggcgagcctggagcggctggatccgcctactaatgaagtcggtagcgacttcataacccgacaaacctcgcgctcggaggtcatcgatggcatcaatgaacgactgaagagcaggggtcaaggcgggttttgcggtccaagatgggattttgtctggttgttcctcaggaacaaggaaccacctcgcccgccacttgctacgagaagaagggcactggaaggggatatatcgcgacttcaggccatctcgaagtcggaaacccacacatccagataccctggtagattccatccaacgcaactcatagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaacttagaaggcggaggaagaaagccacagagaatatagtcctcgatcgcaactatacggcccaggacaagttcaggttcaatacctcctggttccctctccatggctccgcggccggggaggacgccatcctcctgtagcttcttaagcgacgcgctggtggaggtagacttgccgagatccatcgccgccggagatcgccggagaaggggccgagatgaacaagctagggctttgcaggagcggaggagacaaggaacgcctggaggctggagagctttcttcacaacgggcggacttcaaaatggatcctcaaaatcctcttaaatagacgcatttccgacggtgcgaattccaaggaaaggagagagagattaccgccggaaatttctaggtccgttacgcacggcagtttttcggacttcagtttaaattcactcatgaccgttgggcttcacatggtgttgtcgattgcgtcctgtctctacggttcgcacaccgagaacgacaacagcctcgacaccagaagtcgcgatcggttacacgagtccatttaagcagaaatcgggggctactgtcagggttacgggtaaggtataccctttacccttcgatacatgccgcgtatcggtatggtatacctgcgcgtatacggacgctctctgcatacattaagggaatccgtcatggagttcacagatggaaagagtcctactcggacaagactgggtcgtcagtgcatcgtgcagggtccgatatctccgagttctacttggaaaccgcttgacctgcgttataaaagggaccccctgggaggacctaagagagggaatctgatagccaacatcaccaccacagcctacgaagtcggagcctgcgaaagccagattgccgagaggtctagtcggattaacccgatacgatctcgtcggtttcatcgagttccatatttccctttgtaacctgtgatttccatcatataatcccatactaactggattagggctattacctatcaaggggcctgaaccagtataatcttcgtcttctgtttgcttgatgtcgtactacgtagacccttgtaccagcgtaccccaatactctctatatccggtctacgggtatcacccgtggacagaatgttatctcaatcgggcctaaagttcccgtcacagatgatggtcatctgtgacggccgcaactttaggcccgtttgagatatggaatgttatctcaatcaggcctaaactacggcccatcactgaaaggtgtcatccgtgacgggcttaagttttatgcccatctaacatgtctgtgcgaccatatctcaatcgagcacttttcggcccgattgacatgacttccttgtgacggcccgctatttctaaccatattaaagttcgtcacagatagaaggatatgtactagtgtatgcgatcagctttatggaaagcccaaaatgctactccctccgtttaatattataatactttctagtattgcccatattcatatagatgttaatgaatctagatacggtatacattcatacagatgttaatgaatgttagtaatggtaaaaagtctcataatatgaaacggaggaattacatgttttaaaaaagttgccatacgagtattagacccccactggtccgatatatgatgcttgttattggatcacctattggtccatattgagatgcacgaagaaaattgtaatggggagtggctctgccaaggaaggtacgtagccgccaagatgttttgttcgatctagtcatggctagaaactggtcaccagccgattggagtgaagatgaaggatggaagcacctcatgctctgcacaagtggcgaacctaattatctaagacttggaccaaagagaaatggccttcaaatcaccatgaacgtggctccttcttgccttcctcttgtttcagtagccctatcttctccttttctgtaattttctttagtcgctctggtaaacctttgtattttgatcttttattccttctaatataaccggcagatctcatgccatcttaattttcaaaacaaaaaaaaagatgctctgctgatttttttttcttcatgctgtagttgatagacgtcttatatgtgttctggaaagtttggtcccatgcatgatggtcggatgacaccgttcgtacggcactgttgatcccgtacgtctagatgcatgagacgtcgatgagccggcactaaattcatgcgttcacaaacggtccaggcactccacaaactgactaggaatgcccaggagtaacaaacttggtgttcacctcgagtgctcaaaaggatgagcctaggttactccgttgcactaaacatgcaccagagaaaggagaggagtgggagagctaaagaatatacaatagagaggggggggggtctcatcttacattacatgaactcatcaaaacagaggagatgaagttaacttgtccattcactcaaaaactaataatcgctactaatagattaaaattggaagttcgaccctcagggggccgtaaaggagtttgggtggcatcaaactataacaacggaatacgacgagacaacaaactttcatattcaattttttaaaggtcataacgtagatgaatagaagccatggcgaaccggacaagcaagtaaaaggacggcaaatgagtaattctatgcggttggtgtgacttttaaaaactataaatgaaagcccgattatgataagttttaatttttaaaatcacaagacaataagataaatgtttaacaaattttaaacaaataatgtgtaaaaatttagatagctttgtataggtgttagccgcgcaatatgcacgccacctagctagttatattatcaagataatcttaaaagcatgcaccacgtttaatgtggtggctgaaaatcccacattagtcgaggaaaaagaaaaagatcttattattagattacggtgggtccggattataacggtgtagattgattaatatagttgtatacgagatacaattatatatgtagaaatagaagttaacaattatatatgaaatctaagcttacaaaaataaaagctaatagttgtatatgaaatccaaatatttcaatatataatggtacctatagaaataaaatttcagagttgtatattaaatttaactctaagtgaattatctacctctgtgcaaaactatgcggaacaatccccttactcactactctatccatcccataatatagcaacctaaaaccggatgagatatatcatgttcaaattcgtagtactatgatacatcagtacatctcattcagtcgtaggttataatatactggatggagacggtacatttaatcgagaatagtcgaaaccaggattctctttttcggtttagccgatttgatctgaggccaccgatataccgaaattttaaacaaaatttagttaaatttgaacaaatattaccgaaattcacgaaaaatttaaaaaaagtagaaaaaatccggccgaaataatatcgtatccaaacctagtcgactgtacgagaatatgattcttgaaatttcagtccgaaatttccaaacctagtcgactgtacgagaatatgattcttgtataccttcatcgcgtgtttcggctggatgcttgtgttgatggtacagagttacggaatacagactacagagacacaggatcgaagctagtgtagttgtgttgttgctccagatcactaagctcgctcgtgtcagtcgagcaaaccttaagcagccatggctcaaggtcaacttgacgccgagagcgtcgtccctaccgccaccggagtccggaggcgaggaagacgtttttggctgtttcgtttccgatcatgtttcctcgatcggtttcgccgccgtatatgtctttcgttaggatgtactgccaacatcctcgcgtcgcttccgacgagggaaggatggtggacggcgttcgtcctctaccacggctgctggatgacgcagcaggccgccacgagcgtgtcgctgcctcgctggtgcacgcccagttcgcgcggcgccccgacgatgtgctcctcgccacctacccaaagtgcggcaccacctggctcaaggtgctctccttcgccatcgccaaccgccgccgccgccggcgaccaccccttgctcacccaaagcccgcatgaccttgtgccgttcatcgaggtgcccttccaccacctccaccctctcgccgccctcgacgcgctcccctccccgaggctgctctccacccacatgccgccccagctgcttccccggcgcgtcgccgagctcggctgccgcatcgtctacctatgccgggagcccaaggacgtcgtcgtctccctgtggcactacatgaacaaggtcggcaatggcttcttcctcgatctcgacagggccttcgagctgtttgtcgatggcttctccctgtacggcagtacgggccgatctgggatcactgcctaggctactggaagaagagcatggaggaacccgacatggtgctcttcctcaagtacgacgacatgatggccgacccagccggccacgtcaagaagctcgccgagttcctccgagccccgttcaccgacgaggaggtcggcgccggcgtcgtcgaggaggttgtgaggctgtgcagcttcgagaagctgagccgcctacccgtgaactcctccggggtggttgatcggagcagtggacggccgatggagaactcggtgtttttcagaaaaggtgaagtcggggactggaagaactacttgactgaagagatggccaagaagttggatgccgttattgaggagaagctgaaaggatctggtctcaccttctgattatctgaatctgatatttgttagtattttttttatacatttatgctttgtgtgctcctgtgtaaaagtacaataatcctcagaatctcttgtatttaaactatgtcccattgtatgcacgcttgcgcaagagttggaaaatcttatatcgctcactgcaataaaatgcaatctatttcttgttttcaagggctggaattttgtgcgaacgtagaaggattgcacatcaatatattagaaagaaaaggagattttgttacacaacgcaatcggccaaacaagcctatgccagaagaaagaaagaaaaaaaaaagaaaaaaatactactacgaaaaaaggttactccaacaaacgagagggaagaggcggagccacactacactcctatcaaatccccaaaagcggcattgtctgcggaagacaactgacggccttccgagcggatggactctataagcacggataccgaggagagcgccgagtcgaaaactcttgagttccgttggggctggaaatattaatgaactactatctctatttcaggttataagacttcctagtattgtccatattcatatagatgttaatgaatttaatcacacatatatagatatatatatctagattcataatatatatatatatgggcaatgctagaaaatcttataactgaaacggaggaagtacatatttgggcctcatttgcaccgccaaaaacggctaaaacctacttaaaatctgtctagttctattgtactataggtagctacattttaacacgagagagtaaggggttgtttggttgatgtctaactttactacaactaaccgtaaagtgtgaaataaaataaaagtgactatgaattagtatgctataagtgtgacatggtttaaaaacataaaacttgtgagcctaaaatataagtcaaacacctacctaaaatataagtcaaatatagtttggtaaagtgaagagatgaaccaatcaacctaagatttaattttgatatcatggtctcctctcatgactggactagtatgacggcgctcggcgcggcgcgctcttccaccgcgtggacagccggtggtggccggagatacgaggcggctttcccgggaaaaacggcagccgccgtcctccagacctttctgggttccaagcccagcttaccgtgcagtagcacgagcgtcagctttgctgaaatttttacattttaatcctttttaaaaacttattttataaatagacccctaacaagacttaaaccgagaatggtcctttttggaccccagagaggctggcgccgtcctccaacatgacggcgccagccatcatggcgccgcgacagtgccaccatggcactagggctgtcgtagcgatgcggacttggcagaagaggggcgccagccaccttgacgccgcccctcatacgacggcgccagcatggatggcgcgcctctcctctgtgggccgcgcctttaaaccctgtggccccaccacctttctcctctccactcccatttttgcctgagtcgtagcctgagccgctgcttgttgttcttctccctctccccccctcacctctccacctcaaatccagtcaatttaaactcatttttcgcgggatttttcgccatgttagaggacggcgccagccactctggtgccaaaaaaaaaccatttttgttttaagtttttccagaggtccatttataaaataaatttttaaaaagtactaaaatgtaaaaatttcaggtcagctttgggtcctccaagctgcataaacgtcataaattgaacaatacgtggtcgttattttagtactactactgtcacggtttggactgccatttcggaaccagttagtgttttacttcttcttccaatgcaattatgcataaacgcgattgaaaagattcaaagttttgttaagaaccaaatgaatcagtagaattcaaatagtgaaattatgaaatcaaggccgaaactgcagttgtgcatcgtcgatgggtaggtggttcatgcgaagtcgtcagagcacgtacgcaccttgcatccgagggagcagaagccgaatcgaaggagtcgagcaggccacggccacacacctcacagcaccggccagcggcggcggaacatgttgcactcgccgcactgcgcgaagtatacctcgccgactgcagaggcctcagccaccgcgactacttctcttgaatcgccggaccaacctgcaatacaatgcacaacatcaaaaccaatccaggaagccgagcaattgctctcaacctagctcatcgaaaagaaaagaaaaacagaaatgaggtttggtcacttaccatatgcctaaatggtctctcttcgttgaatcgcaagaacaatgtgtcaactaaaccttgaacaggggaaatcccaagaacagaattctgctgatttgggatggaaatcgtaagaatgagtgtacagccaggcttatagtttgaagaatagtaagaatctgctcatgtccaaatttatagtattaaggtgtgttatctcttttactagatttgtttgttttgtgatagggagagtacgtgctatgctaaccttgcacctatagatggccatatggcccgagacctccggcccagcccaaggcacgccattttggtccggcccaagcatggcatggcccgattggggtcgtgcccgtgccagcccggcccgacatccgggccgtgcttgagctgcaccctcgacatggtgggtcggtccggcacggcatgatcgaagaaaaatagtatagggatgcaaataaacttaaataaccatataaggtaaggccaaaaagaagaggaatataaaatggacttattttttagccatatgggcatagccaatagagttgagagacgaaaatagagttattctgtggagaagcacgatgggttgtcgtgccttcggcacggcccgagttgtattggccgtgcctaggccgtgtgtgtagcccgtgggctggcacgacacggcccggcatgtaggttgggccatgccggcccgattaacctcggcccgtgcaagaaaaaaaaaagaaattgtcgtctttacgtgtttaaggcattgtcatcatgccatgttcagttgttcaccatgatcatgtcaaactgtcaagtgccaaaaactgagctgaccacaattagatgtaaaatcaaaagtgtttttgattattattctgtgatgaacaattggcatcggagattattggttttgttatttggaatttattcacgaagtggttttggagatgattggatttacaggtgaatcgcaggtgttgttatttcatgtgaccggtcagaccgggcagtgtgagccggacagaccggcgtgtatcgcgcggtcagaccggtgcagcccgcggtctgaccggccgacgctgtgtcggtttcggtttcgggttgtttgtttggatatccgtgattatttcatgattatggcttctagatggatactatacgtatgtaatactgttgtttgctactaatgagtcaagttggagatagcttggtctcggaatatggtttctttgtttatttcatgtgtaggtgactcgatgtctcggaagagtatttgcggtgatggaccggaagtcggcttggggataagacgacgtccgtggtggtcagagatcatgcggaatacttaggctagagttgatgcacgtggttgatggagattccatatggcatacgatggagttattgtgtgcgtatgggatgcggagtcgaatttggaaggagtccaaatttggtatgattggttatgtaaagtttgtttcttgtactagagggtttcctaaggtgtttaggactcctagtatgagtttggttcgtggctttaggctgcctacctcgggtataaatagagggggagcgtgaggcttcccagtatcgctttttagagcaattgagttgagttttgagttagggtttcgagtttagtcgaaatttttgtaaggagtgttgttggtgcactttgtaaacatagagagaatcaataaagtcgtcatctactttaagagttctttgatttctgtttcaccgggtttcggcggtctaaccggcgatataccggcggtcagaccggcggcaagcggcggtcagaccggcaggagcacggcggtcagaccggcggcggcgacaggcgcggcaggcgacttcggcggtcagactagagattcaacaccggtcagactggcggcatctactcggtcagaccgatagatcaatctcggtcagaccgacttccgtcaatttcgagggtaacttttatttccgctaaaagttttcggtttttgggtataccaaccattcaccccccccccctctggttggcttagttaatgtgattcgatcttacaagtggtatcagagccttgttttcttctttggatttttatcgatctagagtttttgccatggctactcctgttaggttttcaactaagcctcatgttttcgatggaacagatttttctcattggtgtagtaggatgcaatcttacattatggctgaagattatgatatttggagaaaagtttctcatccttatttgattccattaatattgctactgaaaaaactgcttttgaacaaaattgcaaagctcgcaacattcttttgagtggtatttctcgttcggattatgatcgtattgcgcattttcgaactgcatatgaaatttggaatgctttgagtaactttcatcaaggaacaaataacattaaagaacttcgtcgtgatattttcaaaaaggagtacattaaatttgagataaaacctggagaaactttggatgactatctttctacgtttaataaaattttgagtgatcttagatctgttgattcttcttatgatgctaattatccacaatctgagatttctcgtcactttttgaattgtcttgacatgtctatttgggagatgaaagttacatctattcaggagtcggttgatatgtctactttgactttggattcactttacacaaaattgaaaacacatgagatgaatgttctttcacaaaaagttgattctaagtcgagtgctttggtttcttcttcttcttctttggatgttgatgcttcttcatctaagccttcttttctagctatttttaatgccacatccgatgatcaactcgaacagatcgaggaggaggatttggctttggttgctaacagaattgctcgagctatgaataatgccaggaacaggaaaagaggtggtccaaatcgttgcttttaatgtgattcaattgatcatcttcgttcgcattgtcctaagcttgggagaggcaaaagagaagacaaagatggtgagaagaccaacaacaacaagtcgaagggttcatccctagggaggaagctggagaatctcaggaaggcttttcaacaagtttgcgccgccttcgagccactaagtgatgtagatggtaagagtggagatgatgacaagggaaagaacatctccggtgtttgcttcatggcgcgtggtgaatcggatacagagtatgaagataatgaggtaagtgcttttgaggaagctattaatattttgagtgtaaaaaataagaagtgtaagaagatgtatagaaaacaggaatttatcattgaatctcttaaatctgaaattgataggttaaaatctcttattcctaatgatgatgattgctcaaattgtgaggttttaatgaatgagatttcaaaaattagagatgttaatgctgcacatgatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgtttttgattgctcaacaagtaatttgaataagatgaaattgaaagatgctttagatcgtgttgagtacatggaagatgttgtaaaaaacaatgaagtgttttcttgccccagatgtcgtaaaagcaaaggtgttatggtagatagtgaaaattgtgctaatttggaaatggaggtttcttatttgaaaaattctttgctaagattttctgatggtaaaaagaacctcaacatgattttagatcaatctaaggttagcacaaataatcgtggtttaggttttaatccttatgctcataattctagacatcctcctgttgtgttaggtgctggtgctagaggtggtgagattttggttaaacctgatactaataaaattgtgtttaaatctgctagtattatgtctaccttgagtgcatcttcttcaaaatccaatgttgtgcatgcaaaacctcttgttactgcttatgttgctaagtcttctaattctaataatgtgtctaatcatcgtgaaaaatatacttgttctttttgtggcaaagatggacatattgttggtttttgtttcagattagctcataaacagaaaaaggagagagagattgttttttgcaaaatcaaagtggcaaaaatctggttttccctcgaggaaaccggtcagaccgtagtggatcccgcggtcagaccggcgatcggtcagaccggctgctgtcggatcccaaaactaatgattcggaaaccgacatgtttaactgtatcaagccctggatcagtagattgatacagcttcaacaatctggatctttattgcgtgcattagaacaacgctacaaacgagatgttgttccataaattaataggggaatataaaagattgtggctaactattacagtagaagctatagagtgactcaaccctaatattttgctattgacttaaaccatctaactaatctagatttgagaactaggttaaaataagactaacttatatgattgaactcctggcttcggcaagaacttcaatttaattctggaaaaaggggtttgaagcaagggtcagcaagctattatattcaataatgaatgtatgaaaaggtaatatttgagtaggattacgattacctgcagaaggcagagaatatagaaatagaaagcctgatgttttaaatgcagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgtcaatattcattagcttagtcatggcaaagcttttcggttactagcatcagtggcacctgttccatgaactctcatcctcatgcgctctgaacgtaattttatcagcagcgagaggagttctggcgttcccgaggtttttagagagggaactggtttgagagacccccgtcatctcaaccaggttttcacaatatacacacacttaactcaacaaatcatttacctgcgcctcagtaaatgttatatttgcccttctcggcatatgcccttctcggcataagtttgcctcttgcacgaggacttaaataagaaccactgtacagaggtaccacctttgctagataacttactttgcaaggtctgtccccattctagtattgcggccgtactcgttcgtttgacataagtacttggtaataactatatcgactgagacagtactagccacccagaaatcaaccaattcctacgtactgtcccaatctaagttcattatatttttatgcaaactaactaggcagggctaagcaaagctagcatatctggttttctatgttcaggttatgcattcaaaatcatgtatgactaatgcatagaatagagatataagaatataggatctttatgctcaaaggggatgaataataacttgcctttctccaacgcgaataaatccaaggtaggcaacctgattatccgatccttgaaatgccacaggttgccatccaaaataagataaactctactgaagaagaggaagagccaaattcaataaaagccataaaataaccagaaaacgataaacgtctaagagggatagggtttagggtataatctatctcctttaaagggtatagggattattgggttaatattttatgtggaggttctagagggttggaggttgaggtggagaggggatcaagcaactcatgtcatttatatttcatgtgtgggtcttggttgcttggagagtaagggatataactggttaagtgagtatgtggctagtattggctggtggtaggtttgggtagtataatacctagggtttggttatatttaagccgattgtggagtagggcaacatatcggctaggttctatattttatgtataggttctagaagagtaggtagctaatagtatggtggataggtgggtatggaatttggatggtggttggaatttaattaggaaggcatcggctagggtttgggtgtttgctagtcgttgctagagttgaacagtataacgactagaattggtatcttctctacccggtgtcaacagacagcataatagctagagggataggaggtttgtgtgggtttagtggggcgcaagtgttactccgacaaccgtgactggcggcggagaggctaggatcacacagagcccaagagctgactgtgcggcgtgctgtggagatcaaggaaatagtgaagctccgaccactatacgcatcgaggcttcgggtgccaggaggagcacttcgaccttaggtttggttttgccgggctttacaaccaacggtccgacgtcggggatagtaaaccgcgaacgtccccatgaaaggcgtaaagttccaaccggtggctttttagtggctaaagggtattttgggttaaaaagaaatatttgaaaagacaaacataaattcaaatagtatttgaataaattcaaataaaatattaaaagagtaaatttggggtcaaaagatagggtttgaatttagctggatttagatccaagtttcactggaaccggatctacggtttaggagatatgggcttctaaagaataggatttgaactaaatctagaaaagacgaaaatgcattgttcatgggcccacctgtcagctttcctttttcttttggggctatctatataggaatcgaatgatttctgaagctccaatcatgcagattttatctaccat

SEQ ID NO: 64369 - DNA, 1483 bp, Oryza sativa
aatatgatcagagcaggattacttactatttaatttatttctgcttttggcttatggagaaaaaatcagttagtggtgagatgatctcctcatacctgatagtatggagttcttttgaaaaggtaaatattgatatcatctttatggtgccttttcacccgtttctttgcaagtcatctcttatcttgaccgttcctccaaaccagctcaaattatttcagtagccacaagcccagtaaaaagggacaaaggctaagccagtgctggtgtcaaatgtgatgccgacggccacaacatcctgaatggatccatctgccaggtgaaatcagtgcaagtcacactgaacggtgagtgttctctgctctgctccattcacacgccataaaaaaatttacagtgtcacacaaggtaaagtggtgaaagcaaacttttgaccccttcctggatgactctttggcatttccctctaatgcaatctctatatatgtataattcacaacttcacataagcaactaactgaaaattgcaccagtgtacttcagatgtaaccagtcgatatcttgaatcgacagagttgccgaggagagtggagagagaactgagaagtagccatggaggtgatcagtcggcaccgcgctcctgctagcagtagcagcctgtgcttgctgtttctgacctttcttctgagcgtgtcgatggctgcggccaccgagaaatcgccaatgcaactgaacaaggcacaagagaacatcatgcgagatatcctgggcttggtcagtagtgccatggattcatctctcaccaagagctggaacaccagctcaaatccgtgcgaatggagtggggttcattgcacttctgctgcatcctcttcttttgtcaccaggctctccctccccggatatggcctctccaatgccaccatccttgcatctatatgccttcttgatacattacactcccttaatctctctagaaactccttcactgacttgccaagccaattctctccttgccccatgaaggcagaattgcaagtgctcgatctcagctacaataggctatccagtcatcttggcaatttctccggttttcatgagctagaggttcttgatttgtccttcaactctttaaatgacaacataagtacccagctgaattatttgccaaaactgagaagcttgaaccttagttccaatggctttgaaggccctatccctacaagcatggttacctctttggaagaactggtgttctccggtaataatttcagtggtagaattccgatgggtttgttcagatatgggaatattactctgttggacctaagccagaataatctagttgatgacgtcccagatggcttcttgagcttcccaaaactcaggattttgctcctttcagaaaacaacctgacagggaaaaatccacagagcttgctgaatgtcaccacaatgtttcggtttgcaagtaatgagaaca

SEQ ID NO: 64370 - DNA, 1642 bp, Oryza sativa
actaaagtactaaacaaagtcccccttttatctttttctctctttttttctggaatagttttgcagaagtctatttcagccaaagtagcaaaaaaaaaggctactaatataagtacaaaaccttacatgcattgcatgcttatattaataaccttataacataacacttgttggtattgcactattgctgcatacaggttagttgcaattttttgctagcaacaacagaatagagtaatctatcactgtcagctgcaggcctgcagccatccaaaaatttggaacaacatgtcctcctgaccaccaagtgatactcatggtcaggtagtcagcattcacatttgtggatgagctgccgtgcaagtaccatcaattcaaatgacagttacagggccagacaatgcttggtatggattggaatttccatagttcgaagtatccaaatcagcaccatctcgcgcagattcaaaacaaaattcatagccaggaaacctagctaatttggccaaatgcagcacgcaccagagagcgttgcgcagcagcggcgccagcgagtaggggagcaaggaacaatcacctgtcacattaggcgagcaccggagacgaaagcgtccgggcagccgtacgccggcggaggcgccgccacccgccgcctcgtcgcctcgtcggagacggcagatgcaaaactagagaaagacaatgctttccgtaacccttaggcgaaggcggaattgagtttctgaggaaggcttccttgggccgaagcgatgccgcagagtatgtgaggcccatataggtgggcccgaacgggataggggagtacgtgtagcccagaatagttgggcctaaacggcagagtggagtattttaggcccatgtatcctggtgaacgaaaaataaaggaaaaagtacaccgaaggtccctgaacttgtcatcgagttaccaaaacgtcctcaaagcgcaaaaccagataccctgcgtcccttaactaatcaaaaccagtcacaaaaggtgcttcggtggttttgacctcggttttatcaaacgtgacggctgagtcagcgtgagacccacgtagaccccacatgtcaggatgccacgtcatctctctttttcccctcttctctcccttcctcctctctctctctctcactcgtctctcgcaggcctgccgacaggtggagaggagaccgacggggtccggcggccggcgagaccggacggcagcctgcacagccatgagccccatcccgaaagccatcagctcctccggcgacatgcggcccacatccgcgtctatcggcggccacctccccgccgcgcgctccatctctatcttctcctccctctcccgccgtgccttgtgcgcctccaccatcgcgcacaggtcgccgtacgctctagttggtgatgtagcgtgcgcaacttatggctctgactggatgcatatactccagcgtgattgattggcgattggcaccaacgagagcgtagcagccggatcaacacgcgcacagtcaagatctgcaattctgaacttctgatgaagttctgaactgatgaattaaaattataacaggggaatctctctgctactcgtagtacccatctaatggcctggttgatctctgtattaggagt

SEQ ID NO: 64371 - DNA, 1377 bp, Oryza sativa
atttcagtggtgtgatcccaccttcgatcagctctctgcagtttctcagcaccctcgatctcgggaacaatcagctgacaggaaccattcctacaatgccaaccaaaatcggtgctcttatactaagtcacaaccatctccaggggtctattccatccagcattggagctttaagtaacttgctgttacttgatctttcagacaaccacttgtccggtcaggtgccatcctcgtttgcaaacctgaagggattgatctacttgtctctttgctataaccagctctctggccccatgcctgagttgcctagaggggtaaaggttgatgtatctggcaatccaggtctcacaatatgtacagaagactctgacagtcaatacaatatggctagcactgaagatgacttcaggtcaactacatgggttgcaacagtttcttttgtagttggcttcatcatctccttctattgggctggtatcaggaagtattgctattgatgtttcttatgatcataaagtagtgtcagtgggaacacgataacaactcaaaacctagctgcatatccctgcaagtcacaagtagaggtattgtaagtttatagatcatgtcagagacaagactattctctcacaagtagggatggattgtacatgaatgtgtgtggaataacaaattactgataataaaaatgaccatgctcagaccgggctttacctcattgtgctagaaagggtgttactctttcacatgagattcacatgaaaaaccatgtcaacatactacatagattcacgataatcagaaactatttcagtatggtgttttttcttaagttcctccaatgtctgtaccaggttgcaagcaaacacttcatacaaaggtacggtcgcacctatggcaatcaaaatatccaaaaagtgtaatgatttcacgaaataaaatgctctaaaaatagaaaaatgcagaagagcaatattcaactaaagtactaaacaaagtcccccttttatctttttctctctttttttctggaatagttttgcagaagtctatttcagccaaagtagcaaaaaaaaaggctactaatataagtacaaaaccttacatgcattgcatgcttatattaataaccttataacataacacttgttggtattgcactattgctgcatacaggttagttgcaattttttgctagcaacaacagaatagagtaatctatcactgtcagctgcaggcctgcagccatccaaaaatttggaacaacatgtcctcctgaccaccaagtgatactcatggtcaggtagtcagcattcacatttgtggatgagctgccgtgcaagtaccatcaattcaaatgacagttacagggccaga

SEQ ID NO: 64372 - DNA, 2133 bp, Oryza sativa
caaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttctgaacagaaagttgagatccatacaaaggaaacacagaatctggagaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatacaattcaaaagaatacatgaaattgttgaatatgtcaaatgaaacaaggttaacaatccactttgctggataaatacaacaactcagaactgaaaatttcatatgtttgctatgtagatctgaactatgtaatgataaaagtaaaactacactgcattcagtactacaaaactgcattctggatgattgtattactatgtactattgatgaataccaaactaaatttataaaaaaaacatgacagattgattagtcttccaaccttactgaatttcactccgaagatatcacagttatacagttatacagaaatataacaactaggctatatagcatatcctgaattgtcatacattcaattttatcagcataatcaccatattaaactaatgacaaattcaaatctcaatgtcaaccacttgtctcatccaactcaatattacataaaagttcaatatctcatacaacacaaacaaaagagccaattcatatgaactcacaaatttcttaacatgttacagtaaaaaagtaataaaattacatataagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaacaatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaggtgccatcagatattataagaaaaagtgccatcagatagtttgttccataagtaaattttacctggaattacagtagcattacactctaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaattgattcatttgttcacttcagtgtctataatcaagtatcaaattgattgtagttggatttttaagtagttacaatttatgtttactggaattatagtataatttctctgtaatacaaatatatgttcactataaatggacttatgaaaaagattgggaaatacactctatgtttcagaacttgctggtttagaaattcaaaagttctttgcaatattaatttattctttctatgcaggtggcatacaaaaggagaaacaaagcaa

SEQ ID NO: 64373 - DNA, 1840 bp, Oryza sativa
tcctcctctctctctctctcactcgtctctcgcaggcctgccgacaggtggagaggagaccgacggggtccggcggccggcgagaccggacggcagcctgcacagccatgagccccatcccgaaagccatcagctcctccggcgacatgcggcccacatccgcgtctatcggcggccacctccccgccgcgcgctccatctctatcttctcctccctctcccgccgtgccttgtgcgcctccaccatcgcgcacaggtcgccgtacgctctagttggtgatgtagcgtgcgcaacttatggctctgactggatgcatatactccagcgtgattgattggcgattggcaccaacgagagcgtagcagccggatcaacacgcgcacagtcaagatctgcaattctgaacttctgatgaagttctgaactgatgaattaaaattataacaggggaatctctctgctactcgtagtacccatctaatggcctggttgatctctgtattaggagtatctgagtatgatgctagtacatctttccagtgatgagtgattgaatgattggctagtacacatacgcgcccatctgatctgatacggccagcagaatccatccatccagaggcagcaccacaaacaaaaggaagcccatatctttgtgttcttcatcgtcctgcacctcactcaatctccatttagatagctgaattgagtgatagacgattgctggatcatctgcagattttacaaagttgcgagtaaaattcagttgtaatctgaactagctacaatattctcctatcttagtgatgcagtttgttgtctcgtccaaattcgcaggagatcgcttcttaatctgcaaattcgtggttagcggttaatgtcttatcaacattttcttgctccccgaccatcccaccaccattcactcctcgccgcacccgcgtcgctggcgaagacaacgactcctgcaagaatcgctccaggaggcactccacataggggtggccgaaggattaggccttgccggcgggggagcaagcgcgcccgcgtaaccgccagcggcacagcagcactgcttcgccggcgcccggcggctcgtcgacctggacctcccagccgcctccggaggctgcacctcgccgacgtgtcgctcggcggccgcttcgccgatcaggtcccgtcgcggctccccgtcctggaggacctgcggctcagccgctgcgccacgggcttcgccgagattgtgtcgcggacgctgacgaggctgatcatccacggcagcggcggcgagctggccgtcacagctcctcggctctcctccctgtgcctcctctctcgctggcctccgccgtaggcctcggagccgccgtgcttccctgcttcagccgcgccgacctcctcctctcccgccgcagagaaaactgagagagagagaggaagggagagaagagggggagagatttgacgtggcatcctgacatgtggggtccacgtgggtcccacgctgactcagtcgccacgtcggataaaaccggcgccaaaaccatctaaggacctattatgaccggttttaattagttgagggacgccggatatctggttttacggttagaggacaattttgtaactcgatgacaagttgagggaccttcggtgtactttttccaaaaataaattggtattgactcaactgccaaacggtttattttttgaaccaattttctgtagaaaagttgtttcatacaatcatattaatctatttttttaaaaaaaaatagctaatgtttatttaattattttttaataagtcgatctgcgtgcggaattcccaatctaatg

SEQ ID NO: 64374 - DNA, 1821 bp, Oryza sativa
ccccccccccccccccccccccggttcccccgccctgtcgccgccgcctcctcctctcgttccagcgcgcgagccagagagagagagacgggccacggaaacgggtagtaaaccacgaatcattccgcccgcgaaaaaaacgattggcgacaccgggtgggcaggcaggcaggcaggcaggcaggcgaccggatgattgatcgtgtggttgattgattgatttcagcgaccgagacgaagggaggggaatgtgttgatgttgctgggtgtcgtgtccaggaaaggcccggacaggaggaatattaagcgcgaaaaggcagccgctttgattcaccaacactttgattccagcgacccatgatctgtcactctgccggacaaactgctcactcctcccgggtaataaggctagcctacactctattactcctagtgtgtgtattcttttttgagattatacttggcgtaggtgaactgtcccggtcggaccattcaatggggattctttcattggcaaaaaaggacgtcttctctcaacagtgatagactgatagtactatacgagtacagagtatgtatacaagcagtaatgtggtagtatcaagtagagtatatactttgaaaaggttgtgtgaccactccggctgattgcttgagcttggtgcatctcatggaaagtgagtttatgtattaaaatggctattgttcgaaggcgaaaagcaacagacgaaattgtcacgaggatatgatgtgttttttttatcagctactactcttcagataatggttttcctgtataacgaaaactcttcggataatggtgataagctctaaacaaacgagagtgcatgcatgcacgcaggaatcgtggtagttacagagcgttaaatcggtacggtttggttccttaaactattttatagcccgtctcgtacaaggttatgggtcatgactgtgaaatgctccggctcgagaaattcagagatggggcatagcatcttcagtgcggctgtctctgctccacaaagcctgaagccgatatagtacagagaaaagatgtgctctttctctttgatggaagcatctggtgttttaataacatccgatggtacgcgagatttcgtctggtgatactgctttaggagctcggaggttaattaagttgaggcaggccccgggaattgccatcgtgggccatgttcttgtccccgttagtggacaagatggttacatcgatattctgtcaatgctggtgttccagagtccaatcctttagtaagtactgtagacaagttgtgatcaactgatcaggacaggttcagagacaactatgcaggaattatcctctctttattggatttatttataacctgatattggtagatatttaatcctttcttttttaggggcaataatgttagtggacgaaaatatgtcaagcatttttctagtcatttgtcccttttgacaagttaaagatctcaactttatggaaaacagaaacattcttattttttttataaagttcatgatcttagcaagagaagaaaattaaagggtatattcgcaacagatcaaagagcaatgactaggaaatcagtcagatcttcccccatatctccttctagatacaaagttttcaggatcattcaggttcctaccatctttcaggtgcaaaatacctttctattgtgatcacaagcaaaatatgcattctgcacaaagtcacagcaagccccagcagattcttttctctttccattggtgatatcaagaagcaaagcgtttcctaccctgtaaacctaaggactcttgaaaccg

SEQ ID NO: 64375 - DNA, 3728 bp, Oryza sativa
tgtaaacatgtctcatagcttgaaagtaatattgtccagcttccagtaggcccccatggttacatgcagaaagaagagcaacaaaggttatctcatcaggggggaaggcatcaaataccatagatctgaagaacattagtgcatcctgtgcacgtccatgcatcgctagcgccccaataatcgcattccatgagataacatttttactaggcatttcactgaacaagcttatggcagtgtctacctgaccacaccttgcatacatgtcaagaagtgaattaaatagagcaacacctggattatggaagttatctctgatacagtcatgtatcatctttccagaagccaaatcgccaagttgcccacaggcagagaggacagcagccaaggtaaactcgtctggagcgaggcctagcaatttcatacggttataaagatccagcgcttcatggaatcggccaccttgaacatagcaagagatcatggcattccaagatattatgctcttctctggtatctgttcaaaccaatctcttgcggcatcaatagacgcacgtttggccagagcacaaagcatagatgtccatgaaacagcattcttgaagggcatcatgtcaaagcatgtatgagccatcaacaaatccccacacttaccatacatgtccaccaaagcattggcaaggatcaaatcaatccgacatcctctaaccagcaaatgagagtgcacaagcttaccaaattcaagatttccctccgctgagcaggcaaaaagcaggctgaccagcgtgaactcatcagccaagagtccctgacgtctcatcccctcaaacaaggagcacgcctccctagtatttccagcctgcgcatatccgttgatcattgagttccatgacaccacattcctgtccaccatctcatcaaagaaccggcgagaatcccccagtgacccggccgaagcataagaatgcagaagagcattccccacaaacacctgccccacaaatcccagcttaacaaccacgccatgggtgaccatcacatgctcccacgcctgtaccctcgcgcacgccttgaggaggaatggcagcgtgaactcgttcggcaggatgcctcgccggatcatgccacgaagaagaggcagcgcttcttgggggcaatggctattgcagtaggctctgataagactgttgtaaacgaacctgtccggatcaggaattctgtcgaacagttggcgggcataccacaccccaccaccagccggtagcgcgcagtaggacgcgaggatctgagaggtgacgtcgtccacgccgtggacgacgaggtgggcgtggagctggttgagacggtgcacggagccgcaccgccgcaggagctcccgaacatggcgggcggaggaggcgccgccggccgatggcgcgagcatcggagaggagactcgaagcgcaacctcccaacgggccgggccaagctagaggaaaggcccatgggctttcacctgctcgcgcatatggagagatcgagagaggggaaagcgagaagagaagacgcggccacgcaggcggaggcaggaggatgagggtgttgggcaagcacgtcttcccgaggcaggtggcgctgctcgccgcagggtaggtggcgccgccttgcatcctccggcctcgattctcctcgtcggcggcggcggcggcatgacgcggtgtgtgatttttgtagggtcgtgttcctcggggcgacgacgtacgacgtgcaccggtcgatcaagaacaacgagcagccgccgaccaaggagcagatggaagccctccaggactacatcaactccaagaagcaaaactagtagctagaaataatcatccatggttcccaataatccgatcaatgcggatcagcttgtgtgtgttcgtctgtaatctgaacagaattggagatgagaccaaaggtggatgggtggaggaggtggggcgcgcacgccatgtgttcggcgaaattcccctgaggactccactgcgtgtaagtgtatctgtaaatggcttgcttggtacaggtatgttagtacagttacgaacgtgtaagcttaactatgtccataaataattccattgtgtagaacatgattcatcttatcataaactccaaactgtattgtgctcactgcatcatggtccattcccaaccccttccaagaaccaagatgatttcggcttgtgtgcagtccgccgagcagcagatgtgtgcagtattctgcaggttgctggcagtgtcccagaagattccattatgcacagtattattacagcaacaagggaaccaacagtgatcgatctcaatcagagtttcttggtgcgttatgagcgcataaacaatggcggccgacggtgtgcatcacaacacgtacagctcggcaccggcatccagacttcagataatgtagtatatcatctgaatatgacgggcacaagatctctggtttgctatcctccacgcagaacgcataaacaattttcagttcaactgaaagaagaacaggtacgcgatctctcccctcttcaacaggtcaaacaaaaagaaaagctgggagaaagaagcacgcaatgttccaacaagattcatgtgaccttatgctataataggcatgtagccaagctggtatacaagttaaactactacttgtgcactgctagatatagtgactagttaactaccagctactttaattattctttttattagcataaactgaatttagtagtgacaggttcaagattttgctgagctcatgctaatgatccttcataaaaaggtgacacctgtacaccaatgttctataaaaaaaacgttgctgtttttgactaatagattggaaatctttgtgggggtacatacccatcttacatccatgctgataagactaatatttcatatagatagttaggtactttcacaacctagctgattgactgaagcaatgagtgataagctgacagcattatgcaagagtagtatgacctatgaaatatggtcatatatacactactctgtttcatagaaacttccctatatatacacaatgttaaagtgtacatatatttgcagatactgcaatactttgtacattgcaagacttgaatacaagataaattgtaacaacaataccacaagctgatcatgatgatgttaggctagagcagtgcctcactgaagaggggagcatgagtgatctgtagtaagctttaggcagagccacaatcttctttgcctttgggacgtaggccctcttggtgaagttgttgtaatcgttggcctcgatctcgtcaaggatttgtcggtacagaagtagagaagcccaaacctgcaacaacaacctaatggtcattcatacgtgtgaaccaacttaacataattaagaatgttcagatggaaattttaaaggatatgtagttgtcatttctcaccggccatcggctctcctgattgagctcgctggcgccttcttcggcctgtctgaaaaacgccctcgctctcgtgatctgatccctcataaaacatctccatctgtccgtgacgcggccgtcgaagatgtcatcttcagagagtccggccatctcgagctcgtccattgggagatagatcctgcctcttcttgcactgcaaattaacaagcatatatcaggacccattagagatggctgtaactaatcaagaaataatcgcatagatgatgatctctg

SEQ ID NO: 64376 - DNA, 17169 bp, Oryza sativa
gtcaagcatttttctagtcatttgtcccttttgacaagttaaagatctcaactttatggaaaacagaaacattcttattttttttataaagttcatgatcttagcaagagaagaaaattaaagggtatattcgcaacagatcaaagagcaatgactaggaaatcagtcaagatcttcccccatatctccttctagatccaaagttttcaggatcattcaggttcctaccatctttcaggtgcaaaatacctttctattgtgatcacaagcaaaatatgcattctgcacaaagtcacagcaagccccagcagattcttttctctttccattgttgatatcaagaagcaaagcgtttcctaccctgtaaacctaaggactcttgaaaccgaagaaaacaaaaccaaagccaatttcttgattaatcgccaaggcaaggctaaataaccctttatgtcagggttgacccaaacacctcacctcatgaaggaattccagagcagcaacacaacggcacgtaatgccaacggtaagaacaaaggacgccactctggaggcaattaaaattttgcttcccaagatacggacgccgttttttctactacgtttgattgcactaaacacaatactttaatggccatacggccatacagacgaatatcttaatggccatatggactaatattcccctaatccttcgtcaccagtggcaggcaatggcattaaccgcattgtctagtggcaacgggagaaactgatgttgactctctgatgagagaggcaggcctgaacatgtctggataatgctcgcatcgtcacatgacagtcgaacacgaccgttgagtgtgcttagttaccttggatctaaagccatttcaggctggcttcaacgctgcaacgcctgcttgattggatcgatgcagatactacatcttcgttgacgagagatcccatggttttagtgtccgttgcgatggtaaatccaacacagtgtttggttcttgatgcctgaagaagcagctgaagaaaactgaggggagaaggatttacagtgtcctttcaagacggctctgaatctcagtatctgaatctgatgattctgatcacctaacattcgtttaattagttgataacttgattatatattactaacagcttttacccatccatgatgctgtactatttgattctgattctgatctctgagccgacccacagctgcagttttgtcattatccaaatggactccatcaaagatcacatcaaaggccataagacagggacatcagcaaaagcgattgtccgttaacccaaccaccgtctaaaatgccatatggaatgattacatttcatctcatctcatttgcccccaacacttcaccaataatcaatacttattagcaaggacacagcacaaaaccattaacatcacaaaaaagagagggaaagaaatcactaatagtaataaagttgttatcaacaggttgtttacctttccttccgtcataatttatctcttcctagcactcctccactagctcctacataaaagaccggattaatcaaatccagggtcacagctgcctccattactaaaaaaaattgtatctttaaaaaaaaggggaaaaaaatagcgattgaagaagcaatttgtcacaaacagttcatgcttcacctaacgcgaaattggacaaagtccatctataatcactagcagtagttggtaaccgtggacaagaagtatacaagctaataagctatggattagtatggaatcatatagctggaaacatgtgttctttttttgctaatcccctccctaattaccacacacatgccatctagctcagaatgatacatgcaaactcagcaaatcatgcacatttttcttattttctcaaaattaaatggttgaattagtcaaggacactattgcactaatgccagtagccgttggaagggcaacagattaacaacaagagagtacatatttcacatgtttgcagctcctgggagacagtccagataagagcatctcaactgccttctagcattttgacaatgccaacttcttcaggctcaattatggaatggattatacactgattactctccagaactaaattatccttagcattgaaggtgcacagaaatgtgcagtatagattaagtaataagacgatccgaaatgctgcgtaattgcgcttaatgtaatgcagtatagattaagaaagcttgttcgtaccactaagtaactgcaagttggcaatgtaccatatatcgtccgtcccaatctgggagcgtgcaagaaagaatcaactgatgataaatatgaaacaattggattagcattataatgatggatcaagtcactgcttttctttcagataagttggacatggcaatgcagatgtagaaaggggaacaagacttagcaaagggggaagcaaaactggttaccccttagctcatccatttgcacattttcataggtgaagcaatagaaagaaaaaggagcaagccaaggcaatcgtggaattgccagtttaacaagaaggccccacagagcacatcgggagatcctaaagattgtcccaaaatcccttgttatcttttcgaacggccaaatcccttgttatccattcactatctgtgcaattttcaccctttgttctatggaaggaacaaaaaaaatccttttagataggcacatgaactgaacaaattgcaaattggatgcagtttcacttctgaatttttatataatggacatagattacatctccggctctccggcttctgttataagaagcacagccataagtttcacttcagaatggcagagagtttctctcaagaaaggtgcaggatttgacaatgtggttgcttaattccattttgtcgattcatgaaatggacagaaccaagtgaagcattccaaatttctaattccattatttgttgcgaggatgatgctaaggcagtatcgaaaagtcgaggagacacacgatcgctgttacaacatggacgaacacctcggtgtgccactgaatcgagctgagctgaatagctgatcagctgaagcgaagagagcagagcgatctctgcacgggccatggtggtgggtggcgatctcaagttctcaactctacgctctcagaagccgttcatctctagcaggtaggtgcggcgcttgctgagcgcgctgacggcctccctgtacgggccgtcgaatgcgtcggcgacgaactcgtcgagctccttcctgccgccgccgattccgccggcctcgccgacgggcttgatgacgacgagcgtggcgccctggatccgcgtgccgtcggagagctcgagcatcggcgcgtaccggagcttcatgttgcaggcggggacctgggtgcggttggccgcggcggcggcggcgagcggcttgtcgcggaactccctgatctggtcgcgccccatgctgagcgtgccctggccgtgcgcgtccgtgagcgccacccgctccagcgtggggtgctccttgacaatctcgcggaggaggtaatgccttgtggccgcggcgatgagggagctgatggtccacaccacgcgcagcttgagcccgccgttggtgtagaacgactccgggatgctcccggtgtcgtcaccctgcgaggcctcgctgtccccggcggcggtggcggtcgccgccgccgcggcgggggcggcggcccggtccaccctggtgccgccgaggatgacgcagctctggagggtgctcccgaacacggccttccacctgagcagcaccccgtcgtcggtgccgacgtcggagacggggagctccatccggaggttccggatgctgctgaagttcttcagcacctgcgccggcgagtggtgctgctgcgcgccgcagccgccgccgccgccgccgtgcttccccgcgcgctccccaccaccgccacccctgaccccggcgtcgcagtgcccgaacggcttgagcacggcgagcagcatcgccttgaggaggtgcgacagcaccccgcggccggcggggcgcgggccggcgaggccgagcgcgtcgtcggcgtcggccgcgtcggtgatgacgcggtcgatgcggaggcaggcgtcgtccacgagcggcacgagcgagttgaaccgcttggacacggccgagcaccgccccagcgagcgcgcgtcggcgaggcggttgaagatgaggagcacgagcgagtccgggacgcggtcgaagtggtcctccccttccgcctcccgcggcaggagcaggtcctccgcgaacaccctgtgcctcgactgcattttcggttccgcgaacaaggagattgtgagatcgaagaggaggagggagggaggtaggtgcggtaggaggaggcgagtgaattgaagggaggaaggcggaggtggtgggtttataaagaggagaggacggggctcgctaaacaccatgactcgctgtcgggcccttgcaatcataccgttacagatgcggcctctcctctcctctgctcggcgtttttgcgtgttgccattgtttaatggtcgaccaattagtgtgtagggctaatggcaactaggcagcaacggtacactttccatcggcaagtttatactggtgtggtgtaaatacatgtactcgcgttcctgctgcatgcagtcaccgcgccctacgtacgtggcgagcgaggctgtgtaatgacactgtgcaacctcataaccggtggcagccagacagaaatggcctgtctgtgtgggagagcagtgataataacacgaatgaaatccgttctgatttctagtggcatcaaactggcttccgttttccacgttttctatgcaacgagtttttcatatggtcccttagaagtaacccactctctatttcaatttacttatcagtctacgtactccgaattaataatacttatcattttagataataacacggtcttaaaaacataactttgacaactagtaccttctattataatatatataaaaatatcaataaatatatggttttattaaagtactttttaatactaatctacacatatggtttttatattctaagataaatattttaaaaattatttgtagtcaaagattttaaagtttgactttacccttgtttaaaacaactaatattattagccaggaggaagtagtatttaatttttttttattaaaaaacttattgttgtcatattgtaaagcacattcagaagtgtctttcccttcatatctttcatcattgtagccatattaataatattacttcttaccaccatgagttttaatgctggctttgggtaatattacttttaccatgagttttaattaattgtaatttttaaccaaacgtcctatttagtgtgacaagcaaattgaaacggacggactatatccatttattaagttgtggtatctcaacataagtatgtatgagttgcggcgcaaataaacgctataatacgtggtatggtgtctctttgataatttttttaaaaagctattgtcagacatgatacatcatgcataatacctctaaagctcgcgtgcaaatgagtcatttgcatcagcctaactagaaaatgtagcaagctagcttaatttgccaaataaaagtttgcacaaaactattgcttgctaaaatcatactaaatcaaactatatatagtcaattattatccaaaaacactttttcccattctttaaaagaaaagggagaacaacagaatctatgagatctaaccatgtacaacacttttggggataaagtctctttacactaatcatgcatatcattgaatcaaaagcaatttaatattctggcgtcactgaagtagaatagagacgataagtgcataatacaattctttattacttgcaactaacttttatatacgtattaatttctgttttgtactaatacatttgaaaaataaaacctttacacacatagttgccattagaaataagctaatatcaaactttttgaacatttaagaactcgaagagaaacaatccaatctgtaaaatatttccaacaaatattccttggactgaaaatgtatactgctaactgtcaactgattttgttggcacaagagttgcttttctcatgaccggtttactgggcagatatcctgctgatcaagtactatgcacggccgtgtacattttacagagtgggcgtgactttctgcattgtacgtagtagcagaaaaaaacttactgctccacgaacggaactaccgaaatcaaagcaagatcagtagcttcattatttgtcctatcataaggacagcttaaaaccaacacgtttccgttgtgtgcaactttagttcgatgtaatagtactacttctgtcccatattacttgttttgacttttttacaatgtttgatcattcgttttatttaaaaaattagtacaaatataaaaaataataagtcaaacttaaagtacttttgataataaaacaagtcacaaataaaataaataataattctatttttttaataaaacgaatgatcaaacattaaaaaaaaactcaaagcgacaaataatatggaacggaggtagtagctgtttaatttgtggtccttcatccttgtgtgctaaggctaatacaccatgcatgcaactaacatcaaggacatgtatggtagtcctgtggtgaggagaattgcagttattttgcaatgttagatttttttgcttgttctaatctgccacctattattgattaataggtagtaggtatcttcactaattgtgcgtctctctgtcctagcttaggttcacaaaggtagatgggagtaggtgctatgacttatgaggagtaggttcaaggtttgtcttcccaactgagcatttgtaccaattgaactttgccaaatgatgcacctctatctctatggctaccgttattttactgggttttgctttcgggaaatattggagttggaaacaaaaccatataggtagttccaatgtctctgtgaaacatgacaaaaaaaatcgatagaagtcatcttttgtttatcttgatttcccaaatgctgatattttcccttcctatgtaaattgagacttggaactataaataagcacaacaatgaacctaatgtagaactttttagataatggattgaaaagcattattgttgttgaagtatactgtacaagtccaagctttggatgaaactagcttatacacttgtaacaaaatatggcatcagggttagaggtataccccgctcaattcctggccagtgaaatcaaataaaggaaagaaaaatctaggagttaattttcaaaactaggtgtagatattttaagcgataactggttttactaggaggataatgcatggatatactttcattttctcattaattctcggtgctaattaaaagtaacttcattgtgattcgattcctaggaagtcgtcataccaattttcaagcttcctcttagctacaaatgttataaaaccggctctgaaattcacaccggaaaacgtcataggagatccaaacatgatgatgacaccgaagcacgatatttggtaacggagttcagccgtagcctacatatcagggacactgaaacaaattcgttgtaagggtgcacctaagaaatttctagagcttggacgaaactttgggtaaatgtagtatcctttctgaacgcagctcctccctcttttccaccatgcatcagttatcccactcagatgcctagagtcactagtctttcggcctcatcttttagcttatgtttatgcttataagccaaaatttaaatttttaactttaaatttggagttgattttagggttttttttttcatcgtagtttattttcagcctttgcttttatatcgctaagaacacgtatataaaagttttatttataaatcattttccatttataaatatgttgtttctcttattccatcaataagcaaaacgatggagtactttagcctttaggtttaccatggtttggttatccggcctcaatcataaaaggaattaagaatacaatataccacacctgaaaacaatttaaatggaagggaagataacctaccacgctcgtgtgcgaatatattggcaacttggcatccatgcaccgatagaggatgaccgtttcaatgggagttttccactcccgcacaggcacccacctcgcaaccgaatcaatcagttgcacacgagcgacgagctagcgtagctgctaccagtttgcaagcatgcgaccatgcgttcgtgcccagcgttgcacgcaaggccagaggagaatctaatcgaccacgtcctaataatgcgatgcgataacatcataacagtattatcactaatctttcagctcactgagttgtacatatggtccactgctggtaacatgattgggaaccaccaaaagggaagcatcacaaacaaacttaatactgcaaagaatatgatatatattcgtattgatgattgatcggtcagcccatgaactgtccgtactcgtgcttaagctaccaattggtgcatttgttttaataaaaaagtatgtgcatgggttttgaatgttttgataccatgttgctgccaactaggctcttcccgagctataaataatcatggtaactaatcatggtgtttcccaaaggtagcagcaggagccaagaaggaggaaggaagaagaatggggctctcacctagaatgctatagaaaaaagagtccatgtcgactccatgatgtggattggaatcaaaactaatcgaagtttagtagttcacttattgttggagcgtgtcatgatcttgtgcctaggaatgttttttaatgtgccattgctttcgtctctctgctggcagtgcacctaattcttcgatggagattcggatattggagaaaaaccttcccacggttgcttcactgcactaccaagtgttgtactgttatcatttgttaattgccaggtagttatcccgcttggattttgaaaaaaaaaacagagaaggaaatgatttgtcggactaatttgtaaatattactcaaactataaatatttttgcaacattgattgagattgagatcctttaacttacccctctaacaaacctcagtgatctacaatgatagggagttagtcggagtaattgcttgtcattcatcggttggcactgagatgagctcatcagtgtaaagtggaacacaatgttagagttatattctagatggtttcttatgcggattcccttcgctttcctctcccggttgtgattctataagccggttcgagatggatacgatcggattcacgctgctatatgtactggcgttttcggtatgaatcgatattgttttctgtgtaattgtctcacatggtatcagattagtttcgattctcgcttccgctttctcgccacgatcatttcctttttcgacgcgtgcgccctctaacttcttcgccggttctcctcgcgacgccgcgatgtcgtctaatgcggagtcgccctcttccaaaactccgccgccttcaacgggttctcttccaccaacggccactgctcatcaagccgctgttgatgaaatctccaaagtcgcagctgaagccatccgggctgccttcatcaagccgtccacttctgtcgatattgaccctgtcaccgccagcaacgttgcggactctgcggcgcgcattgcttccgcccgcagtccgtctccgacttccatccctgctggatacacttatctcctccgcaccgatcgactcttctcctgcggccgactcggtttctggctctgcggctgccctgacctctactgtgccacccgccaccaccgaggtccctgcggcaccaaccctgccggcacctcttgatttggccgccctcctcgccaatgcacagctacaagccggctcggttgcttctcttcatggcatccctatagagcacggaccacgcctccctattggcatacctgtgacaggccatctcaccggcagtctacctactgttcctcaggctgcaccagtactagatgcagagacgactgcctctcttcactcccaggctgtctctgtcctaaatgtgaaggctctcgtccctattactctcgacattgccgcagcaaactattccaagtggcgtggcctcttcctcgtcacgctcggcaaatacgccctcaccgaccacgtcttctccaatgcgttctaccccaaccatgcgcattggcttcaaatggactgtgtcattttgggttggctatatggctctatctccgtcgatcttctggaaaccgtcatgacgccaaacgccaccgctcgccttgtatggctcgccctcgagaaccaatttctgggaaatcgggaatagcgtgcgctccacttgtcagctgagttccgcaacatcatccaaggtgatctcaatgtcaccgattattgccggcgcatcaaatccatggcggatcgtcttgctaatctcggtgaaccagtacaggatcgctcccttgtgctatgcttgctcaacggtctcaatgagaaatatgatcatctcaagactctcctaccgatgcaacgcccgttcccaacattcattgaagcccgctcgcaacttcttctagaggaactcaccaagtctcaccggctctccagctctccggccaccgccttcattgcctccacagcaagcggcggcaaccgttctgattacgggggactacttagttattcttgacgactgctcccattttgtctggacttttcctcttcgtctcaaatctgacacatttcccactttgttacgtttttttgcttatataaaaacacacttttccaccaccatccgttctatccaatgtgacaacggtcgtgaattcgacaactctgccgcacgtgatttcttcctccgcaatggcgtctccatacggatgtcatgccctcacacttctcctcaaaacggcaaagccgagcgcacgctccgttctctgaacaacattgttcgctctctactctttcaagccagtctccccgcctctttttgggttgaggccttgtacacagccactcaccttataaaccgccaccccactaaaactcttaaacatcacacacccttctttgcactctatggtacgcacccctcatatgatcatcttcgagtttttggttgcaagtgctatcctaacctctctgctactgccgccaacaagctttcccctcgttctaccttgtgtgtcttccgtagctatcctactgatcataaagggtaccggtgttttgatcctatttacaatagggtttacatttcacgtcatgtggtgtttgatgagcattcgtttccatttgccgaaaagccttttgttgatagctgtgctgctaatctcgattttttggaggatttttctttacaggaccagccggctgcacctccagggtttactaccaagattcaggataagtcagtacaaaacccatcaactggatccttttccacgactacactacctgcgccagctgttcctccgggatttcctgccagaacatcgcaacaaattattctccaagcgccacatcacgccaaaactagaaccaaaacagctccggcatctcctagatctcccacttctccctcaagcccaacctcggtcggcccatcctcactctatcagccatcgccaccatctagaccatcgccaacatatgggccactgccatcaacagggtcatcgccatcctccgggcccaactcgccctagccatcgccctccacttcggatcgctccagtctctgccttgggtgccactgccgcctgttgtttttcccacgcgcccacggagtgcccggttgcctggtgttcctgcgcctccctcaggccttggtgtgtctcctgttataaacacacatcaaatgactacttgaggtaaagatggaatattcaagcctaataatccctggaatttacatagtggttccctttctcctgtacctcggacctacagggctgctcttgctgatcccaactggcgcgctgctatggaagacgagtacactgctcttatggctaacaatacatgggaccttgtgccaccactaccaaatgccaatgtcgtcactggcaagtggatctttcgacacaagttccaatccgacggtactcttgacatgtacaaggcacgctgggttttgcgtggattcacacagcgtcctggcatcgactacgatgaaacattcagcccagtggtcaagcctgctactgtgcgtactgttctcagcattgctgtctctcgctcatggcccgtgcatcaactcgatgtgaagaatgcttttcttcatggcactcttcaagagacagtttactgcattcagcctcaacaaatcactttatggactcaaacaaacccctcgtgcttggtacaacaggttcgctatgtttttgctgtccattggtttcactgaagctaagtccgatacatctctctttgtctatcgtcacggttccgacactgtctatctcttgctatatgtggatgacattgttctaacagcttcttcatctaacattcttcgttggacaattacttcactacaaaaggagttttccatgaaggaccttggacctctcaatcattttctcggcatcaatgttactcctcattcaggtggcttgttactcactcaacgacaatactgtctagaaatcttggagcgtgcaggcatgtcagattgcaaaccttgtcttacacctgttgacacttcggccaagttctccactgaaggaagtccgtctgtctctgatccaacggatttccgtagtctcgctggtgctttgcaatatctgactttcaccagacctgacatttcatatgccgttcaacaagtttgcttgcatatgcacgatccccgtgagtcccatcttactgctctcaaacggattttacgttatattcgtggcactttggagtatggtttacatattcaacgatcatcgtcctttgatctcatggcatattctgatgcgaattgggctggttgtcccgacacacgtaaatctacctttggatatgctgtgtttcttggtgacaatctcatctcatggtcctctaagcgtcagaatactgtatctcgttctagtgctgaagcagaatatcgagcagttgccaatgcagtagcagaaacctcttggcttcgacaattactccatgaattatatgctccaccctccaaggcaaccttagtttactgtgacaacgtcagtgctgtatatctttcaacaaatccagttcagcatcaacgaacgaagcatgtcgagatcgatctccactttgttcatgaacgagttgatgtgggagcagttcgagttctacatgtaccaactacatcacaatacgctaacgtattcactaaaggcttgcctagtccagtttttaatgaatttcgatccagtcttaacgtccgttgttctgacgttgcgactgcgggggggtgttagagttatattctagatggtttcttatgctgattcccttcgctttcctctcccgattgtgattctataagccggttcgagatggatacgatcggattcacgctactatatgtactggcgttttcggtatgaatcgatattgctttctgtgtaattgtctcacacacaatgtgcctaattttcactccatattttgcatgatatattaccgatgtgctcctgcataagcaagcaaaatggcgaacacctcgaaaaaggagagggtttataaaatacatctccctgcaattatatccaccagcctaccacatgatattttgttatattagcagcaactgaaaaccaggtccctggtggcctggtcgtcacacaatttggagtacagctacaggcagcgagagagagagagagctccgggaggacggaggagccagaaatatccagagcaagtacacggttggcagggtggccatcctgtcctgtgcagagtcacacactctgccgcgagccacggggacggatcggcgtccgagcggaggagaggaaaacaaaccaaaccaaacgaaaccaaaccgggaggaggagcacgacgaggtgggttgtggccgctcgctgtttccacatgacacggcgcggctcgaggaatgtggatggcgctacctgcgtgcagcgcgcgggcgcgcgccggtagaggagacgacgcggggggccatctcatcctcaccatctctcatctctgctcggggacacgccatgtgacgaggtgtgcgcgcctcccggctagccctttgctccgacaattattggcggccgctgcatctgcatgagcggacacgcgccgtgtcgccgcccttgctgctgatgctaatccaataaatctctcccacggtgttttcacgggctatataggttggagtacgatctaaagtagtaagatggtgatgatgagcagcagttttggcctagctaggcgcctcggtcgcacatgtcaaacaggggtagtgcactctgatgagaacgaaatgggggaaaaaggcacggggtcttttctgcctggatcgagattccagtgctggtgccgaaagaaaggggagaaatcgtacaggcatcatgtgtggaaagggcggcggaatctggtaaagagtggacatgatgctgatgctgttctccgacaatgctaaaaggagtggagcttaagtatggttggcaaatcatggcgtgctttagctgccagcaagataattgttgcgacttgcgagaagtaagccgcaaattatggcataaacttgaaagcatatacacatggtctgagcactcaagagagtcacagctcaagtttttagtcaagtcgctcaaaatttcctcctcatccactgcaaaccaaaataaaagcagatggggaaagctggtacattagtcacgcacgacaacagcacacaagcaacagagcctaccagagcatcatatgatcagatctacccacttgcaatccagtaaaaaagaacagagaaactgacaaaccgatggagtaaagcattccttcctcgtgatcaagctgcgccaccgtggttaccatccgctgcattttctgaagcaaggtggcccaccgtaggataccgctctttaaacttatcttcccaatcttgcaagacctctagctcgtctggaccaaggccatccaaatctccagtgaggtcaatagggtcaaacgacatcaatgcaagggcccgagttgcatccctcccagcaaacaaggaatatggtccttgaggaccataaaagagcctgggagttaaaaaaaaaaaactgagaacacaatcatgaataatgaaaataaaactattgatgcatgatgacaagcaccagtaggatctaactgcatctcagagctgttgttcaagagcaaattataataagcatcagatagagctatgcttctgacaaaatacaagcatttcttttatgcacgatgtaatatattaggagatctcattttaaacctcatgtggacgtggaaattgagaagtatgtaagcacagaattgacagttgttgcagtatattgcgcaagtaccagtgcgtttatgactctaatccacaacatggcacttgtggaatatttgtacaaagggtccagaccttcaggtacatatacctaattctttggcagtacatggggatagtggatacccaactagaaaactacagtatgagctctagagtctagacagcatcaacaaataggaatatgcttgttgtctgttgaaatagcagactatctactcctaattgcaggctgcaggacaaacagttcactactaaacaacagttgcagataatgtgccaactagaatataccatttgctagacaaacatggactaaacaaggaaagaccacacatgataaattgggatcaatgagacagcaagaaaatatgtaacttaaggaatagtaaggtggtctggtggagacaaggctacaagcatccaagcataaaaaatatttttttacaagaaatcagaggagaaataaacaaagaaatagtacatcaaaataggtgtaagggagcataggaaaaatggtagagtgaaatacaacaaatgctaaatatggtagtgtatcgagccagctgtttcaaacaaatggtctagttattctctaatattaggcaacacatttaagcatctgtctggtgcacaaaagaaaacttaaagctcatcaaatcagtagagcaataaataggcaattaggcagtaagtaaaaaaaggagtttagctttagaacttagagaaatgatccaacaagacaagagtatcacaacccttttcatctaaagttcgacagtacccactaaatttcttttgctttcacattgaaaggttgtgtaacagtacaaggcatacatggatctgttatcccacattgtacgagcagttatattttgaattaggaagttccatgagacgaatgttaccaataccgatattttacacattaagcaggcagcactaagtaaaagcactaggaacaatcaaggaagctaggatggtgtcatagctaactaaagtggaccagaggtttgaggcttgtgcagacgatccaatatttacagagccacatatgtcccactacagcatttgttggttgcggatatgcagcaagtcatttgaaccaacgcccttggtggtagatataacttcaactctctagtctaagtttaatccaggataatcaaacgcacaacaacatccttacaataaccctagtgagaaccagcaaaaccatgccaagttgatgactgttgctcaaacttgcatagacaataggcaatttcctcgttactcgtgtagagttccctaaaccaatttaattgcaacaacagcttactaagctgataagacccatcgacctactacctcagggctcgcatgtctgaacaaatggaatgtcacaccaccagtttgataacctactcacaagcactctatggtccatgatttcacatacttggaagagctcgtagtttcttaccactttgaaacttgcttaatggctactatactaatgctgctgcctattcgtttcatctacttgttccagcttagatgtgtcttagcagtgtgaaatcagttcaacagcaatcctagtctgccgtaaaccatga

SEQ ID NO: 64377 - DNA, 2949 bp, Oryza sativa
ttatccccatttgttatctattatgaaattgtattacattttgctgctactttgattgtttgttaagggttgccatgcaacatatagattaatgagttgagtccatgatcctggagatgcccaattctctattattgtaaactgtgatgttcttgttctttctggaatttctttggggcaaggaacttaacagtgaaatagaggcttgcatcaaaagaaccaaaaagagtaaaagagggtaatttctaccagttctattgatgactttgtggcttagctttggttcgttttctgttttatatgaaaacagtatattcttcactatggacctctctgctggttggcaaatctgaatccgtttgttcaatccattaggttgcattcttaaaaggcatggagttaaatttccatggtggtttttcaaagtttactttggttgatgctttcatagacgtagtatggtccaatgtggggctgtaatttgtcatcattccagttatgtcatcacatgtggcatgtgatatacctgtcataaaaatgcgtttaatattgccatgctttcaccaagttgtaacgatacactattgcataattgctttgaagtttgttttgactagattgaagatgtgaaaatatgatctaattggaatactgaaatgtctacatgattagctctaaacctgccacaagttacttgacattcttctctacaggcttttctgaaggaagctactgctatagttccacttgttatatttgatgatgcaattggtgatcctttatctactcttgaccagttttgatagttcattttttggatctggaatcgtactagaggtatgcctgaaatgcattagcttgtattcagaactatgctgatgaaggcatagttgatcatagatagtgttaaagattgtaaatctgcggttttcttttggctgcttttgtttaccattaagatttgaagaaggtgccaggcataggcaattctttctttcccaaagtagacttcattaacttgtctcaattgcaggcgccaaaaagaagttgagctcagactattagaggaggaaactgcaaaaagagttgagcaagctattaggaaacaagttgaagagagtttgaattctgaggaaatcaaacatgaaatacaaagacggattgaggtagggcgaaagaggatacatgaggaggtattagtccaaattgagaaagaaaaggaggcagccctggttgaagctcagcacaaagcggtaaatgtcctgtcgctagctcatcttctgctctttgacattagaacattatcccattcatgaaattaaaagatcatctggagatttttccatgatcaatacaggatgatgggcagagggtatgataggatatttgaggaagactataatcatcgatcctttatctgttgttcaatgctcaattgctgagtggttttcacggatatttgaggaagattataatcaccgtgcttttatctgctgttcaatgctcaattgttgagtggttctcacaatactgctgcagaattctctcaattgaatgccctcttattcttttcttgtcgacgcaggaacgcgaaaggaaagagcgggaggagctagagaaaaagctcgaggaagagcggaagaaagccgaggaggctcagatgaaggaagcaatggagcagcagcagaaagagctggagcggtaccaggagctggagaggctccagaaagagagggaggaagccatgaagcggaagcagatggaggaagagcagcagaagcagagccagatgaagctgctgggcaagaacaagtcgcgcccgaagctgtcgttcgcgcttgggatgaagtagatgaaggaaattagtgccttattatttagtcgatgtgtattttgtaacagtctatctatgcctgaaaacatcatctctcttgctggtaaatcgtttgcagatcgtgggcaagaagaaagctctaacaatgtttactgtactacacaagcctgtggcaacctgcaagttgtaattggcttgggcattttaccatctcatctcaagtgtaagctgacgatttgttaacagttcagaacctccgaacctaccgaatgggttctacctctacccatatctatgccttacggacatagataacctagtgggtacctgatgggtttttaataacataatgaataatatctctataaatagataactgaagtagcaacgcaattaactagcatgcgcgaggtcacggcgacggcggaggcgctccagttcgccatggacgagatgggagacgacgacgagcgcgcgaacaaggcggcgctcacgttcgccctgctccgggcctgtttagattgttgctaaaataaaccttaccaaatttgttaaaattttggcaagttgtcaatattgctaaagttttgacagaatttcttatgtatttactaaatttggcaacaaactaaacaaagatatttattttgataactttaccaaaaaaaatgatatggttgaaaattgcatcaatatgaacagcccctccatgagaacgcgccttggcaagcactgcggccttgcgctattcacctccaacatgaaccgctacggagacatggccaccaaggccacagataaaagtagatttatctgatattttgaagcaacttttaaatagaaaatttttacacaacacatatcgtttagcagtttgaaaagcgtgcgacgagtatctaaattttcatccatttcttttagaggaaacgaagggtaccatggattttaaaccgcattaattcacatatcctaaggttattaattcacatatcctaaggttgtgtttagttcacaccaaaattggaagttttgttgaaattggaacgatgtgacggaaaagttataagtttatgtgtgtaggaaagttttaggctatgtttagttcacaccaaaat

SEQ ID NO: 64378 - DNA, 1628 bp, Oryza sativa
cactcaaaagggaggaaaccccctaccttttcccagcaacccagcagccgttctgatcagttctcactcccctccaggcctccactccaccctgtcggcgatcgagccatccatccaccgatgccgcccgcctccgccgccgccggtgacggcgcggcgcccgaccaagagccgcccccgagccccccacccccgcctccccctcccccgccgcctagaccggcgccctccctcgcctccgcgctccccttctggttatacctcaccgccaccgtctccctcctcgcgatcctcctcccccacctcctcccttcctcctcacccccaccccctctcccctctctcctccgctcccacgcctcgggcggcagcgtcctcaagctccatccgggccccgacctcttcgccgtcacctccaaacccaccaccaccgccgcggcgcaccgccccgctgtcctcgtcctccccggcctcgccgccggatccttctccttccgccacgccctccgctccctctcctcccgcggcctcctcgccgcggccgtcgacctcccggggcagggcatgtcgccgccctgcgacgcgccgccgccgccgcctccaagcaagagcgccttccgcgagatcatggaccgcggcgtcttccacgccttcgagcacctcgtcgagacgggcgaggtgccgttccaggagcccgccgccgcgccggagccgccgtcccacgccccgctctacgcgccccacgaggcggccgcgtccgtcgcccgcgccgtggacgcgctcggcctcggcgccgcgccggtgcacctcgtgctccacgactccgcgctcgtggccggggccgccttcgtgtcggccaacccggcagcagtgcggagcgtcaccctggtcgacgccacggccgtcctgccggcgttccccgtggcggttctcggcgtgccggtgctggggagcatggtggtccgggtgccggcattgttcaggggactcctgcggctgtgctgcgcgcgggagatgggcgcggaggtggccgaggcgcaccgtgcggcgatgcgaatggaggggaagagggatgcagtgtttgagtcatggaaggctctgaatcagagctttgatctgaaggagtggaggggctctttggaggcagtgaggaaattgccgatgatggtgctgtggtcgggttcttggactgataggtggatcgatgaggggaagaaggtggtcgcggcattgccggatgccaaattcgtctaccattccggtggtcgatggcctcaggtcagtgtgatggtttcctttttcataatcaattcaaaatgtagagagtgtttagcattgtgctgaatgtatagcttagctgatgtagaggttcagactacagacagtcatgcaagattgcttgggcaggttggccttcaagctctactttaagttaactagtgatttactatgcatcataccaatgtcgctggtctgatacagctcaccatgatccatcatgttttgttaagaattagtagcacaagcatcaggtgtccattggctaaggatgcaaataatctctagaacggagcagtactcaacacccatcgtctcattgcaaacatcaagaccagctaactgaataa

SEQ ID NO: 64379 - DNA, 10392 bp, Oryza sativa
gcggctgctctcccttccctccgctcccatggcgagagatccgtgctttcgacttgtctccttccccttcatctgcgctctgtggcgacgagtcggtgggttggaatttggaaaccgactcgctgacccgcggtctcttcctcttcccctttgaataattttgaaaataatgggtcctctttcgaaattaaattttaaaccaccttcaaataatctgaaactgagtttaggtgttccaaaattcaaactccaaaacccaagcgggaaatcataaatttagcgctcgggatggttccaaatttccgatcgcgcgcactgaatttggaccccgcgtcaaccacattgcaagatacctcatcacctcaggagattcctacatgaatatgggcatttccgcggttccgccccccaaatcgcagcgggaaatcacaaattcagtgctcgcgatggccgatggttcgaatcaggtagccaatactgaaaatcggaccgtgaaaatccaaatagggagcaaatcagaaactgctcgtgctcttgaaatttcaaaatcgctcaaaacaaattgggcaatacaggtcaaccagtgtcaccaactagaacaatgcaggttgcaaaacgttcacatagcacggcaagagattgcaactgaatttagagggtaaatcactgcagatttcctattccattcgaacgaacgaaccagtagttcatacatccctaattaatgaaggaacaggagacgagatgaaacaacagctacaggagaagaggctaggctactacgacgaactgaagaacatggcactaatcgaatccctatccaatcgcgtggcctcgcatcgcctcgcctagccgccgaatccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagcctccggatcgccggcttcgtgatcccctggatgttgtcgcgcagcaccttcctgtgcctcttcgcgccgcccttcccgagccccttgccgcccttgcctctcccagacatcgccgccgccgccgctcgccgccggtcgcgaggaagaaactttgacttggtgaggagtggttggcggcggtggtgatgaggtggggaggagaaggcgtgtgggggcggggctttatagaggcgtgggtttaggggaagcgatggggggcacgatccgcgtgctgctggttttccgcccgttggatgggagatggacggcggggagtgggggaaggtgggggttgcgcggatcggtgacgtggcgtggtggtgagggggaggtgtgtttcttttgtgaggatgtggcgggggtgcgggaattcgagcggggagtgggctcgtgttgggtggatggcaggtgggccccgggtttttgggtggcgggtctgcgcgcggtctagaaatttcggatgggttctatctatgacaagtgggcccatagttgggtgccatgaggttagtaaaatacgtttctgtagtttgaaggcgtaaaaggctttgagccaaaattatttgtgagatgaattaagctggccatgttaggtactcctatttaactatgtaagtcaaccaaattaaatttctgaagacttgcaaaagcttcacaatgcatttgtgactgtaaacaatcgtgttctcttctctgacaaaaggttacaggtaataagacacgtataaaattgtaaaaggacggcacgaaagaataatttgcatatgccaaatgagcgtagctctactcatcatgtttcttttcctgaaaccatcccacccgacatctacgctaggggcctgttcactttcatgcccgacatctacactatgtcaaaattttagtatgatttcttatatagttgtcaaaaattagctacaaaataaatgtagcaacttttttggcaactttaccaaaatttgataaggtttaaaatagcatcaaaatgaacaggccctaggtgtatcattgtcactcctacttataatcggtgttttaaataacgagataagatatttagtagttgaccttcccaaacaactatagcgggttaaatgaagttatagcggctaaattatacatgggagcaaatggttaggacccttctcaaacgactatagtcggagatagcggtaattatatttttgtatggtatttcatgtatggaaaatgcagggattaaatagcacaaattataaagtacgttgattttttaaaaaataaaaattataaatgcgaggctagtccagttggtacgtgctgatgcactaagatacagactttgcatatgtagtttaaatattctaacttgattaagatatggattttaacttggttttcgttagcatgactttcgaaatgctaacgttgtattccgtgtaaaaactttctacatataaattgctttaaaatatcaaatgaacatatttttaagttaaaaaaaataaaacttaactaaccctgtgctaatggttttctcgtttgtgtggcatcacttaatatctattttcatcagatttaaacagggttaaccaagcatgacgaaccgatgaggtcaacaaaatataatgtttaagagcctgggaagcatatctacgataacccataagaaaaaaaaaacgtgaccttattcctaggcaaaggatggttcacatcaggtggtctagtgcaaaccgcttccttttacaaggaatagaatgttggagaattaggctatgtttgaaatgatgtgataataacttgtgattaactgaattttaattattacaaaattaaaaaaaaatggattaatctgatattttagaataattttcatatagaaaatttttgcacgaaacacaccgtttagcagtttaaaatacgtgccatgaaaaactaaaacttttatctcgaacagggccttaatgcacatgcttcctatggagtactcccttcgtcccacacagggacggacttaggcctcaggccacgtggcccaggaaagaaacattatcaggcccaacaaattctcaaacttgggccaaaatgccatgtgctagcccgggtctcgtgagaaatctggatatgtccctggtccaaaaaaacgaatcttgataagtttctgtctagatttgttttactatgatatatcacactcagttataggtttgttttctgtgagacggagggagtaagttctaaatgtggtatcttttttttaaaaaaaaaacaaaaccatgtatgtatttaatagaaagctattataactccgatgtagacttcacagtgtttgatttgtttgtacccttaaataattatcatataatcattcatctatttgaaacggtaattatacccttgaacttgattaaaagttcatgtagcacccaaaactttaaaaacatccatccaacctcccaaattttattccattcatattcatataatccactatggtggttttgcaaagtgtttttttttctaaattacatatatattttttaggagtttaactacatgatatacacattggtatcccattttgcaaagtagtcctttttgtctaaattgcatatccatttttcctacctccatcccatattatagctacttatatcatttagattttgtcagatgatatagctacttttctatccaaaccaatcacaagcctccctcattttaatatcaccatgttacttaatttcttcaaaatagcattcataagtcactataaaaatgagacaaagggagtacatcagttctgttaacatgcatacaaacatgtgtataagtgaatcaaacatcgccctcacgccaatttcactacaaaattcctacgacactctttggcatgcaacgtgtagccttcaaagaaatatccatcggtatcactcgacatcgtccattgttttttctatccaaagagaatttattcgaagtgttggtaagatagctacctacttcattcaaccatcatggatccaacataaaaggtgaccaagataatatcactttttttgaaacctaagataatatgactctccattgcacaaaagaaatgcacgattaattccttccaattttgaacatgacacttgtgctcagctgtactggtgtatcaacaaactcacatgtaatgatcatggtagcatcacagaaaaggagactccgatctttcggccatgcatcggtaatttgtcacatcctggtcaaaaatagtcaatccacacggccacaagttgctcttgcctctgtgtttgtgtataagcatgctaaagattgcatttcccagtgttgtcgacattgacaaaagaatggcatttgtgacaagaaatgccaatattgatacttaaaaggaaatgaaaaggacacccactacaatttttttctttgaaatgaaccgcacgagacagtgcgagatttcgtatcaaagaatatagcaaagatgaactgcaccaatatgggttccatgagtttgccggtcatgtttagcaatgacatgggccacatggcccatctctcacccggaacaagaacaaattcaaccaagtatcacaggagagaagggcagcaatcttgttcttgtcatcagctgggatcaaggaagaagagggcattgtgctcaaatgcttggaatattgggaatggaattgccacgataatgtctataggtgagtacacttgtctgaataatctttcactttagttgattgtttgcatcaatcagacatgattctccacatgagattgtgaacaataatcaacgcctaaactccgccaacttcttggttcatcttgtgctgtcagattagtattttttcctcttgcgactaaacatagctttcagatcagatgcaccgacagactgataacatgtgctttgtgcaaccattatgcaataatttaagtgcaaattgacagctgagcaagcgaggcgaggatgccatgtctgaacttcaaagcagctcaaccggggtacagtacttgcttgcaatgcaaacctgaaaagcatcgtaaaatcgaaattaattcttaatggcgaaagatcagtagcaacaaacacaatgaaaatacagaaacttctcaaaaattaagcgatcagttatgcagggatcaccgaaccgaggagcaagcaggaagatgcttcggagaaacaaaccactgcatcttcagagttcagagaacaagagatgaccagctctgttgcctcctgatcgaactgtgtggtttcgttgaattcggggagaccgatttgagagtggcgtgctgtccttctctctgaaataccttaacgaactttttaattctcatgagatgtcgtaagacattgacagtatttccaaattaacgcctaatgtttcaattccaggacccagattcagatcacaaatccaaccacaatacaccaatctgaattcgactttacttgctttttcttcaaaaacaaccagcttataatcatgattagaaacagaaagagagttaattacacagacggccacacgaggcacgcagcccaatgacacgctgtcagcaacagacttgcaacagcttgcgccgttccgtccgtctgcgatcacgacgccgacggtgccggcgcccgcagccaaaagttagacggcgacggtaacggccgtcaccgtcccccgcccgccacgtgtccgggatccaccctaacgccgtcacggccgcggcacatcccggaacattccgtcacggcgtgtgggcgacgggacggaatcccgcggcgccctataagaaacccgcgcttgcattttcctcgcacacacacaacgctcgcactcctctcctctcatctgacatatctcctcccgtcctttcgaagcctctcgaatcgcatcgccgagccggatggcggtcaccgccgacgtgaagctcgagggcctccgcgccgccaccgacaagctcgaccagatcaggtgcgagttcatcccactccacttccactggatctacccgcgcgatcgtttcgtccccattttttttgtgctgattttttctgtgtgtgtgttttttttgctgttgtttttgttgcagcgagaacgagaagtccgggttcatcagcctcgtttcgcgctacctcaggtgagatcccgtagtgtttgcttcgattgatttgctgcttccgcggtgggttttgatggtgatggtggtggtggtttttgcagcggcgaggcggagcagatcgagtggagtaagatccagaccccgaccgacgaggtggtggttccctacgacacgctctcggctgctcccgaaggtactagcgtctcgttgtgaattgggtgatctgagatgctcgtgtggtggttttttccgaaccgatccgaggttcagtgactgtgtgtgaacactgatcatgtggtgatgtgtggatgtggtgcagatctcaacgagacgaagaagctgctcgacaaactcgtcgtgctcaagctcaatggaggcctcgggacgaccatgggctgcactggtcccaagtgagcacaattccatcccatcctgtttagaacttccagttggattgattagatcgtatatggccgtcatgctattcatagccagtataaactaagtcttacaaagcaaactagattttctcctgcttgtggcgtttacaatgatactatagtatggttgcctgctttgagtgatgttgatattgtactttgttaatttggtaactataaggcttgctcacgcatatgcaccaatttgccaaaaccatttcaaagttgttcagtgtgtttgatcagatcgtgggaaagtgtgaattatgtgttggttttaatgccacttgcccctttttaaattctacatgttattatattatatgtatgctcttctgtctatgtctcttagtggagttctcaatgttaacgatatggaaggactcaatattgtaaaattcttgttgttgctttcaagagctcttgcttttctgtgttgcagctccaaaaaatagtgtatagagtcctctgcgtttaatgtacaggcactaataatggagcaaatttatatttgctaggcatgctcattctcattgcaacatgccaacatcctcaatatgttgatacaaacatgcaattcagtgaaattgtttctctgatcagtctgttatgtcttatggttctctcttttctttgttttagatccacaattaccatcgtagttcagggcaccatatagcttacaaggatatgcattatctgcttgctgtgtggactgatctattgagtcatctatggcatattaatttttaaaggagctgatagcaacaagcattaaggctattgatgatgtcattgctgtgtgattttgtttgccccagtttgctgttactgaacttctgtgagcttgcaccctgttgcacatgaatctagtacatatgttgcaacttaccgcattgggatgatttgaatcttatattttctgctctactttgagttttttactgtttgcaagcggttaacatatctcactgtgcccctcaggtctgtcattgaagtccgcaatggctttacgtttctagaccttattgtgattcaaattgaggtacacttattttaactgacgagtttttgttgacaaatggaaatcatatgttatataacacatgccttacaagttttacctctgtgcagtccctgaacaagaagtatggatgcaatgtccctttgcttctaatgaactcattcaacactcatgatgacacacagaaggttgttatttctcttcaattttttttagatgtactaggattttagtatttgggccaacttgcatgctaacggctttttattttttctgaagattgttgagaagtactccaactccaacattgaaattcacactttcaaccaggtatagagctgcttctgtgctatgtttctgatttgtcgcatttttgcaccatggtgattgttaattaacataatcgtgtttcatgcagagccaatatcctcgcattgttactgaagacttcttgccacttccaagcaaggggaagactggcaaggatggctggttagtattctcagattattccaaaatggctttggtttatacatttgactataaccacttatagtagcagatcaaacctccctaaatctgaataaccagtttttgaatgtgcaggtatcccccaggccatggtgatgtgttcccctccttgaataacagtggaaaacttgataccttgttggcacaggttagctaaagtgctttgacctttcatgttggcattgttgttagcatcactacttgattcaaattggttgtaaacatgcgcacatagtcatgcaccacactccaaagatacagacactgagctgtgtgatgtgtgcttatgcttattcatcacacggacagcttctttgccatttcacgtttggtgaaactgcattaatcttgttgcttgagaaaattagaggaataaaaacatgttttccaaagaaatagtaaccaaactatgacatcaccttttggggctaacaatcataaaaaatgaatgcaatactatgactaaaaatatgtgagttctttattgcatattgatactcgtgtgcttacctattttcccattcttctcagggcaaggagtatgtctttgtcgcgaactcggacaacttgggtgctattgttgacatcagtatcctaatatgaagaccaaaatcacatgttttttcccatgtttttatcacttattaatgcacttcatcttccatcagagtttgaatccttaaccatcacagagatcttaaaccacctgatccataaccagaacgagtactgtatggaggtatgcagcaatagttactatactattgttattgaatatgcacaacatgaaaattaactcctgtatttattccaggttactcctaaaacattggctgatgttaaaggtggtaccctcatctcttacgaagggagagttcaggtacttgtttgttctcaacttggtgtcataatttaattgtctgctaagaattgtatccagaaattactatgtaactagcaaaatgcaatgttaaaattgaaacaaaccactctattatcttgttcctattattttcagttagtgtctgttcctgttaattccagtcatatatatcactaagctttgaatggtatcatgtattttttttgtgtgcagctgttggagattgctcaagtccctgatgagcatgtatgtaccctccactatatcgttttatttggattaatgagcggcaagtgctgatgattatttttcttgtcttcttttttcccaggtgaatgaattcaagtcaattgagaagttcaagatcttcaataccaacaacctgtaaggaagttatgctgtctgtctatctgtctttgattaggaatttctcgcttgctaacagcttctggtaacaggtgggtgaacttgaaggccatcaagaggctggtagaagctgaagcacttaagatggaaatcattcctaaccctaaggtatgccatctatggttctgcgtgtatctgccccgttctattctgtccattggcatttaccaaagcagttggtattcacaggaagttgatggtgtgaaagttctgcaactcgaaactgcagctggagcagccattcgggtatttaactcttctagaaacatgatgggttgctgctccatttttgtatcatttaaatgctgtgctctaacacctttgctttatctagttctttgaaaaagcaattggcattaatgttccccgctcgagatttctgccagtcaaggctacatctgatttgttgcttgtacaggtatatctaaattcctcaccatgcttttgttgatttgatgtcatgattcagctgtgctaagctcattttcgtcctccagtctgatttgtacaccttggtcgatggctttgtcatccgcaacccagccagaacaaacccatcaaacccttcgattgagcttggacctgagttcaagaaggtaaatcagtttgtattcgaaacttttaaggcagcattaactagaaaagaaaagcaaatcaggaaagcagtgactagtgaaagctgagttgtgatcataactttcctgttctggatgactataggttgccaatttcctggcccggtttaagtcaatccccagcattgtcgagcttgacaccttgaaggtctctggtgatgtctggttcggctctggagttacactcaaggtaaacctactctagtgatttgatgacacttcttgagatactgtgacgctaataaaaacatgctg

SEQ ID NO: 64380 - DNA, 635 bp, Oryza sativa
ggaaagcagcaaccgtcgttgcgcaacggcggcgacgacggcgacgacgctcgtgaggcaccgaccgagcgagcaaatgaggagtgggaaggtgacgggatgctcgaccccctctcgtcacgctgcacccactggagggcgcgggtgcgagccaggttcggtgcaggtaacgtaacccaaacacgcccttatccgcgcgcctcatcgcctcgccaagacgccaaccaaacacacaccccttatccgcgccccgcccgcccaggaaatcccgcgcggccaatcacagcacgcccgcccgtgatcgcgagatccgacgccccacccgtgatcgcgatcccactcccctccacccgcgcgggtacccccccacgtcgcctactcgcctcgtctccccgtcatcgccaacgtgtcgcggctttccgccaccaaatcgatacggaacccggcgcgcatccggtcctctcgtcgaggcgagaggaacctatacattcgccacactcccctgcttcgcttgcttgccctcctcttgcgtagggaaaaggaagaacacaagagcaagcgagagcccagaaatcctatcctcgactggaggtttttgtgtattgtatagtggtagatttgggtaccgagctcga

SEQ ID NO: 64381 - DNA, 1684 bp, Oryza sativa
gatggggagaggaggaggaggaggagatagttatttgtggagaagatagtttcccagcgcgcctctcacttcctatccggaactgaagctttgacgcgaataatgccacaggatgagaagcggagcggcttcgcttcttgggccgagttgggccggcagttgttttatctgatggtacaagtctaatttctatcctattttgaccaccctccaccaaacttttgaaaccggtgtcatttgactctctgagcggttttgagagtggtttttgctgatgtggctcgctgatccggtctaaccagctgactcagcatgtaggacccgcatgtcagtgtcacattttcatctccctctctttcttttctcttttcctcctctttctagcccggctttgcaaggtggtcggcgagcatgctcacaagagccctttcccgccctcccggagcaggcgagcagccacaagctcggctccaccagtgaacgagcatccctcctgtggttagacggaagcggcaatccagattcgtatgatcctagcggatgcggagcatgatggtggtcaatgttgatgacgaggctgttagctcagatagggttggcaattcaggctcgggtactagcaacgctcacgaccagatgaggtgactggaataggtgagggatagggcgccgatgcccacaacggtggttgactccatgaacggcgaactagagcaggtgaggatgaggttgtcgtatgcctcaaccaccacgctccctatcccgcgaagaggaggagaagcaacttcagtgatgaatcagatcccacccgcaccgagctccgctcctctgaccgccatgagctctaagaccacctctgtcgccaccgtcagcgtagaagaaagttggagctgcttcgtagggccgtccgaggctagaaaattttcttctttttttttaaaaaaaatcaaaacataaaattttcaaatcagggttcagcggttttcttagtttttgtgagaaccatatgaaaactacttacaaatatgttcaaatttggtaaaaatttcaaaattcaacttgaatttttgaggttaaccgagaaacactctgtttgtgttctcaatccaggaagtccggtttccaaaaaaccaattgattttcagcgtttttgtaaacctagggactgcccggggaaattttgtgatatcatacaaattttcctagtagccttagagactaatccagctgataattcgcggtgataatctgactttagctttctcaaaaggttacagaggtagcaactttgctccaagcaattgttccctccaatcaaattttacgacaaaatttggtcaaatttttactaaatctaacaagtgcaagacatcacgatagtagtgtttttgaaagacaaatctctacacatataattattttggctctgttcattccagggtgataggggagattgagtctcgttttccacgcgcacgcttttcaaactactaaacggtgtgttttctgcaaaaaaaatttctataggaaagttgctttaaaaaatcatattaatccatttttgaaatttaaaatagttaatacttaattaatcatgagctaatggctcacctcgttttacgtatcttctcaatctcttcaattcccttctcctcaaacacaccctttgtttttatacgggcaa

SEQ ID NO: 64382 - DNA, 13574 bp, Oryza sativa
ccgccaagtcagggaagttggagatcccagatggagccgtgcttgagaacaaggtaacatacccatacctcttaaataaacctgactttcgcaactgcttagctcccctttgtgaattgtgatgctcgacctgacaaagtgtccattggataactttcaggacatcaacggtccggaggatctttgaggctgctcacggaaaccttccagatatatttagctgagcgttttgtaattgtcgtgtgcattcggcagccagggctcgatgatcccattacagaataattgtaatcatcttggcacatccgtacttctgttttttggtgtgccaagggcgttgtatttcatttacttaaatgatctcgtaataccatagttttgcatgcactgtagctgggagctcgtagtttactggtaattctattcagagtttactactgattgccacttcgtcagcttggcagtcgatgtgcgacgagtcgcacattacgacacggcctattgcgcggttgagctgaaattcgcaatcgcaatctaaccatactagtcagtctgccagcgaccatggtttccttgtcgcctgagcaggctggcagctgctcgtgctttcctctgcctgatgctacatgcctagtccatccgtagttctgtgtgattcagaaggatatgagattgcataattctacataaatatcttgatactttgtgaatgatacttccgtgagattcagaagggcacagaacgcataatgattcagaagggcacagaacgcacaattctgcatcagtttgatgatttgatatttcatttcattcttgggcacccacggaatggaaatatggagtgaaaccgagagacgctcagaacgaacggtcatctgagcggtcgagcagcaggcagaatggcaagagagtatagtaacatgttgcaggaaatactcgctttgcaactggaataaaccatccacatcgcgcaggatcactcaatccaagctgtgaaattcccagcatatgccacgttacaacctctggtccttccacaaaaattgaaaaagaaaaaaaaagcaacatctctagaaggctaaaataaacacttcaagaaaccgaacatttacaattccagcgcctagaatctattccagtgtggcgagatgccatgcaaggcttgaacagagattcgacactcagacaacagttccaaatccatgaccgatgcgatcgctgtgttgattatgactgctgtatatcccgaaattaatctcatcatgcaacatgattagtcaccagacttctcaagttcacacagccaagtggttgtcaatatcaaaactgcgaagatctgaagcaccagttcctatcctgaaacatagtaacacaagttggattttaggtacaatcgagatgccatgagattgcttccgttgtagaactccaagcatgcaagataatccattttctgctaattactaacacacacacacacacaaaaaaaaaacagaaatgatctgatagcagttcataacataatggccagttggctacgagactacaactaaattattgcatgcttgaagagatggcaggtaaatcaactaaagcaagattctgagtttagcaaacttgcaagttgcaatagccatcaggattgtcagacatggtaatgacaagtgggtagtggtcgtaccttttgtttatagtgcagtagtggaatttgatatttccggacttgacatcttcaagatactgcaacaaccaaaattcatctcatgagcttgtggtgccaaaatcagaagaagacaaaaaaaaatgaagaatgaacagaaagatttgagtatgggaaggcgggtttaccatcctcaaggtgacaatgatcgaagaaaatgctagagaatcaaatggtatgtcatccaaggcaaaaagtgcacattctagcgattcaggtccaggtgagaagttgggggtcttcaatcttgctcggaaaataatgtaactctactgcatgtcatcataacaaacaagatcaacttagtagagtattgagctatcatggagactctgacaatgctaatttcactcacttggccaatcagtggaatatccaactgagcaaaaggtgaaagtatctctacatctgcacaagcttcctccaatgtttcccgggaggctccttccgctgcagactctccaacctccaaataaccagcaggaagagtcctgttgatgcaaccttgattaggattatggaccaaacaacaagcaccaaaattgactgggaatgactgcctatgctttacaaatgactgggaagagacaaaagcaatctcaacattgttgcattagaaaaataggaaaaaggaacaccgttttacatactagaatcatatcagtcaccagtcgatgtgctaaacataaaaaagaagtgtatttaaactggattggcaagagtgaaacaaaaactaacactataatgtaaagaactgtacagttttaaactgaattggatacagcgtgcatgtactaaattgattttgattattatattcatactcaaaataaagcttgtacagtaaaattggagcatggtaagactgctagttctctagtatagtagtatcacaacaccagtaaagtagaaccgtttaagaaaatgcatggagttgataaaagtagcttaccaaaggccataagctggttcgatctttcttctgcaaaggagtactttgttatcatgttccacaagacagccaacaacctatcaatatgacataggttaatggcaaaatggaagacgaaagccaagtcatactattaaacatatatacgccttcaacaaagatatatgtgtgtagtaaaaaaaacagagcagatatgcacagaagaactccgaaggagctggaactctatttgaatcaagcaagttacagtggctaaattctcaagtctaaatgcatatgcatcttcgaagatggtctttggtcctaaatttcgttctacagttcgtaccattttggggttctcatagtgaactcttccacaagaagagcagacagccctcatcttttcatctccatctggaatagccagtttcgtcgggcttccacaagatgggcaaaagcgtatctttgacttgggcacctgtagaagggaaacttaggtgagatcaaatgtgtatgtaacaacatgacaacttaacacttaaatcagtacaataactggaaatcgatacaacgatgccatccagtgttacatttattatgataaaacactagctgaataaccaagcaaagagccaggctaagcacaaaaggccaatttccaacaccaatagtgcagaaggcacagtgccaacatcgttttgaccttatacacagctaattagagctggcacaggaataggatttccgagtggattggttagctgatcaattgcactctttgttgcttcccactactgtgcacccgtaccgtaaaatgttcaatctaaataaagtcatcagtattcctggttgctttataaaaagaattgcacaaggtagatgcatgattcaatcagagaacactgcaattctacaaattgtttgcagaggatgcgattatagaggctcagtaagcgctcctcgctaggcaattggtaaaggtaattaggtcactggattagagtcaacgccctaggtgaccacgcacagcagcaaaattctgggtgcggcacccgcccaagcaatcccaatctcactccctcagcccgatgactgcagcgcggacacgagatagagcgcgcgggggctcaccacggggggaggcggcgagggggcgggggagctggcgttggaggaggaggccgacgacatgcgtggcgggcggagcctactggccgcggaggcggcgcgggggagcggcggcgggtggcggaggaggaggcggtggaggcgcggggagaggcgggcggcgtggtggtggcggtggaggaggaggtggtgggatctgacgaggagcatggcgatggtggattttagtagtaggcgagaggaggggagggttggtgggcggagcggaggagaggaggagagatggaatggcgaggacggcgtccgtccgggcccgggtcaggtcggcgaggtgggggccccggggggtgaggtaggtcggtcggtcgacacgcatcgcgtcgccgccaatggggtcgacacggagaaaactatggtcggcctgacgtggcaggtttatcaatggttttttttaagagcaagtttaaaaggacagtctactactggctccaaatcatctataaccaatattatagccaattcatataatagttgcttactatactattaatacttggtcccacctgtcatacacacattatgtcttggagtccatactgcagctggctacagatatgtagcccgctgcttttctctcttttttttatctctttaaaatatgtttatagctggctcatagcctgctattgtacttacactaagaaaggacttctttagttcccaaaacaaaatcaatgacacagtttacgtgtaaattgcgagacaaatcttttaagcctaattgcgccatgatttgataatgtagtgctacagtaaacatttgctaatgacgaattaattgggtttaataaattcatctcgcagttttctggcggaatctatatttttttgttattatactacgtttaatacttgaaatatgtgtctgtatatccgatatgataatcaaacctaatttttttcctaactaaaacaacatgcgattaccgaaagaatctttgaatcgggcagccgatcttaaaaaaaaatcgatcggtcaaatgttgcaattgaccactggtgaaacattgagttatatatggtgaaaaaaaatcacggaaacatttaacttggacttgtgaaggggtagaaacattatatcgcgtgcgtggctaggtcaataacaatcaaagcggacagaaaacgatcaagaattaatggaagtgttaaaatgggagggaggtgaactttagatgctattaaagtgaacttttgatgctataaccaattttgcctaaattttacggcatagctaaaaaccagagagactaaagaattagaaaacttacaaattcaactataatatattagtaatataactacatcttcactcataattatattaccacacgtaatagtaatatataaataaaatataattacattgtaacttagaaaaatattatcacatgcaattgtaatataaaaaaataattacattgtaacctaggaaaaaatggtatcgctatgcgttgctactttttctctctccaactgacgtcatctcagatctaatctaatctaaaagtggaaaattagtaagttttgctctctgatttctgtcgacggaaatttagctgttccgcatgttatagtcgagtgtaaaaaacgtacctaactaaacgggtggcattagaaaaaaaaactaatataaaaaaattagaggaggtgacttcaggtgccggggctttcatcaaacaggtggcattggcaacggtggccgcgacgtcacctcccggaagatggccagtgacttggcgagggcgtcgtgtgccctcgcgcgctcccggagatggtacaaggccttgtacgccattatcagcacgaggaaggccacggcgacacacatcacgaccctgtcgctggtgctgcagtcgcagacgagatgtggtagaacgacgaggaggacgaagacggcggcggccgccgcccccacgccggcgacgtgaacctgaggacgaattcagcgtcgatcatgtcgcgtaccagcgcgtccgcgtcgtcttccgacatgcccgacgccaccagcggcaggtacttctccatgtacgccctctcgagcttgctgtcgtccagcaagcccagcggcgccgccgcctccagcaaggccagcagcgccgccgtcgccgccgcgctcgtcacggcgcccgacgccaccatctcgttgtggcgcgccgcgcaccagtctctcctcttgaggaagtggctttgcgggccttgcggcagccatccgacgtgcaagtacttccagacgtcgtcgttgctgctggccgcgtttttcggtggcgccgccgtgttcatcatggccgaccggtttgatgcgctctttctttttagaaaaagaagaaaaatcacggcacgaaaccaccagcaagtgccggtctggctggctggaatcctgcatcgtatccggattttatttcgtcgttgtaccgatccgattcggatctgtattgtatctgcatcgtatctggattttgtttctgtattgttttttgggtttttttatacataatttatattgttgattgatatataccacctttttgttatgagtgatggttattcaagatgcatggtgaaatcaattaatcaatcaaaaggcggtcctcccgtgcggacgcacgcattatggtcaaagataatccttaatttgaaccgatcggttcgttacttaagaggctaatcagtaacggaattatctccggatccgaaactaattatcaggccgaccggatttgggttttcgctgaataaaaagcaaacgacgacgcagagaatcagagaaagaaaaaacgaagaagaagaagaagaagagcggccatgagcgacctagcggcggagaggcggtacaaggaggagcaccggaagctgatggcgtacgggatggcggacgggtgggcgtacgggatggcggacgggtgggcgcgcgacctgatggacaaggcgaccgaggctcggtggagggtggacctggggtcgtcggtgtgggtgatcctgctctgcgtcgccgcctgcctggcgctcggcgtcggcttcccgctcgtcgacttcctcgtgctgcccagctccgagaacgccggcaggatcatgctgctcgtgtgggcgctcatcggcgccctgatcatggcgtactacgcctggagccattaccggaagcgcgcggcggcgcaggacgtcctcgccaaggcgcaggacgtcttcaaccaggctggggtgtcgtggccactcccagtttattgttttaagaaacccagtacaaacttataccccgacaatatgggtccaatcacaatcagattaactgtaccctctgtagacacctacaatacgagtacagtcacctcctatgtagccaccgacaatacgagtacaatcacctcctctacaattgtacacccgcacaccctcccactttagcatatgttgttcacccagtttgttattctttgtacagtggaaggacatgtcacatagacgttgtagtgacttaactagcacacccaagatagttcaaatcttcatatgagcaaaaattcataatctaaaaaggccgtatatatcgggttggatgtagatgccgggtaaaaaatacccttttctaaagaaaaactatactatgtactaatattacttttggggaatttgctaaaattatggtgtcatttttcttacgtaatttcattcatttttttcctatgtgattgcgttgccaaaaattatgtatttgtgtacttttagggctctaagatttttttcatatgaggtattcctccatccttggaggggcatatacctccctattattttagtgatacaaattaaaaaaaatgaaaatcttagagccctaaaaccacacaaatacacaatttttggtagcgcaatcacatatgaaaaaaatgaatgaaattatgtaagaaaaatggcatgataatcttaacagattccccaaatactacccaaatactattttttttcctatgtgatagcgctgccaaaaaaactctgtactaatattacttttattcagtttttttatttctctcaaatcagtccaatggttaaaaatttgtaagatattagtagaagttttctatcaaatgaggagtagacagtcacagtcccaattaattaacgttgcctgcacaaaccaaacacgacatatcacaccgcctcatttttacggcttagtgagggagatgacgattcatcctttgagaacaaaatcactcgtaatcttacatatcatgtaaataatatttttttaacaaataataataaacagtaatataagaaatatcactccacgaatatgcgaggtaaaattctgagttctataagttataacaaaatgaacaaaactaaaccacgggaagttaaattttaagttgcatgctgtggagtgtggagtgccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggatatactttatatttatctaccttatcattttatttccaaacgttttaataaccacttaggtgacataaaaataaaaatgaggggatttcacttttcactcgttgagagcgaagctagccatcggccccaccaaaaaaaaaaatccacaatacgcgcggcggcttctttcctctttcgctccccacacccttcttttgtcgcgctgatccccagacgccggcggctactgcgtttgcgatgcccgccgccgccgccgccgccgcgccgcccaatcccaacgttctgcagctagccccacgcctccgaggcctcgtctccttcccctcctcatactcctcctcatcgccgttctccaaccgcctccgcctccgcctcccccgcgccgcctccatgtccgccgaggcgcgggtgcccgtggcgccgccggcccaccccacctacgacctcaaggccgtcatcaacctcgccctatccgaggacgccggcgaccgaggtacgcaacgtagatagcagtcgtgtatgccgtgacaccacaagcaaatcctgttcctgtagtggtgtagtgtagtgtaggcacaattaagtactaacatttgttttttggtattcatttctggtctgtaagatcactttgttaaggctctctttgtttaggcttataagccaacttataagctgaaaagtctaagcctaaacaaacaagcggcttattcatttgacttttctaaagttataagccactctaacattattaaaccaaaaactaggttggagaagttttttttgacctatttgagatagatgtatgactccaccactaaatttagcacattaaatccaccagcttataaaccataaaagccaataagctgacttaaaagtctaaactaataagcctaagcttaaacaaagagggcctaagtttcgcggtggtctgtaaattgcaatcccatatatgcaatcaatttgtttggggtacatttatatctgttgttttttctcttcagttctttaacagttactagcatagtcatgaacgtagacactgcggttgtattagcaaaataagtttatcatcattggagattcctacaaatatgattaactctattggagctaaaggaacatattcaggtgggctgctctgctttagccctctgtagtctcctaaatagtactagtaacaatctagtatggtaatgctacttaagttcttctatctttgacattgaactattgctgtgctttgaacttatttgcagttctcatctttcagtatgagtctgacactcttggcatcatatttacaccttcaggggatgtatcttgcttggcaaccataccttctgacgtgaaagctgaagccacctttattgcaaaggaggatggtgttgtcgctggaataagcctagcagatatgatatttaagcaagttgatccatcattgaaggtatatcagcttcatagtttcattttgctgtttggcagggcatgattctgcacatttcatatatggcattgataataccattttgggggccattttacaggttgaatggtttgaaagtgatggaaattatgtccataagggattgcaatttgggagagtatatggtattctgcctaaaacaacttattgtatttggtagtgcctaagttcttgaattgtgttaacctggtaggtctaacacacttttcacattttcatcatttgtatttaggttgtgctcgcaacattattgttgctgaaagagttgtgctcaatttcatgcaaagaatgagtggaattgctacaatgacaaaggtgattggtgaccttagttgatagctaagatgttcgtctttttcgcagatgaagtgaaacataggcaactgtttatggactttggacatgtttcactattcaaacagccactctagttgctccttacatattttcctgataggtacatgcataccactttccagatttgatgataatcagccaaggctgattctcccgatctgatttttcagtaaaccactttgatgtcttgcttttcccagatcaagtatgattaaacctggtgggctgtgtacatatgatttggatgtaaaagctgggttttaatctatgttctaaaaattaatataattataccctgttgtgtgttatgtgagaatgaatttcatgcaacatacttttttattacattcaggccatggccgacgctgctcatccagcatgcatactggaaacaaggaaaacagctccaggtttacgcctcgttgacaagtgggcagtaagatacctgtctctctttttttttttgccactttaacacttgtggcttatttttcattccttctgttgcaactttaatcgtgcttgtacaagcataggtactaattggtggtggaaagaatcacagaattggcttatttgatatggttatgataaaggataatcatatttctgttgctgggggcataacaaatgcaatgaaatttgttgatcgattcttggcgaaggaaaagcttgcacttcctgttgaggtatcatctagtgattacatatatcacatctaaacgatgcacttatgtttgcatgtgattctgttttagctttacatttttctctccaggctctttagttagaaatgtgcttacgttcttgtttaaaaaaaaaaagctaaaatgagaatgtgcatatgttgacagtgattacattttatgaatcaggttgagacaagaacacttcaggaagtaaaagatttattggagtatgctgctgagaacaatacctctttaactcgtataatgttggataatatggttgtccctcttggtaacggtgatattgatgtatcaatgctcaaggatgccgtggagttgataaatggtagatttgagactgaggtgtggcaggtttaactttgcaaagcatacatttcctgcagtgttatttacataacatgggtgggggaagtgacaatttacttttattgatccttataatctgatgatgtcttgaactgctgttattattctatattgcttatttatactcattattaacttggggaatttagggtaaatatgatgtaacggtagactgcagggcttattgcatagtgaattcccttgtttaactgacgaattacaatgaaatgtgactgttgcttcaggcatctggaaatgtgactattgacacagtgaagaaaattggagaaacgggggttacctatatttcaaggtatcggcatcttgtttctattaactgctactaattatttccatttgtcaactgatatcatgtgcactgccttctgtttgagttgagatatgtttgcttttcagagcaattttgtaatacgactttaattgccagctctttgtttttgtttgctgttttactgtagaagaacaacctgatatcttgaacttccaaatcatttatttcaacaatttcttgattttcttttcagtggagcattaacacattctgtaaaggcacttgatatatctcttaagatagacactgaactcgctctccaagttggaaggcgcacaaatcgcgcctgactctacagaactaatgtaaccttgcaagatctgcaggtacgtttagttccccatatacaacttgacctttattttcctgcttctctaagctaactctttggagccatcagggtgtttctgtggcgtggcttgccagtctatcaatccatgcccttctcatcaacttgtaagcgttgagtgtacaacaaagaatgtgttttcccatatttatgggatataaaccaacaccacataatacagcaaaataataacattaccttgtaggcttgcctaccgtcctagcatttgtatttggtagaaaaaaaactgcagattgcggcaagttatcgaattttactcaggtattaataagactttttgcaccatgaaaaattagcaagctggacactgtaaatgggatgtgcgcggcattgaacttgcagttctgcacttgtgtttgaccaaacaaacactataaaatggtgatgtttgtgatctacaaaagaaaaggaagtctaacacagcagtgcattctttttcagattccatgtactcgtattgaattcatgttctcaattatagtatactagtatcattcaaccgtcttgtctgcgtactcgctcaagggggaaaaatatataaggtcaacttttttttccattaacaacagcattctgtggtccttctggacacatgttaacctatcgctacttttaccgcatccataactcttcatgatttaacccttctgaagattgcatccacaaacaagccttgcctgcagcgagacattcagaatgttttgctcacagagttattaccaccatcattatgttctatgcagctatcaagagggataaggggaaaaagaaaaaactttatatccgaaaatgcataaccatggtggtgtagcccactggttttgtcaatttgctacgtcacgctccccggaatcgacaagtgaattaatcaaaatcaaatcaactggagaaggtggctgtgtacgcctgtaataagtggggctgcggctggagtagccgctagtcggatccgttggttcaaccagcgcgattacgcgagcttgaaagttgaagccccagtgcggtcgcactcatgcgctcagcgctcgtagatgagtccgaaatgatatcattcgtacaggaacgattttaagttggcaagcactttttttt

SEQ ID NO: 64383 - DNA, 3261 bp, Oryza sativa
aaaattgtcaacaacaaagttgtataacgcatcaatattacaacttttgttttggtcatttttctatatgactttgttttaaccgtttgaatttaaattttaaaatatgacaacttcaaacaatattttgaaatactaaatgatttcaactgaaaaagtcatcaacaacaaagttgtataactcatcaagatctataacttttattttggtcatttcttcatccgacatagtgatagtaacattgtttataaaatttatatctatatcatttggttctataaactataagagagataggtaaactttgtaaacaatactactatcactttattggacgaagaaatgactaaaataaaagttgtatgtcttgatgagctctacaacttttatgttcatgactttttttagctgaaattaattacagcttcaaaaatattatttaaagttttgaaattcaaatttttaattgataaaacaaagtcaaaagaaaaaaatggccaaaataatagcagtaagaacacaataacatgatagagcatgattttagaaacatttaggaaaaaaaatcatccaatttggagttcatatgagtgagataaattagtttcaaattttcaaattttatttttgcatacggcttcttaagtcacccgtgtggaaaaatcaatttttccatgcgggtccttaaatggtccacaaacaaacaaatgaaaaaaattcaattctgaaaaataactactcaaatttttaaaaactttcaactgaaatgttcaacccaaaatttaaaatatttaaaaaattttcaaaaatttcaatgtgcttacgaaaatttcagtgatactcattaatttatttgtttcatgataacataaatttgtatggaaagtaaacaaaacattttctatctccccttgcccttataaatagagataaaatttgagaatactgatgttttgtttttgaaaactaatggctatatcgtttttagaagcttattttgtggggtcttgatattttgataattattcgttaccgtattcatttcgattcgtattcgctccgtatctgtattcgataatattcgattccgttttcgtatccaggtttccgattccgatttcgattccgagaataaaaaaatgaaaacgaatatgatagagctagattccgaccgtattcgatccgttttcatctctactaccgtccctttcagctgacataagtacgtcatggacaaatttctgcatcagttccatgcgttttgcttgcgtgtctgcaactccaaatgtcacacatgcatgcactacttcaacagtcagatcgatgatccacaggtccagacaaatcgatcgagacaaaacaaaattaaagcaaatacgaaagcaacgacgtcatgcatagtagacatctataccaattcaaatacgtgcattttgaattcttccggtgatcatccatcttggactatataataatacaaacaaaaatacttggtctcttgtgaggaaaacaatacatacatctatccatctgcttacgtagatgataggtacacaacgacgataagtatatatacacgaactcgtcctttgaatatgaagtaacccccgtttgaaaatataagtcaagtatatatagataatcttgactttactggataacaagaccatgaaaataatttaaaattttgcgttttgctagtactactctattgtatacgtatattgattgattgattgttcaaatttgacctcgacttcttggagttatataacgtttttttctccattggacgtacggcttgcacatgttacagcgacatctgtatgggacaactactattcatatacatattgtactatactatgcatatacaatttaaaaaatgaattaatcaaaagaattgaaaatgaagtgatcgaaacggatcgactgatcgagatggctacgtacattgaaagctacgtgcatgtaaaacgacgtcgtcgtctttgtgaattgtgacgaaacggacggagatggagacatgcatacatttaagtcataatgtttattagcaaccaacaaacaaaacttttgtatacttgtttttaaccataattaatattaaaacggagtaatatctaatacatattggttcgcaagtctttatacgtatcgaatttagcagccgacactaacttatagcacgaatgatataagttatcggtgtcggtcctacaaccagttctaatatttaattagtctcccgtattagtcggaagataaagagaaaatgcttatatttaaccgatacatataggaacgtccttcattagagttctatgctagtttgaaaatcaaaatactacactacacgaaagtaaataaaaaatcatcttaaattaagatatactaatattcaatttccgtcagcatctgatgaattgaacggttgtattcttccccctccttttccaactcataaactcagtttttcgtacgacgataacttcaccttccgaacatagccataggccgtcaacgtgttcgtctccatgtactgaaagcgtcatgagtcactgtgtcaatacaaaagttggagtaggtttgcttggtttgatcttttgatgcttctcgacagttccaacaccggtttcccaaaaattcagctgtccatatgcattttccatcttccaactagcgtgaagacaatttgctgggacttgctcgtatgaatccaaggcgtgcatggtcagaacttcaacgtgtgtttccgtgttcctctctatctgcccagcacatatatatccatggttatctagaaaaacatgcacatcactctcgttttcatcattcgaaaataatatgaataactagtattctctcatgtttcaaacttatcaacttaatttctttgccatcatccaaaaaataaaaacaaaattatcaaccataccctgatgtccactaatataacgcacatatgcaggtggatttttaacaggaatttagtgagattaagcggatgtgctgtcggtttccgtctcttaaagtatgtgttaggggactattcgcgagagtgtgagtgtggtgttgcgtgtgtagtgatctaacgtgcaatcttaaaaataaagctcactaatgtattttgcctaattatcttactattttctcatgaacttttaagaagatttggatgggatttaggagctagactgcctagacttggctccgtcctgtttatagacatttggatttgaacactaataatggtgtca

SEQ ID NO: 64384 - DNA, 3855 bp, Oryza sativa
tgatttttttggcagtcaaaaatacccaccaagtttagtcattatcttggcggctgaaattaacgcggctatgtagaaaccaccaaggtaaagtgtattcttgtcggtctagaccgttaaggttatatttcttagctttccaaaagtttgatattcttcatagttttcttggcggttagaccaccaataaaactttcccttatggttaacagtcaagaaaatctggatttccctgttaccttagacttggtggtttttgggcgctaaaaaaattacggattcttgtcatattagaaaaggaaagcaagtgctttcagacgaaatttccctgccaatacttggcaaccaaggagctaagccatagttagcaccagctggaactcactgatgacttgattcatcaacaaggaaaatgccgtggtctttccattgatttggctaggtggtggtcaatcaagcagctaacgcgtgcgcatgcatttgccggtatcatcaaacacacaatggcgtggactgactgtgtggatcaagcgtgtaatccttgacccacaccgagagactgatcatatcgatcgatatgatgatccgtatcatcactgctactctacatatcggtcggttgatcgatcggttggtccacacccacttgtctcctgtatgctcctcctcacctgcaaagatgcatggaatcagcttagtaataatcaatcgccagcagcagcagcagcagcagcagacagtgcgtgtagtagaacagtagaggcgttcacatcacgtcgcatgtgcaggtcgtcgtcgtcgtcgtcgtcgtggtggtggtgaatcgtccactgctgatcctgcagctagcctcactgtccaatgtccatccagctccagcatcgtccagccccagtagcgccctgtaactgtacagtaatggacaagaacaaacagtacagcagtgtcctgatcttgagagaggttggggtccatgaatgcatgcatatgcctctcgatcgatccatggcgatcgacatggagcaatccgtgtgggctcacgggagctgagctagcggctggcaatggctaactttcagggaattgaagaggaaagccaaaaggcaaaaagctaaaccctaggacagtggcaaaagcggctcaccttgaaatagattattaaagggattactaacgaattatatacttaattatataagtaaatgaaatattttgataaataaacttaacaaattaaatagcttccaataactagtttaaggctgcgttcggacgagggggttcccatctcctctctcgtattccgcgcgcacgctttttaaactactaaacggtgtattttttataaaaagtttatatacgaaagttgtttaaaaaaatcaaattgatccttttttttaaaaaatagctaatacttagttaatcacgtgctaatggattgctccgttttccgtgcgaggagatgagtcccaaccccatattacgaacacaccctaaggctgtgtctggtagcttcggttgaaaacttttctcccgcacacgtaaaatagagtgagtagagtgagttattagtgcatgattaattaagtatcagtaaaattcactttaaaaatagaataatattattcttaaaattaactttgctatatttttttttaaaaaacaaactgtttagtaatttaggaaacgcgtggatgaaaaacgacagtactgtagatgttgtgaaaggaaaagaaaaaaaaaacgcagcctaagtacattaaaagagaaactttcttttcgagaaaatgtgattttttgaaacatgaagcaaacacttcatttcaacaatccaataaataatctgaaaagcaacttaggtcaagtttagttctaaattttttttttcaaactttcaactttttcatcacatcaaaactttccgacacacacaaacttccaacttttttgtcgcatcgttccaatttcaaccaaacttccgattttagcgtgaactaaacacacacttagcattggtcggagtacaagtacaaccaccatctaaggggcaggactggctactgtgcggcattggcatcttgcttgtaccatggatcgatcttgccaaacattttctcctccatcacctgcatatatccatcgatccatccatatcatgcatgggtactgtacgagtagtacgtttgctgctgctaccttttctggttgtccatggccatctctctctgttcatcacacgctagctaagctatcagctggttagctatagtcatcgagatgatatgtagtacagatggatcgcacgtcaacttttgcatcgttgtgccggtctgatggggatcgaatatgtatgtgtcgatggtcagttcgtcacatggtcggttctatagcttggttgggttggccgcctgcctgcttcgttggtttgcttgtggttttctttcttgtcagtgtcggaaaaccgagacttctactagaaagttgttcatcggtgatttcagatttaacatgtggttttgttaatttattgtgtcggctcaaaagaatagtacttactagtactagttatcatctttcccgtggagttcccaacttctccaaaagagaacacgcctaatacttaattaattattcagtaaaaagtttttgcaaaaagtttttttatagctaatacttaattacttcctcattttcatattataagactttctacattcatatatatgaatgtggacaatgatatatgtctagtttcattatcatatatatatatatatatatatatatatatatatatatatatgaatgtgggcaatattagaaagtcttataatatgaaacggagggagtaattatttagtaaatattaagatttaaaaagaagtaaccataataccctctattaaatgatgtatggttgaatgtaggtgtgaggacagaggttgacacaagtacacatatttcgaaaatgctatgcatatgatttatgtcattatgtgtacgattgctaaaggatgaatatacatatgtttcaaaaatgctatgtatacgatttatatatacgattaaatgatctatgcagccacactaaactattttctctatttataaatataagagattattttaaatttttgaagagattaaaaataaaaggaaaatactatatgcctcttatataagggatgttgagagagtgggaattgtcggggacaagatattaggtgaaaattaagtcctaagtggttaattggtagggaaagttgtactatataatattcccttgtatttattaacaaattttgaatcctaaaatctcttatatttacggaatggctaaagagcatacgatattttttaacacaaaacttttgaattgttgaccgtcagattgtttcgagatttgtgcgcgagggagaaaaaggcacagccagagtcgaacacatgaccggttagatgcatatcatcattgctactcctagccaataaggcgacatgtcgtttctattagttatgtacgagttacatattagttacagcgtaactacaataaaattgtaatcacacaatagttattgttgaaagtttgttttaaagaaaaactatcaaatgttcatatagctacataactatatggtccgcgcgcgttcgtataaaagggtgtttgttttgatgactaaccttagtagtaaaaccaaatcttaggtagggaatatggtccataaatgtggttatagtaaaatgctggccaaacttaggaaaacttaatatgcaataaacgaatctttgacgtgtgtggggcatatacctacaattgaaaagcgatgctaagttacaatcgtggcattgctaatt

SEQ ID NO: 64385 - DNA, 2900 bp, Oryza sativa
taatatggttcccaacattattattattattacacatgtcatccaaagaaaacagaacagacctccgctgtcataaccttttccaataaaagtttcatattaagatacgacacatttattgatttcaaacacaagtctaaaaccatctctacacaatagagagccgctaactagattcttctttattgaagggacatgctgcacgttctttcccgaagtaaacttcagatcgaccgtaccaacaccatgaacagccgcaagcgacccgtttcccatcaacaaggaggaacctctcccgacctgataaaaagaaaacagggaaatatcagaacacacatgaatattagcaccagtatcaacccaccaatcaggtgaatgaaaaacagagagaactgtaggtaaaaaattaccataccccgatgttcctccgccctcgctaataaccatgttggcagacttcttgtccttgcgatcaggacaattcttcgcccaatgcccaggcttaccgcacacaaagcagtcgcccttggcctttcccttgcctttcttcttaaaattggttgtagcctttggtttgacatcaggcttgactttcttgttgttgttgttgtgggatgcatgagggttcttcttttgcaccaaattggcactagaacctccctcgatatttttgccccggttgtcctttactctcgccttctcctcaacacccaaagagccaatgagatcagtaacgctgaactcttgcctcttgtgttttagagaagtagcaaagtccgaccaagaaggtggcaatttggcaataatgccacccgccacaaacttgtccggcaactcacagttgttgttctcaaattcctttgccagcatctaaatctcatgagcctgttccactacagaacgatcatcgaccatcttgtagtcatagaactgctccatgacatacagctcgctgacggcgtcggaaactccgaacttggcctcaagtgcatcccacatgtccttccctgaaggcatgtgcatgtacacgtccactatattgtcagtgagtacactgatcaatgctccacggaacaggcaatccgaagcctcaaacttagcctcctccttaggagagagaggcggttcacttcgtttgccctgtgaaacatagaagcattgcatcgctgtcaaccacagtagtgcacgtgctttccatcttttataattagaaccatcaaaagcatgtggtttcagtgttgcagcaaagccaactaccgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcatccgctggagtttgaggcagtattgcctccgttggtgttgacgggagcctccttctccttgtatccagtgttgccattgtctccagtgttcgacatattggtgaaggtgaagtagatgttgatgaacagtgagtagtcgcgccttgcgctccccaaaaacctgatcgcccgcccgtccgtgcaaacgtcgcagcagcgcgtggtttcggaggcctactctcccaacgtgtgtgcacacacttgtcgggatgggattaccgtagcagcaacagcgttagaaaatggatgaaagtgtgtctcactattctcgtgggaaatcaaatccattctcattttataagaggaatggaagatgaagagtaagagtcatggaataggaagaagaatagagcaactaattgtcatcaactagccatgaaccatcctccactacaccaccatcaaccaacaatcaattaggagtaattgatgtaagttaccaatggaataggaagaggaatagagcaactaattgtcatcaactagccatcaaccatcctccactacacaaccatcaaccaacaatcaattaggactaattgatataagttaccaattccctaatcaaatggattaattctcaaaactcttcatcccattgatatcccataaaagaatgaatacacatgaattcctagcataatgagccttggaatttatttgatttaattgatttaaatggatcaattacccaattaaatctaacactctccactattgctgctgcttccacaccttgctgtgcttgcggctcgtgtagagcgacacgacgatagcgcaacgacggccacaacgacgaagagagacgtggtctagtctcctccttctcccgccaatcgcctcctcctcccactaggctcgctggaactccacctcgtggctagcatcgggcggcagctgaatggcggcaacggctcctgacgccgcctccccctccctctcccgcgtatgcctctctccccttgtcccgttgggcgcctccccttacctcccaagcttcggaagaaaagagcagaaagaaaaggatgctgacacgcgagcctcacattttttcttctcattgacatgtgggtcccataattttttttatttttctttgctgactaggatgctatgtcagcgaaaccaaagatctatactacatccggaccttttttgcacggtttgtataggggtggagatttctggtattagagatcagagactttagatagactctataggccgagatagaactatataagatgccgcatttatgcccaccatataagttatgtattttgtggcctaaataggcccatcatagctcaaaccgtaacaaagaacaccagatcatcgat

SEQ ID NO: 64386 - DNA, 7148 bp, Oryza sativa
ccaccattccaggtgctgttctgataatagctattgctagttccatatcctggagcagtctgatgaccaccagcattgtaatatgtgttacttgtgggaccaacgtaagactctgaattctgaaatgaagtaagaggctgatgagctgcacctgaatgttgatttgttcctccttgctggacagaagaaccatttgtagtttgtgggtaactataataatagtttgcatattctgcagcagtgtacccatgttgaagtgaacttgagtaaggcatgtgagaatgagtcgcattttctgtgcccatagttggctgagcattatgaggtgcactgcttgccacactctgattgtctcccgaaaccgaaacatccctttgtggatcatagtaaactgtatcttggctttgattgttcactggatagctccacgggactgtagctgccccagttgaagaggaccatgaatgatgccctaaagctaaaggtggataagtagatggatttgtctgccccacaatgctgacctgccattagcaaataaaggggtcatgaactcatgatcatttatataatggcataatgcacatagcaacttagttacaaaagccatgaccaaaagattcatcctcactgcagctttaaccatttcagtaattcattggcaaaatgctttaagtcagtactatattgcaactagaatgattcgtacaactaggcttccatacaaccatagattctcagaattaacatgtagttctacgcatagcaaagacgttcaaatccgatcaaacttctgctctaatttttctttgcaaaaattcaacgaagccaccttgcatgaatagtttagttcccttggctaaattttacttctaccaatcacccacatcctcaaattagcttaagtttggtacagtaattagcataatatcaaattcgttgcatcctaaatagacactaaataaacgatcacatattcaaaaaaaaaacaaattcaaaaatcaatagaacatcagacgaggcgcgtcatctacctcggcaggagcggcatcggatccagcagccaccaccccggcgccgtggctcgccatcattcctccccctcccggagctccaaccctagcgaaccggtcaaccgcccgccgccacgccaacgcaacgcaacgcacaaccgaaccgagctagcgacctcgattcgtcgagagcgaggcgagaagccgatcgatcggggggagagcagccgcacgcgaacgaatcgaaacccttaggcaaaggcgcggtggattcagggaggattggaatcgcgcgtgaggtttttttttttgtgtgtgtgtgtgtgggaagatgcgggaagcgagaggagaggcggagatgttgccagctacggaaaggaggacgattttttttcgcctttttgattcctttttttaccgcgtcgcgtcgctttgcggtttggtcgggtggtgtcgtcactagtgaggaggaggcggcggaggagagagaaggggacggtgagatgcgttcatgggccgttagatttgagcccatgggccataaatgattggtgggcccagcccatttggacccaacttctccacaaaaaaaaacggctgttctttttgtttatgttttgaagctattccattaatctctgccactaatgttgatatgatttcaagtgaattcctgtgactctgagcaatgctatgccattttcagaaattgccattgagagtgatgtgcaagagccaactgccaagtgcagcgtcagtgcgtcacactcactcactgttgttaaaattttcctgcggaggtctgttgaaactaaagctcagatgaaatttcctgaaactatccggatttcaggctaattcaactgctagaaccaactgaaacaaaagcacaaatgaatttgctgaaggaatacaaatgcaactgcagtaacagaaatatacaaacaaaagcacagatgaatttgctgaaggaacccaaaggctactgcagtaacagaaatatgaagtccgaaatattaaacgaattggatctatcgtcaaattaaagcgactcagacaccgtttgacattatgcaaattcgctgttcttattcttggtcaacgatggtcaaatcaatactactccctccattccaaattgatctacatataatttttttgaggttattcctaaatgatctacatatttgtgttcattcattaggtctattcgttatttgtgcattggagtaaatagacattgatacatgcatccatgcacacaagcatttataacccacatgcaatattttaatttgctattggctagaaaatagtggggatggtgcatgcattgagtttattgctagagtaaatatagaatgagagagttattagctttttttttgtcttggtgtacctatggaatatgtagattaatttggaatggggggagtatatcgaactgcaatgtagctagatatcaaccacttgttggaattaatgaatgggccttagcccactcgaaaattaattctttggaaaatcacaaaagcccgcctcatgggatggcatgcatgtggagtttagtaccacattgcttattctaggagatggggacctccttaaaagggaggatgccctcctagctacttgaagcatgtgtggtggagagaagagaggagaacacacgcgcgtgctcgctcgcctcgcctgacagggcagggcaggcggcgcgcgtgcacgacgtacgcgtcgaatggtccgccaaaattggttcctcaccttgcgctccttttgcagttttgttttgctgcaaattcggattcgtttttgttttggaaacgttccgaaaaatctggtgcatgcaaacggcgtggagtccggataagttacgcgtggagtgaagatcgtgcgggcgccctgatcaagcgacccttctctatataaaccgacccgccgtcttctcgcaacacacgtgttttgccgtaaattcggattcgtttttgttttggaaacgttccgaaaaatccggtgcgtgcaaacggcgtggagtccgaataagttacgcgtggagtgaagatcgtgcgggcgccctaatcaagcaacccttctctatataaaccgacccgccgtcttcacgcaacacacgcgaaatcaatctagggtttgcctcctactctgtactacaccgtcgctcgtagactactccatcccgctcgccggcgtgcaccggcgattgggagacgtggagtccggataagttacgcgtggagtgaagatcgtgcgggcgccctgatcaagcgactcttctctatataaaccgacccgccgtcttcacgcaacacacgcgttttgctgcaaattcggattcatttttgttttggaaacgttccgaaaaatccggtgcgtgcaaacggcgtggagtccggataagttacgcgtggagtgaagatcatgcgggcgccctgatcaagcgactcttctctatataaaccgactcgccgtcttcacgcaacacacgcgaaatcaatctagggtttgcctcctactctatactgcgccgtcgctcatagactactccatcccgctcgccagcgtgcaccggcgattgggagagcaggtctccggaacctctgccttcgacgtcctgcaccgggagaaggcggcaataaggtttttgggaagcgtttcgcgcgactgctccctgttcgttcgcgacggctcgccttcctcttcgctcacgtgcttcgtgccttcgtagacgcctgcgaaaagtttcgaccgagcagccggtctttccaccacctcggtacgtgttcaatatgttgcgtatatttgatctgttcatgttatactgtatagtttccatgtgtagatctaatgatgcgttcatgctaattttcatctataatgtcatgatttatttatggaataaattaaatcattatatgcctataatctcaacaccactaacctatatcaacctcaccctaaataacccaattcgctttaccccaaaccccaaaggcctattaaaatattcgtgccaccaccagggaccaaccaccaatttgcacattcaacaaaaggacagatccataacattggccctgaaacatgtttcaattcaaatcccaggtgcaaacatcatctgcttcacagtttcatgattcaggtaaaccctacaaaactaaacggcgaactgaacaaggtggattccacggccagacaacatgggagagatgggggatggaggcacgatcgatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagcccggagatgcgcttcacgccgcccctcctcgccagcctccggatcgccggcttggtgatcccctggatgttgtcgcggagcaccttccggtgacgcttggcgccgcccttgccgagccccttgcctcccttgccgcgccccgacatggccgccgacgacgacgattccggtggctcgccgcacgagagagagagagagagagagaggaacgagaggaaatggaggaggagaagaagcggtggtgattggagtgggatttgggggaagaaaggggagggggttttaaaaggggacgagaggatggagtggggaggtggctgccgttggatgggtagggagtggacggttgggatctggatggcgagaggagacgcgaatcgctgacgtggcgtgaggcgcggatcggtgatttggcgggacaggtgcgaaatttcgtacgggaggcgccagttttatttttcaggctgccgcgtggcgcggtatttggagtttcgaagtttgcaccggaaggccatttttggcacagctctagcttcagcccagtcaaacagtttcagctccaccaaaactgggagtggagctgggtgaagctctctcacaaaataaactagagttgtggactccactccaaatccacctcctggagttaaatttaggagtttgagctgtaccaaacaggcccgaaatttcgtactccctccgtatactccaccgacttggatcaaagtcaaattgctttaagtttaacaaagtttataaaaaaagagtaacattttcaatccaagacaaatttattatgaaaatatatttaattattgatttgattaaattaatttagtattataaacattcctatatttatctataaacttagtcaaacttgaagcagttttactttgaccaaaatcaaaatgtcttataacctgaagtaaccatttatatccctttagaattcatcccaaaatataacaatttttccacctattttttcttaactaatcataatattttaccatttaaattcttcacctattttctcttttcaagcaaacacgttcatctcgtatttaattacacctactttcttaatactcctgtctaattctaaaaagatgaaccagtcgtaattatagctcattttcaaaatgtacgatgtcgttaattttttgcacaatatatgaccattcgttttattcaaaaatttaatataaatatgtaaaaagtataagttaagattatttttttaattgatattaaaacaagtcggaacaaaataaatgatatccatataatttttttagtacaaatggttaaaatttatgaaaaagtcaatggcgtcatacattttaaaatggatgaagtacatgaaaaaaaaaggtgttgtgttgttttactcaacaaagtaactttctgttcagttgagggttaagataaagaatattttcccactgcgaggaaaaagataaaagatatttgctctcttgccacaattcacatttcacctggctacttatataagcaagatatattttactcgtggaatgacagttgatttagggttctttcagtttggagggaaatcgattacttagaattaattactattagtgtcattcggttcataataatgtaggtataggaaagctaaaggaaaatttcctttggtacgagttgtaatgagaaaacatagaaaaaaatttatccacacaaacatcttggaaaatttctatgaattgaagtgtgtatgtatttatattcctccattcttcctatttatatgtgtttaaattcctccaaaacaaacaagcccttataaagaaatctcgaaatgcttgttcactttctaggagtacagtgcaagttaatttcgtgcaagcccatctctgcacacatacgagctatgcgaccgtatagatccctaaaattaggggcccaaaatatgtgtttcaatttaaatcaaaatattccgatatatttaggattgtgtattcctttttttttcaaatttatctatttctctccactaaataggattaaccgagttgtttttctcaactccggtaagtgttcaataataatcatgggctacatcaaaggaaagaactatatttagcgacgacgatatgaacgtgcgttctaattctaaacaataacgattccattttttcatggaaaaagtacgaattaccccctgaaccataaaaccggacattcttcacccccaactaggcaaaccggacgaattacccccctcgactgaatccgcaggtggttttggtctacgtggcgtacacgtggcagtccagtcagcaatttttttttaaaaaaattgggggaccctcctgtcagtgtcatacctctccttcctctctctatcttcactctctctctctctctcacgggcatcacaagggccaaaggtgggcggtggcgtgagggcggtggatggaggcgcgcaggggcgggcggcgagcggcggcgcggggacgtgcggcgctggcggaggctgactagctactgatttctaggcgaggtcggcgccgccgaggacgagcggcacgccggcgaccgcggaggcgagggcggtgacagggcgactgcagtgggcggggccatgccgcctcccgatcgcccgccacgctagcctcgcccacccagctgcgccgccccctcgtgctgccgtccacggccatccccgcgcgccccacagcgtgcgacgggc

SEQ ID NO: 64387 - DNA, 4791 bp, Oryza sativa
gaggaagaagtgaatgagagtgaggatgatatgtgggtcccacaatactttttttttgtgtgaatgacaaatggatcccacattttttttattctaatgccacgtaagcgccatgtaggacaaagacttagtcaagaccgtcacgtaggcgccgcgtcagccaaaaccaccgagggatattgtttacaccggttttaatagttgaaggagttgatatacctggttttatgtttggaggatatgaatcgtactcggacgatagttaagggagcaagtatactttttcctcgcggaaatatcggatactagccgaacgttttgcgtgccgggtgtcggagatgaaaactccgaccccaaaacgctaacgtggtctcactgttcgagcgagatcagcgccgtggatgcccgtatatgctcttcgtttttttgcgattaccccgtatgctctttcgattatcttgcatatcgtgcccttcgtacgaagagagaggccattagttcatcatcaatcatgcatcagatagagctacggtgattaagtttcttttcccttgcgaatgtagtactaccaagtcacgctctgagttttttcccctccaacggcttgatcagcctacagtgcaagtaacgaaagagcagataaaacaatcatgaactgaaatgttacagggtatacggttgtacatttaggactgtagttggtcagacaaggaagaacacagggaggagatcaggacacagggaagaaaggatcagatatttgcagcgtttgttatatagttatcgttggttaggacaactttcttcgcatagtgttttgtcattcgatgagaaattacagttttacagcgttccagataatctgccttggaacaaggttcagtatacccttcgtatatagaaatcatcaaaccaaagttcctgttgcacacggtactagcaccggcattgcacggagcagtatttttggttgcatctgctactgctagttctttcagtatccgagtagttacttctctcctctcatagtctcattagacgagggaaacgtgatttacacatactcacaaacacatgaaaaataaaaatgattgacgacgttggatctagcatcacatgaaaaataaaaaaaatattttttctttgatgggaattctatacgattagcatgcaaacagccaaacagtaacttacacattgttagggcctctttgatttgaagaaaaaacatagaatttttagaggatttgaaccatatagaaaaatttcctatgaaaccctttaaaataaaagattgaatcctatcatatcctttaaaattcctatggaatggacaatcctataggaattttgaaggaaatttagcaagagctccaacctcttgaaaacattcctttgagtctatctctctcatccgattcctgcgtttttcctgcggttcaatcaaacggtcattactgtgttttttctgcgttttgcaatcctctgttttgcatttatatttctgtcagaatcctacgtttttcctattcctccattttttcattcctaatattcaaatgacccttaattcacccggcaatcaatcggattagaaaaaaaacaagcaaaataaagagaaccgtcatagagcagtccgcaacgccgcaatgctcgcccgtacgccgctccgcctgcccatgccgctacacgccgctgcgcctgcccatgccgctccatcgccccaaccgcacgcccgccgtatgacgagtcggatccggcggtgccgagctcgtagccgctggatccggcgttttgcgagggccaaagagcagcgagagagagagttggaaggcggtggtcgtcggtgaggaagagtagcggcgaccggcgtggaaagtggaggcggcggccgacgacgagaagaggagtggaggcaatccatccctcatccccaagccctcccttcaggccggaccttcgtccccatcgtcccggtgatgtgaagggaggggaaagcagcaaccgtcgttgcgcaacggcggcgacgacggcgacgacgctcgtgaggcaccgaccgagcgagcaaatgaggagtgggaaggtgacgggatgctcgaccccctctcgtcacgctgcacccactggagggcgcgggtgcgagccaggttcggtgcaggtaacgtaacccaaacacgcccttatccgcgcgcctcatcgcctcgccaagacgccaaccaaacacacaccccttatccgcgccccgcccgcccaggaaatcccgcgcggccaatcacagcacgcccgcccgtgatcgcgagatccgacgccccacccgtgatcgcgatcccactcccctccacccgcgcgggtacccccccacgtcgcctactcgcctcgtctccccgtcatcgccaacgtgtcgcggctttccgccaccaaatcgatacggaacccggcgcgcatccggtcctctcgtcgaggcgagaggaacctatacattcgccacactcccctgcttcgcttgcttgccctcctcttgcgtagggaaaaggaagaacacaagagcaagcgagagcccagaaatcctatcctcgactggaggtttttgtgtattgtatagtggtagatttttttactgacttgggagttgtgtgatagtgtgggttgcgttctttttttagtgtgtaaacgatgtcgtctttagtgtcgacgccgttcacgacggcaaccggggtgcagaagaagctgggggcgcccgtgccgctccactcgttcttgctgagccggcggcagccagcggcgggcgcggggaggggacgcgcggcggcggcggcgatacggtgcgcggtggccgggaacgggctgttcacgcagaccaagccggaggtgcggcgcgtggtgccgcccgagggcgacgcgtcgcggcgcggggtgccgcgggtgaaggtggtgtacgtcgtgctggaggcgcagtaccagtcgtcggtgacggcggcggtgcgggagctcaacgccgacccgcgccgcgcggcggggttcgaggtggtgggctacctcgtggaggagctccgggacgaggagacgtacaagaccttctgcgccgacctcgccgacgccaatgtgttcatcggctcgctcatcttcgtggaggagctcgcgctcaaggtgaaggatgccgtcgagaaggagcgcgaccggatggacgccgtgctcgtcttcccgtcgatgccggaggtcatgcgcctcaacaagctcggctccttcagcatgtcccagctcggccagtccaagagcccattcttccagctcttcaagcgcaagaagaactccggtggcttcgccgatagcatgctcaagctggtgcgcacgctgcccaaggtgctcaagtacttgccctccgacaaggcgcaggacgcccggctgtacatcctcagcctccagttctggctcggaggctcgccggacaacctccagaatttcctcaagatgatcgccgtctcctacgtgccggcgctcaagggcgccgacatcaagtacgacgaccccgtcctcttcctcgacgctggtatctggcacccgctggcgcccaccatgtacgacgacgtcaaggagtacctcaactggtacggcacccgccgcgacaccaacgacaagctcaaggaccccaacgcgccggtgatcggcctcgttttgcagaggagccacattgtcaccggagacgacggtcactacgtcgccgtgatcatggagctggaggccaagggtgccaaggtcataccgatcttcgccggcgggctggacttctcgggacccacgcagcggtacctcgtcgacccgatcaccggaaagccgttcgtgaacgcggtggtgtcgctcaccgggttcgcgctcgtcggagggccagcgaggcaggaccatcccaaggcgatcgccgcgctgcagaagctcgacgtgccgtacatcgtggcactgccgctcgtgttccagacgacagaggagtggctgaacagcacattgggcctgcacccgattcaggtggcgctgcaggttgcgctcccggagcttgacggtggcatggagcccattgtgttcgccggccgtgaccccagaacaggcaaggacatttccagattccttttggtctcactcacctacttcgcaggtaatcctgtacttgtagctgagcctgaaactgttttttcctctgtttgatgcagggaagtcacatgcgttgcacaagagggtggagcagctctgcactagagcaatcagatgggcagagctgaagaggaaaactaaggtacgcaattccacacagttcctgtataaattgtagtacccgtatagaattgcattgtttctgcctgagagcaaaggcaaccacaaacgtcacatctggatagttctgaattcactttcatatcttcttgaggtttttgagggatttaagattgcatgctaaacaaacatattagcttaacaacttcactgtcatgctcaaaactggtattgcacatgcgccattcatcccatgaagagctcttgtacatttgatgccgcaatcctgatgtgaaaattccagtaatgcataccatcacatgatattaagttcaatgaaaagccacgtgttatgcaatcattagctgccaactgaaagttatccttcaaatgaaacaatacatcatgtgagaacaaaaggctcaatacttaaggtgcataaagtatgttcaactgagaactagaactactcgtataatcgatcaatcaactcttccatcctctgaagaactcatgtacataacggtgcca

SEQ ID NO: 64388 - DNA, 6151 bp, Oryza sativa
cctcccagacggcggacgccacccgggacaagctcggcgagtacaaggactacaccgccgacaaggcccgcgagaccaacgacagcgtcgcgcggaagacgaacgagacggcggacgcctcccgtgacaagctcggcgagtacaaggactacaccgccgacaagacccgggagaccaaggacgccgtggcgcaaaaggcgagcgacgcctccgaggcgaccaagaacaagctgggcgagtacaaggacgcgctggccaggaagacgcgcgacgccaaggacaccaccgcgcagaaggcgacggagttcaaggacggcgtgaaggcgacggcgcaggagacgagggacgccaccgccgacacggcgaggaaggccaaggacgccaccaaggacaccacccagaccgccgccgacaaggccagggagacggccgccacccacgacgacgccaccgacaagtaaactcgccggaacaccatccgcaagcacgtagtgctcctagctatcgataataatgtccacattttttttgttgatgatgcagggggcaagggcagggcctgctcggggcgctggggaacgtgacgggggcgatcaaggagaagctgacggtgagcccggcggcgacgcaggagcatctgggcggcggcgaggagcgcgcggtgaaggagcgcgcggcggaaaaggcggcgtcggtgtacttcgaggagaaggaccggctgacgagggagcgcgcggcggagcgggtggacaagtgcgtggagaagtgcgtcgaggggtgccccgacgccacctgcgcccaccgccacggcaagatgtgatcccccatgagcgcggtggacgactaataaaaaaaactcccagcatgttaacctttgtgtttcaagtttcactagctgcttttattttgctttcgttaagtttccactaccgtgtatgttccttctggtaatctaagtgcagtggtgctgaaatctttataaagcccttcagtttaccgcttaccacttttgcttcaaatgtctcgtgtggtttagtgtgcatgttcgttcttttctctggttctggatttgggatattatcgtgggcacgtttccaaatctctatatatgagcctcccagaatgcttttctaaagtaaattttcgaatgctagataatcctgaaaatctcatgagaatctttttttggcgagggagtgctcgtttaagttcgccaatcgccaccgatcggcgcggctcgtagagaacggatagagaagtcgtgggctcttggacttgtggtggtgaactgtcgtctggtgatgcatcctctgccgcacaaaccaacgtgaaaataagacaatcgctgatggcctgatgcccccgagtgaaacgtgattgagctcagcatctctctcaattcgtccatccgaatcgatgctgctgctgccggcataatgcgaaggagcgagatagccagtttagccacgcaccagaataccagacggttcgaagtgagaaaatccgagcaaagtaggactcacatccgtttccgtttacgtttataatgttcccattggatattataagtcatttgatttgattttttttctcggttagtttgatcaaatttataaaacaatatacttatattttttttataaaaacaaacatattatcaaaataatatatttaatattaaatttaatgaaactatctctactattataaaaattaaaaatgtttttgccaatggctcggtaagtcttcgtgtcccgaatctgcctcgcacataatcactatcagtttaactatttatgtgtctctaatccgtatctgattttcctttttccatcgtgtggtcagtccctaacggacttagactcatacacggagccgctctcctcatccgtttccaggcataggggtgtaactacgcatccgtctggaccacctgatccaaacaccctatcacacgagcagcctacctaactaatggcacccgtaatggcacccgtaatagttatctataaactatctacaagagatctatgtcagtatattttcctacttggaagagattaaatggagagaaagagcagagctatctactaacttagagatagtctatagagaaaaacgagacaatgtattagagagctatagatacccatatagacatactattgaagtggtttactattaatctagtctattgttgagatgtacatgttttatagatagcacattactttaccattgtggatgctctaaggctgtgttcttatcttcaagttttcaacccctctctctcattttccgcactaaacggcgtgtttttttaaaaaaagtttctatatgaaagttgcttaaaaaatcaaattaatccatttttgaaaaaatagctaatacttaattaattatgtaataacgcgtgctttgttttgcgtgcccgggagaaggggttcccgaacgcagcctaagcaggcctgatgaacatacataattttaccatctcatatttttctttgcaaagcccccatttctttgtcagctagccttccttgccaactttgcacatgtatatagagtcaacattcacatatctatctctaccattacaaaaattgaaaatgcttttaccagtatttcggtacgtcatccatgtatgagttggttttttaagttcgtttgattttgaaattacacatctgtatttgagtcgggttttaaatttgtacgcttttagaaatacggaaggagctgtataagatatctctttaaaaaaactcgcatgctaacttgagatgattgaactcctgattgtagctcatgattttctagaaagaaatatatccaagcgaattccaatagtgaatttcaccttaactaaactgtataataacaataataagattaaaataattgtcacccgttgcaacacacgggtattttttaaaaaatatatataaagatgaacatgttatcaaaataatatattaaatttggtgtagaagatgttactaattttcctataagcaatgctaaaaagtaactttgattaaaaagaaagttaaacgatttataatatggaacgaagggtgtagcatttaaaaaagaaaaaaaaaacaactttgattcgggacaatgcacaaacagtagtacatactacatagtgtgatcaacttgatgcttattattgccttgaaaggcgagtcataagttacagaaaatgaacactatgtacacaggcctgaatttttctcttgaacaaggaaaagataaatatgcactcagatggtcagacaacaaaaggccccgccaacataaatcagttgcagatccggataacttttttcacttgaatgccacatacagtcccttacttatttggattatttgtccagcattgtgtaagacggcaggtcattcacctccaatacatcctctagtactagttcacgctccaactgagttcttgtagatttcaatacctcctggcaccacgaaaacgaacagataagcatgccattgattaaaacatacacacagtaactgcataatatgcacctactcgggcttacattgaactccatgtaagaagcacgtttcacaagccactgagcatcgagaagccgaaaggctatgcagtagaggtgatcaaatgcattctcatctcgtccaagcagttcaacaaaacgaactcctgactttgaagatggaacacctgcacagttcgaagagcgttaaaccaggggaatgggaaccacaccaaccattatagtgtaaagacgatttttggaaactgagatattacttgactgtagatccagcatttggatcagcataaatgaaatgttgatcccagcaaccgcaaaagggtactcccagtctgctctctgcccttgtactttgttcagaagcgcctgaaaggaaccctgtaccagaataggtgagtaattatacaaaaacaaacagcattaacaaatcttctcagaatatcatatagaaggtatttacaggatagttcctagcgaaaaatatgaggttctccaatgatatgaatcctccacccctgcgtggacaatatcagcattagatggctttgtaactgaattcgactggagcagaaaatggaataaatggaatacctgaagtcagttgatggatcagtgccttgccaacccatctccttccatagttctgatttcagtggaggaatgtcacggttggggtatgctaacctccaaagttgtctcaaagcatcctaatagcaacaatgcaaaattacttgcttgaataagagggtcacttgtggccacattatagccaggcctaagctattgaaataggtttacatacttggtgttcaacacgggagccatcgaaagggatttgcaatctagaccttaaagtattcagtctatcttcctgaaagaaaattgtatacattaaggttcagaattacatcaattcctgtgtgtctattataccttttctcaatacattacctgcaaaggactaagatacactggactgctgttctggttgtccaacgaaaagggaaacaatctaccaaatagtgatccagagccaacaataatatttgctgcacgtagaacagcaaaggggaatcagtatcttattcttgaaagcactaagggttacatctgtgaaatagttgcaacacggcacaacaataccacttgtagtgaatcagagaaaaaaaattaaggcatgggtttacagaatggaaaaaatactacttccactgctacgatttcttatgcaagtgaacattgctacatcaacaatttatttgcatgatttcaaaaaatgaaacagggtcaatgatatgacacggacatccaaattagcaaacttacttcacaacagttattctgtttagtcaagtttactaacccacaagaatgtttttgcagttcttatgaaaatgatgacatcagcaaatgaagataaggtactaaaggctccataagagaactaagacatgatgacagctgcatccattattcttgaattcgtgctaaagcagcaagccagcaattatataaagtatggcatgggcagacacaaaaacagaactatacctgtgtgcattagatcagcccgacaacctgactaccattctaccaatggttactcatcaccaatttttttttaaaaaaataatgcttgtatgagacaaaatcataaacatactgtgtatgagaaatataggcacattaacctagaatatcaactctgaaagatggtgtcaatgggtagcttactgaggttataatcagtaaggattatctgtaactcattacatgtgctccaaaattagaaaaccaggaaacagaaatgaacaatgacaggattggcagccaactagtgtcaagtgggacaaaacttattcaaagttgcaaattgcaagtgaacagtacctaaccattgtgcccattgcgcaatcaaatttgagaaaagaaatgaccagtgtagctgttccttctttctatcatcatcccataagtcttgccttctgggatcatataccttcagatggcggaaaattctgtcaataccttagaaaaggatatactacagttgtgttcgtccgaaaaggtagtagcaatggtaaataaaactatgataagaaaggcctgacctctgatccaccagtatcagagctagatttccctagtaaaggttcattaagggaatctacgctggatatgtcaacatgctcattcttccttccatcgacatctccatgatggagtcgcctccttagattggtcattgacatgaagtacttgtaatctaaacaaacaaaacggcacacaaacaaaaacgtagaagaatcgtcaatgtaataacaagtgaactattgtgtgttatctaacaaaacaaacatctcacaaatggaagacagtgttatgaatgttctactattaatcacattatatattcatgtctcatgtgtaagccaccaaccagaagcctcataggctcacagcaagtaatttagattgccaattttatcctcctgcagagaactagacaaccacagattctcttcgaggtgaacagtccatccaatttcgatctaccactctacagaacctttgcaaactccaatttttcagaagtttccatatgccccccc

SEQ ID NO: 64389 - DNA, 2530 bp, Oryza sativa
cgtaattgcaccaactcatgaagaagcactcatggttctaacaccacacagtaataagaagaggttctctcagctatgagccaaggacactctctctctatatataaaatagtatactctttcaatttttttacactagacctcatttattttaatgtacaattattgctagagctacctattctaaacagatgcaaaataatttcatataacctctcgccacccaccggcgatcactttccccaaatcatgggttcttcgtccctactctccatgttgtcgatggaattgtcgctatggatccaagcctcctcctctccctcccccttaccatggtgacaccattgcccaagtctttcttagctgcagtaacgacgataaagtcctccacggccggtatggcgacttcccaagtcctctacgacaacatattggtggtggcttgatttgcttaaacaatagatctactcgctagagtccttcactagtatgatctgctccatgatggttgttctcgtccgcggcgatagtcagacttgtctggctatgccatcaccttcctcattgggtgctagatctccgtgtgccacccatcttttctccgtcacctctccttttgaccctctaaactaccaaatctcttcgtggaccatctactctcacttgaaaccattttttgggcctgtttggctggagctcagccaaacagtttcagctccaccaaaactgggagtggagttgggtggagctctctcacaaaatatactagagttgtgaagctgggtctagacagctctacaactccactccagactcaactcctggagcaatatttaggagttggagctgtaccgaccaggccctttctctacgaggctaggcatggctccacccaagatgatggctctaccttcaacgtggaaaggcgaggacactcgcccattcaccatatagagcatgcccttgtgtggatgtcctaaaaagatgggcggagcacctcgcaacactgccaagtggagggagaggcaatgctggcggtggcaaccattggaaggagaggaagataagaaatggggcaaccttataaattggtatgggaatctatgggagcaatcttagtcactcaaaattgatattttaaaaagagtaaacaaacaacaagtagacggcccacgtgtaaccttccttatatatcatactgtgcacggtgcaaggatctcatgcttccaagtaatactagtgcgacttgcttatgataacgagaatgatatagacaaaattaatggtttgatcagcaatttctggcaatggccttcaactacttccagcctgctttaaattggcacggcaaatgttaagccatgatggccgtgctgtcacagtcacaacggagagaagaattgacttgatgatagatcaaaaggcaaaatgctaagctaagaaaatggtttgaaaaataagtgctaaacctgagatttgttttaatgaaaaagaatgctggaccttttgtcttgtatatgcaccaagatgcaggaagtagagaaataaaacacttcttcattatcttgataatataaccatgcaaagatgatcattcgtatgagggatggccaccatagcatgaagtatcgaatctgaacaatgagagaatatatggattgtgccgatgatgtcccactggccaatctgataaacctgcaatagtatgtatatcggtggttaggttagtcataatgcatggccgtgttaagccttaaataaggaacatggctccgtccaaatgagcatcccatatttttcgaccaaaaaatgagagaatctcatgtggccggttggctgtatgggagatctacagtgcagtaagaacattcatggttgcaaccatccaggaaataaatgtgacaccatgcccccatgtggtagcattaggctatgttatagatggtggaaaaattggtagtttagagaaaaagttgatagtttatgtgtgtaggaaagtttttgatgtgatgtcatgaaaagttgagaattttggagaactaaacacggccttaagcccttactctgatcgctatgtgagcatgtttgtagcagaggtgatggatctcccaatagactggtcactttttggtcactgaacgctcaagtgaaatattaactgtttgtgaacaggaacgaatttttcatgttaaatctgtaaatcatcggtggaaataagcagaatgcattctagagcaatttgtcatctcgaagctagtgttaagataaataaacaatatgccctctagtaaaatattctaaaacaatatattaaaaaatagagtacatgctgcaaggaatattattcgtccttaatgttgttatcaaaagatgaccaggtagatactccctccgtcccaatttaagtgcagccatgattttccgtgcccaactttgatcgtccgtcttatttgaaatttttttgaaaaaaatttaaaacgtaagtcacgcgtaaagtactattcatgtcttatcatctcataacaataaa

SEQ ID NO: 64390 - DNA, 7628 bp, Oryza sativa
ccgacgcggaggccgtctcggcggcaccttcctcggtagccacgaccgccgccgtggcggccgacatggcgaagctcccctccatcgtggcggccgacgcgacgaagctcccatccctcgccgccgcctcacctcatatcccgccaccgctccgtgtcgccccttgcgccgcccttcctcactgccgcgctcgcctcgccacagccgctgccgccgccagatgcagacggcgacgcgctggtgcacggggatggcggctgacacggcgaagctcccctccttcctcgccgccgcctcgcctcatcccctgccaccgccgccgccgccgctccgtgtcgccacctgcgccgcccttcctcgctgctgcctcgcctcctccgccgcctgccgccgtggtgccgtgcgcgttcagagagtgagaggagagagagaggaagtgtgagagagagaggagagagagagaggggggaatagtgttataggggtatgacaggtgggtcccacatttttttaataactaaaatgccgtctggactgccacgcgtatgcgacgtagaccaaaaccaccgcggattggatcgagggggtaattcgtccggtttgcatagttcggggtaaagaatatccggttttatggttcaggggtgtaattcggacgaccgtgatagttagggaggggtaatccgtactttttccttttttcatttagttagaaaaactaaattgctacaatgatttttcagttgtttggtcgaatcaccatatatatgtaggtgggcggcggaccaagcggttatgattgccgtgaccagtgaggcgtcctccccgcagctctctggtgggtgcggcctccgttcgtctgagtgacgatggcacaatggtggggtgacaagggcttagtgtctcggcagctgtggttgccctcctcggtggagtagaagagccttgcacgtcccagtgtggatctgcaacggaaaccaaatgagccagtggtcaccggagaggaggaagaagctcaatctagactggtgcattttttttcgatgtttcaaccaatgtatctttgatgtttctttgggttggatcgaaatgttgcattggatagtttgatattgtttcatcgatctgtgcatatcccttgatattttaacggttgaagcttgatgttttgtttgttggatcgaattgtttcaatcatgattcacctatgtttcagcatttaatagattgaaacattttttttatttaacggtgaaacattgttcgactaagagtgacaagacacttgatttttgatgaaaaatcagatgcccgatttgtagtctcctccacaggactcttctctaaagtcaagactatatgtgaaaagagtactttgtgaacaagcacacgcacgtccgcctcatcgtttcgcttattcgaataataatttatgaataagacttttatatacgtgttcttagcaatctaaaagcaaagactgaaaaataaacttcgatataaaaaaacccaaaatcaactccaaatttaagattgaaattttaatttttgggtgataagcataagcataagcgaaaagataaggccgatcaatcacgcaaaataaccccccatgttaattttcgagttttcttctccaaaaaatcttctgcattccctttcttagttactgattttgtgctttagttttaaacacatgatgatctcatcaagagtatatttcatgacatgcacctatatgagatatgtagaacacatttttctctgacttttgcatgttttgaatctactttccactttttggctagtttaagccaataagcccaatagaaagtttacacattatttttcttttatgaaattattatttttattttgcttgaaaattttccacataaagtttctctgtcgaaagtttacaggtagaaagttcacatatgtaaaatttctatatataaagtttttaggaataaatgtctatatttggccaccgagacacgtatgtgggctaggggcctctaatcaggaaaggaaaaaaagtttaaatgggttaagaacaagtggggccatttgcattgaacccgtggactttgagatagatgggctcgacaatctggatgaaacttttcccaaaaattaacaattatttggttatgttgctcaacttgagaacatcagcaagcagcaaaggtcgaattcaacatgaataaattggttttcaactaaattgtttgtttcaatttgaatttcaaataaatggtacatatgtcactcttaacgaccaaatttggtaatatcagtatcggagatgaagattagattgaagcggggtcgaagatgaagattgtcgcggaaacagagtaaaaatcggctgaagtccggatcggctacgattggatcggctgagttggagtcagatttggttaggtgatgcagccgattccaacaatacgacttggtgtacgacatcgggttgggttgaggtgcttcaagataattgccacgcatggatagagtcctgggaaggcaattgtatctattagttaggatattttatgtaatttccttatagatatgcttgggcaaaagtctgccgtaaagacttgtggtatcttagagtttgttagagataatagtcgtgtccggtatggacatatcttgtaattctcgggtataaatagaccccgagccctatgtaattaaaaacacacacacgttcaatacaatttcggcgcatcgccacctttttgctttagttttatttcgacgagttcttactttcgggttgagctgtatcgtttcgatcttcaacaagaggtaaaacttgttatgatggcttgtgttatcgggattagtgcttccatctttatgatactctaatcttgtttacgtaattcgtcgagttatcatatatcgtacataatctctggcaatatcactatctaacctacaatcggctaacatctgctagtagagggcagccgattaggttagattttgatgttgatttagattatataagatatccaccactctatgaaacttccagcggcttgattgtctagatattgttcttcttttcatacttaatgctgcatcagttgagtttgatctattaagtcgtgtttagaatatcaatctctagcctgccttctggttgccgattagggtagtatcggagtttcagccgatcttatctgatttaaccatattcgctctatatgcttcagtgacatgttaaatccgccctttatgtcaagatcttattgcatttaagtatattaagcttttgtttgatatattatacttgttttaatatcctgatatagagtagtatcgaagtattagccgatacatgctagatctatatgatcggctatgctataaacatatatagtcctgttattaatatatatttcgatccaagtgatttatattgtcttggcatggcgaccgatctatcccaatcacttgatttaaatatatatcgatataagaactatatattggtaatatctacagccgatcgagtaggtttaagtctttattatctatttatagtcgccgatcgattcacatatgacatcggctcaaagataaatgatatgtcatcgacacttagccgatcggctatcatttatagatttaaccgcgatctctctgtttctatttcttgttgattgcaggatcaattcaattggcacgctaacacacccgaaggcgagctttgaacctgtactctcccaggcctcgtgtttgacgtcaacagtcgcggtaaacaaaatgatggtaatcctgttgctcatactactatcgtactaactgaatagagacattccatttttgcaatagagaagcgaccatggacattgaagctatcggggaacgaggagggaacaagcccgatcaaccgccgaagtcatagatggtgcggccctgaagcttgagcgcatatacgacatccatggccatgacagtcttgcggtgagcatgctcggtgtaggtaatggcatcgcagatgacattcttgaggaagatctcgagcacgccacgagtctctttgtagatcaaccctgagatgcgcttcacgccacccttccttgcaaggcgtcggatcaccggcttggcgatgccttggatgtagccgcgaaagacaatccgatggcgcctagcaccacttgtaccgcgcccagaaatggctaccgactagtggagcgcgagaagtgctagtggaattggaagagaagtggcactggtggtggtgcccagagtgagatttcaaagagagacgacgaggggttttatagaggataaaggtaggagtcaggcgatatttgccgttagatgtgaagaaaatgggcggatgggatcaggattacgggagaggtgccacagatcgctgatgtggcatgagatttggatttttttacttggcgggatagatgtaaaatttcatacacgaggcgccatttttattttccgacagtggtgcatggttttttccaatttggagtttgattgggggtcgagataaaaggaataattaaattcttggtacaaaagccacatttcacctagttttgaaagtaaattctattttacatcttcaactataggccaagttcatcatctaaagaagctataggctgagttttaaagttgctcttgagtgcaagcgaaccgacccatgaacccatatatttgtaatctataagtgggttgctcatttatttgtactgtaagtgagttacccacttataagtaagtggtacatattagtgggtagcccacttatagtgctatataagtagatttgtggattgtcccgtttgcacccttacttccggctatgtcttcttcgttttttctgcatgaatctcccttcctccggtgatgcagctgaggatttgtattttgttttctacttgaccattgtttcctccacgagtttctgtggtagtttaaggcaagattaatgctagcaatttagtggtcaagttagcatcttatgaacccattacgcatgcaaattcaaaacggctggcaacaaattataagcccaagatttgcacgtgtatagtagatttgcatgtgataaattgggtgtatccaattgatgatcagagtgtacaaagccatacgttttaaaccatttagcatgttcgttattatcacaacaaaaaacatttacttgttgaagccccaccccccaatttacattgtccacggcctctgagaaacgtcaaaaaaaataactcaggtatacaactccttccacatcaaaccatctctggtttaatcacctgatccttcaaattaagcgtttaacatttgatcttcttctcgcttccacaataatatcatttgacaaagtttcccttattattgctcctctgcatcttcttcctcctcttcctccccttcctcttcttcgttgtcgttgtcgtcgtcgtcgtcgtccgaggaagacgacgacgagctatcagagtgatctgattttggtgcaggggaggcagatggagctggggctgggacgctggcagctggtggatccggtggcagtgaggtcaggaagcccagcgtcatgacaacgtcggccatcaacggccgcacggagtcttcctcctgcaagcacatcgcggccatggcgaccacctggttcaatgcctttgctgcgtactcgctcttgatgagtggatccaccagctcgtgatatctcttctggtctttaaacatcggcattgcctgaaaaatatgcaatgcagatcgcaattcacaaagatgccattagcaaactgaatcataatgctattgctataatgctattgcatctttcataatttctttgggagaaatgttgcattatttctgttcaaaatgcaaaggtttttaaattcagatttcggcatgcagaatgcagaatcgatggtatatctgcattgcactattgcatcgaccaaattggctgaaaataactgagctaaacatcacaatttccatggcgaacttacccaggcgaccacgttctgctcctccgtgggcttgtcggggtcgatggctctcctgccggagatgagctgcaccagcacgacgccgaagctgtagacgtcggacttcatggtggcctggccgctgcggtcgtactccggcgcgcagcagccgaacgagcccatcatcggagccggcgcgttgccgcccacctggccgagctgcgcgagcccgaagtcggacagcttcggcgtgagggcgtcgtcgagcaggacgttggacgccttgaagtcgccgtacaccaccggcgggctcgccttctcgtgcaggtactccagcccctgcgctgcgccgtacgccaccttcatcctcgtgcaccagtccatcggcttcttgtccgccggcaaatctgccgacgacgacgatgcaacaataacagaacaatggacaatctcattatcgtcgtcttagagtattcgttcgcgttgcggcgtgtggtgggtgtgcgtaccgaacaagtgttcttccaagttgccggcggacatgaactcgtagacgaggagccgctggtcgccgtcggcgcagtagccgatgatgtcgacgaggttgtcgtggtggagccggctgagcttcgagacctcgtccaggaactcattgttgccttggaagccatgcctgtccagctgcttgatgaccacggtctgatcatgcacaaaaaaacaaagaaaaaacataattagttcttgtttatgcgaagtgatcactgcgctgctcgatgaaatagatgtgagattgttggtgagcacgtacctgcccagtcttctccagttgacccttgtagacccggaagaagccgccttctccgatgaggttgtacggcgtgaagtggtcggtggccgcggcgagctcgcggaacgcgaacgcctgcccggcgatggcgagccccgccgaggcgtcctcggatggcttgggggcctgatctgcatggagagaccgcgcgcgcgcattagccaattggaagccatggtcaatgtgggatcatcgaactagccaagaaatcggatcgaggaagctatcactcaccgggcctgggcggcgtcatgggcgcggccgcgggcgcgggcggcgtcatctgcgacgcgggcgccgcatccgcgtcgtcgaaccgcgccgtgtcggcactcaggctcttcttctttccgccgccgaagcacgggaagcagctcatcttcgcgccccctccctgcctccccgtggcggccaccaccaccacccctgtccgccgccgccgccgccgccgccagccaaagaagaaaaagaaagacgcacggaccgaccaccgaggagcagccgcgccgcgccgatcacacaaccatcgcgcgcgagcccgcccgtctcaccacctccgccgcggcgcgcccacctcgtggcacgccatccgcgcacacacgcacgctgtcgtcctggccccccacgcgcgcacccgatccgcccgcgcgtccgcccgcgggaagagagaagggggcgatcgatcgatcgatcgcgccggggcgcgcgcgcgcgtggagggggggaaggagagggcgatggggggttgggggagatggaaggtgggggaggagggtgggagattgggggag

SEQ ID NO: 64391 - DNA, 2440 bp, Oryza sativa
aattgagacattcaaattttatatataactaaaaaatttaaaacgattggaaaccatacttaggttgtgttggttgggagtgggttgggaatgaatcctcttgtacgtaaaacggaacaactcattattgcaggatcaattaagtattaattaaaaaattctgaaaataaatcaatatgaatttttaaagcgattttcatataatttttttttaaaaaaaacagcatcgtttagcagtggctctgtttctgtggtaagatttagtatagcatttggttacactttataacttccatcctactacccttttcctatgcggttgggtcaactcatttcgggccaaaacccaaggcctcaccgaatgcgttttgccgccatgggatgggaccgtgtcaccacgggtgttcggttcgttcgggtgtgttcttgcttgcagggtctcgagatgtgagaaagaaatcaagaatcttcgtggctaaacacaaagggggcagcagagctgcttaaagagacagaggagaggaatattcaaaggtttttcctttaaatgaaaaaataaagagagaaattccgatagcacacaaaagagatcatactacagtagcaaggaagggtcctagatcggtcagagctttcagcatcttcctcaaaaccacgctttcccagatgctatattctcctcctctctatagagctaagcaacgaaggctagctactagccatggagtttatggtatgtttggagtagcttctggtaactatatcttcttctacaatgtccagctgccatgaactttctcaaacaattcaaatattcactcagattcaaaatctatagttgtagaatataaacaataaactagaagctaaaagtttttattagcttctctaaattttcaccatctaatttctctttagctgcttcacgtaatcttaatttctctttatctgcttcacataattttaagctttccgaaaaagtttctcttctcctcggagtctcccacagcccaaacccagcaacgcgaaatgccaaatgcttcccatctcgcaagctgccaaccctgcagcagtgcagctgcacgtctgcgcggcacaattcggcacagaaatggagctatccgggacagggcctgaccaaccgaacggcattaaacaccatcacttgtagttgtagtacaggagtcggtctctcttccacgcaagagagatttcgatttctcaattcaattcaacaagtaccaaacacacaaacgcgagaacgccgaggaacaaagaggagggattcttttgattggcttctgtcaccggttttgctcatctcctacctatcaccaactaaaacattttcttaggtgcccacagaacagcaatgaacaaactaaacaaacactttggatttgaaattcatagcatacaccgagcaggttactgaatatcttttggtactaacatcatactctaagataatagtctatctatctaggagactaggagagtagttgatgagggatctacaggagcagaagaagaacacccacatcttgtgttcttgcctgcctacccaatttcatcatcatcatcatccattggctgatttgattctacaagaagaaatggaaccgaactagtactacaaagagatgatcaagctgctgctaaacaagtaataacaaaaatcaagattaaaccacaggaaggatgcaaagaagaagagtaatttctaagctaaagctgcttctgcctactcttcacatcaacatctgcacaggggaaacccggaaacctatgtacagttgagtagtacaagcccttgtctgcttcacgctttcatggcgtccgccgccgtgtcaccgtcgtcgtctccgactccggcgaggtcggcgccggcgacgctctcggagagcaccgtctcctcggcgacgacgccggcagcgtccaccacgcagccgtcgcggtggcggtcgcggcagagggtttccacggcgaggaggcggcggcggaggtcgtccatgtcgcgctccatcaggaacagccgctcgcgcagggtcaggttctcctcctccagccgcgcggtgcgggcctcgtcgccgtcgtcgtcgtcttcgtcgtcctcgcagtcgccggccgcgacggggagctgcaccatctcgaagcggctgaggtcgtggtcgaggcggcgctccacctcgacgtgctcctccacgtcgctctcgccggatccggagtcctcgccggggaggccaccggcgtcggcggcctgggagcggaggcggatgaggcccttcatggagccgtacccgtcgacgccccacttctccttggccatctccaccaccacctcgcgcgccggcgacagctgcggcgtcggcagcacggccggcgtgacggggcacggcgacaccagcgacgccacgccccccgcccgcttggcccggat

SEQ ID NO: 64392 - DNA, 45140 bp, Oryza sativa
  unsure (1)..(45140): unsure at all n locations
gccgccttccgctgcttccaccccggctgcctcgccacccgcttccacgccggcctcaccggcttcaccccgacgaacaccaccggcaactccatcaccggcggcggcggcggcggccacatctggtactgcagcggcggctgctgcgccggtggccgcatcatggggtcattcatggatggatttggggactaatcgtccagatccgaaaccctaaccctagattaacacccaaaaaaaacaatccaacaaaaaccacacgattagctccccaaaacgggatcgatcgaagccgtctcgtgttaagctctcttcgaatccgttcgcttcgtgtgtgtttttatgagattaatttacgaattttgttcgatccgatttgggggagaaaagcgaagcgagagaggaagagagagagagagcgaggagagaaggtgtggggtgggaaggggtacgagggtatttattggggaggtgggtaagggatggacggctggattggcggtttcggatacggacggtggagatctcctggcgccggttgcgtgtctcggatggacagcacggattgtaccgccattggacgcctctggttgtgatctggatgcgaactggcggttttctgttttttcttactttcttctcgtccataaaaaaatgtctactgtgagatgaattgcaatgctcatttgttagtaacatagtaggagtatgtgttactacgaaactaatgatattagaactaataatagggtttatcttggataaatcccaccagaaattaatttcgctagcatgactcaatcgggatgtttattaatattaatgttaacataaaaggtttactgatttttgcaggtgctagatttatgtagaaatgtcggtcatatcctactaaaaacttgcataaattttgcttcatatagggagtaagtgcctccaactacaataattgttttctttcagagttataccaataacgaataaaagaagaatgttttccgaagatatgtaaagttatattcggatgtatcaattcttaacttacttcctcgtttttcacatgcgcatttcccaaactgcttacatggcgcttttttatgaaaaaaagttctatagggaagttattttttttaaaaatgatactaatcagttttcaagtttattttagctaattattaattgatcatgtgctaatggattgctctattttacgctgaggaggttgagttcccaacctcaacctcctaacacagcctattatcaattaatactacacgtgtggttgcgctttagtaagaattcaacaagggcatggatttttaccattgagcgtatattaatagatacacactcacaaacgtgtgatttacgtgcatggcatgtatttttcacacaatctaaaaaaacatcacatatgcgtgtacacaccacctatggctatagcttagattacgagacgcatgtaaaacaaagcttcttaaacaagctaatagtttatacagggtgtcatttgacatactttaacaaagaaaaaggaacttaaaatcaatgtccatagccctttaaaaaaacctacggcgtttctacaaatatcttttgaaaagcttcatgtcctctccttttatttctgctactatcagctctgttttgtccgtaagatgttacctttgctcttaccgacaacaaggaggaaaagaaaagaacatctaggtgtgtttagaaacttgcgatacaattaatataccaaattccatcatatctcaccgaaatagaaacacgaaaataagaggaagcataacacgtaggtgcacatgacttggctctctttttgacccaaaaccaacaaaaataaaagcacaacatattaacgattcaagcacacgcgtttgtcaccggtcaaagcaacgaatccttggacgcccccctcccaccgatgagccacgccacggtagcttccgctcgtcgtcccggtctctcaccccgcgcaggccgccgccaccaccaccgactcgctcggtgcacgcgccccacgtccaccggtgctcgcggatgcagtaccctgtctctgtgtgtgtacgtaattttttttattttatctattcaaatattttaaaaaacaatattttcaaagtattacatgtatatatatacactcctcttaaagaatgtcatcttagagaatattttacttatgacatggcacgtaaccattgcacgtatgctaacggctacgtgaaggagaactgactattttgtagacaacctccttaccattctactagagttaggctgcacgactgttataacgcgtgcaatgtcataaacaaatatacaatcctcccaacaacggccattaggggtagatctgcaatactttttgaaaaacaattactttctaaatattttagtaaataaaaattaaaaaaaatctgtatgtacgccttcacgctgggccgcaagcagcgcggtcacggcccaaagcggaagaaaggcaacaaagctgcgaacagctggcccattagtgaagttgggccttggatccgagcggatgaatttttttcggttttagatttttttaaaaaaatatttacagaaataatctatcgcccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaagggcctgctgcccagcccccagccctcattcttctctcctcaattccagtgaaaaaaaaagaagagaggggaggagaagagaagaaggggcgaagccctgccggattcagacgccaatttcaggtaatattcatagatcctatatgtgactattgagttaaatagtgtgtattctttaaaaatttgtttgaataaatgcattatatttttagggttttagttgtactaatctagaagtgcgtattgtaaatatcggtaactacgtagatctgctagtttggaatcaatacattaccgttgcattggcttacacaataagatattatgttgtagatgtttattgcatgaaagagtaatatgatttgataataagatgcttattttctcacaacatttattaactttgcttgctttacatctattctttcctcccaggaaccaccaaggagatgtcaatacagagaatggatagacaccagaagggttctaactccacctagccgtgttgtgtagcttgaactaccagagcaatacagggttactaaagtgcggtttgagagaggagagggatcctcactgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccactgagaagcgtaacaccctactcctgtgttctggtggatctgtgcgtgaaggaatacagagaggcggagagcgagagagagttcaggctctagaaaccattcgccagagtcccaatccccctctcccctaggcctgggcctcctttttatctggttaggggtcaccacatgggcctctcgctgcctaagaagggaaacatgctttttacaatgagggctagtctatagccggaagtgacctctgacaagcagagcacacgcctcctgccccactcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctattgccacctaacccgcgatctgaccggtctgtgaccggtcacacaccgcgaccggtcacggatcggataagcatgcgctgcgccgcattaaatgcggcgtggtgcacttcgtccaacctgctataaatgcggttaggtgagccccgctgtgctcacctaacccacacacgtggcgccaaaaccacagggggtcggggcaccccagccctcggggccgaaacgggagcggcccgacccctcggggagacagagggaggggtggccacgtcaccttcgggcccgacccccccgaggaggtcaggccacgtgggtgaccgcggctacccaagcctctagtcacgatacccccggccccatgtcaccgacactcacgtaggggttagctattattggacaacttggcatattgaaatttctactgtcatgcttccttgtcccattactacatcgtcgttgtgttcaactattgcactacctccctcctagttcgaatctaatatcatctatgtaaccgcaatgcaaatagtcatatcatgttcaaattgtactactatttcttcatgttacataattctccttgtttaagtccatataatgtttctacgacccagactgcgataggcctatataaattatccgagtactaatacgtcgaataaggtacaaaaataatacctcacttaacatatgaaattgcacaacaaccaacttcaatacatttttataacaatattaacaagttttaccaataaatacttctttatttattattaacataacatagaaaaatcttttggccgtactttttttatctgggtgaaggcggcaagggatccagatgaaaaagtacggccgcaagctctttatgggcggccaaaattgcaattagccccttgccgccctctgtatgggcggcaagtgcctaatcgcaattttggccgacggcggcagacggcgcggtcgacccaccgtctgccacgtcagcttgccgcccaccattagggcggcaggggctatttctgcaattttttttggtcgatagattatttctgtaaatattaaaaaaaaatctaaaaactaaaaaaattcccaagcggatcaccccaaaacgggtcctgatcggtgacacctcacgccctttttttatgtttttttttctctctctcgtgtaggctaatcaggggaagccaagagccaggcaaatctcgagcccaacctgctgcacgcaagaacagagaacgagcagcttcggcggggaagaggaatcgaaagagaaggaaattttgatggcggaggaggcgaagccggacacgcagctgttccagctcctctccgacctgctccagcaggtacaagcgccgccgccctctcgatctgttgtcgatttcttgtttttggattaggggtggttcatgatttcgccgacatggatcttcgcttcgtgcggatgttgttacttttgcggatctagtatcacatatcaatctcggttgataccattatttatgtaaacctagttaatttgttttggggatagatgcaacatggcctatggcctgggattcgacctcaacgacatggctgggagagaagcaaaatagcagcatagtgcataggctcagagttgatgtagttaatctctttctggtggattccttgctttatgttactatgcactgcgcgccctgctgtgtaatgtttacgaatctgaaagagtgaaacatgggctattgatttgggtcattgggtgattgaaggtcaatgccaactatcaatctactggtgattggctgggattgattccttctcgttctagcaatcaaacaaaatttcctatctaaatcaagctgatctatatcagcccctgtttcaaaactctgaactctatcaactacacccattgcaacctggaggtgtgaaactctttttcttttattttcatatattcatatttttcaagctatgacaagacaaaacaacaacaatagaatcccttttctttttgctgtatttcccatagaaccacagaatcagcggcatgatcatgtatattagggccaataacctcacttgaaacaactagtgaccattcaccggtatctgaaactcaacagtttaccctatgagtgataggaacaatatacaaaatgctgaatcagtactacaaacttttttttttcatgagtgtagtcttattcttataaactgcatggtaatctgagtgtggaaccatgaaaacattcatagacatgatcacttaactgaacacttacttctcggtgacaagtgaaatgccatacaggattagttcattttagccctctccatgagggttctacttaacattgtatctgcaaggtattgtagtctattggaccttggtacccccatcactgactgtcctgtttgtaggcgtgtctacatttttgcatagcatgtaatgttttgtcattattggggcatctgaatctgtatagttcattgattatagcattggaagtttggatcctcattatatgcaggattgcatgtggttgttactttacattcatttctcgcagttcctcaggatatttctgatttcttactattcaacatcatatctttttgtgatttggataagacgacaattgtcttttgatgcttgactatgatcattgagaaagtaactagtatttgattattcaaatgcaggtggagtcaatgagcaaccaggaagaagtagaattgcgtgctaagatcgaagcactaggactagaagttaccaaggtaccagagcagacacctaagcagcttgatgaggtaactgcaacaacctctgtttaatcccctttccgcgaatttatttacattttctcatctcatttgttttcgttcaacgctatctttagttagagatcgcagcagagctggacaaactatcagcgaggcttgataatgttgacaagatgatatcttctgccatggcctcggatccagaggtgaaatcccttttgagtaccactgctgatatctggatgcccgtcatcaccgcctctgccgatgaaaggcggggatttgcaggaacaagtggtgaaagcaaccaagaagagcaggagagttccaaacaatagcctcctacatgtaccttcacatgagtatttcttgaccatgtatcaacatttgtagacaaaacaagcaataagcacacattcatgagatggtaaataaatctgataacttgtggtggccattttgtacatcaattcttgagtcttcagtttgttatttttcagtttcgattctcaaagttgcgcctgcagagtgcagctgtttgtagctagcaaccacaacatttttatctggaaatgcatcaattttgtgtatgatgttgattggagtctgataacttgtcactggatgacatgattattttgtcttgctcctgctgcatattgttcatctggcgagccacgtcgattgttacataacagccactaattatttctgaaatatttgctcgctgtaatgcaacatagaaaatccaactatccgtttggattaatccataccaagagttcaagagagcagctggagaagaccttcttggcgccaaaccaacggccgcaagaacaccacagaattcaagaagagagaaacctcacaaatcgttcgtctcctcccctcctcaatcccaatcccgccaaaactgtcgccattcatggcgacatggcgccatcagcggcctcccttccctcgccatacacttcgccctcgccacctcctcctcttatctgcttctttctttagcttgctagctactagtactagtaattgtagtggtgagtcgttgccggcgaggtcggagcagcagcagaagcagccatggcggacgacggcaagagcagtaaccagatcctccaggagctcgacgcgctcagccacacgctgtaccaggcgcacaccaaccgccggaccgcgtcgctcgcgctgcctcgctcggcctccgaggtcaatggcggcggcgccgatgtcgtccgggccgagtcgcgcccgcggtcgcggcggctgtccctgtcgccgttccgctcgaggcctaagcaggacaagaacgcgatcgtcgacgacgacgacgacgacgacggcgacgacgatggcgacaagggggcacgccgcgcgccgtccaagagccagagcttcgcggcggtgacgaccccgggcggcgaggcggcggcggtggcgggagagaagaaggggatatggggctggaagccgatccgcgcgctgtcgcacatcggcatgaaccggctcggctgcctcttctccgtcgaggtggtggcggcgcagggcctgccgccgtccatgaacgggctgcgcctcgccgtcgccgtgcgcaagaaggagacgcgcgacggcgccatgcagaccatgccgtcgcgcgtgcagcagggcgccgccgacttcgaggagacgctcttcgtgcgctgccacctctactgcagcggcggcgccggcaccggcaagccgctcaggttcgagccccggccgttcctcctgtcggcggtggccgtggaagcccccgagctcgactttggccggagcgccgtcgacctgagcctcctcgtgaaggagtccacggacaagagccagcaaggggagcgtgtccggcaatgggacatggcgttgccgctcgccgggaaggcgaagggcggcgagctcgtcgtcaaactgtcgttccagatcatggacgacggcggcgtcgggctgttcaaccagaccggagcagcaaccaagattaactcgtcgtcgtcgtcttcttccttgtttgcacggaagcagagcaagctatccttcagcatcacgagcccgaaggtgtcgcggtcggagccgaagctgacgccgacaaagggctcgccgtcgccggacttgcgaggcattgacgacttcaagctcgacgagcccagtttgccatcgctggcagaggccaagcaagagcagaaggagccagagccgccggagccggaggagaaggtcgatgactcggagttcccggagttcgacgtagtggacaaaggagtggaagggcaagaagagaacgtcgttgaagcgaaaggcgcggcggaagaagaagccaaggaggagaaggcggcggcggaggaggcgcccacgtcggccgccggcgacgaggtcgtgaaggaggtggtgcacgacagcgcgcacgcgtggcgcatcaacgagctggaggcgatcaccaaccagatcaaggctctcgagtcaatgatgctcggcgacgcgccggccgccggcaagacggaggatacgcgggacggcgacgcggcggcgctggacaccgacgaggaggaggtgaccagggagttcttgcagctgctggagcaaggagacggcaaggccaccctcgccaagtcggtgtcatcgctcaagtccggcgcgaagcgggacaccggcggcgccgccgacgcgtcggcggcgtgctacatctccgacctcggcaaggggctcggccccatcgtgcagaccagggacggcggctacctggcggcgaccaacccgttcgacatccccgtggagaggaaggagctccccaagctcgccatgcagctgtccaagccggtcatcctccgcgaccagaggctccccggcggcggcgccgagctgttccagcagctgtgcgccggcggctgcgaggccctgttcgagaagctggcggcgctcgtcgggacggacgaggtggtcggcaagacggcggagcagatcgccttcgagggcatggcgacggcgatcatcagcgcgcggagcgcggcgctcggcgcgagctccagcgcggcgcagaccgtgtcgctgcttcggacgatgtcgtcggcgatgagcgacgggcggcaggagaggatcgacaccggcatctggaacgcccacgagacgccggtgaccgtcgacgagatcctggcgttctcgctgcagaagatcgaggccatggccatcaaggcgctcaaggtgcaggccgacatggccgacgagcagtcgccgttcgacgtgtcaccggccagcgacaagcggggcggcggccacctcctcgacgccgccgtgccaccggaggattgggcgctcgcctgcgtcggcgccgacacggtgaccatgctgctcgtcgcccagctaagggatcccctgcgccggtacgaggcggtcggcgcgccgtcgatcgtgatcatccaggccgtcagaatcgccggcaacgacgacgacgacgagccgaagttcaaggtggcgaacatgcacgtcggcggcctccggctgaagtcggccgaccggcgtaacgtctgggacggcgagaagcagcggctgacggcgatgcactggctcgtcgcctacgggctcggcaaggccggcaggaaggggaggacggcggcggcggcggggaaatccggccatgacgtgctctggagcatgtcgtcgagggtgatggccgacatgtggctcaagccgttgcgcaaccctgacgtgaagatccctctcaagtagatgctgcattgctgcctctgtgcttctctgatgctgaaaaaaaaagaacatattcaagcccggttctctttatattcttctgaattttgaaagctcaagattgtaatttatacttggttcctgcattgtgattgtattgtaatgaggaaatgtgagtgtctaagaattagattccaacactgtttattgtgttgtaagtattcatgtcatgtactgaaagaggcataatactgtttctgtaagttcacaaagcttagttcaaaatgtacaaaaattttgaacaaggttacttatgacttatgagtcatacgagtaaggattatggaagctattgttgccactgcagctgaacacaactactgtgcaaggccatttcataagttagctacaataacaacacagataaaataagatcttagctttcatccttgccaataatatgcacagtggaggatcatgtgtgtacatgagcacattttgtcatacaacaatcttcaaaatagagctactacagaacatccgcaaacactagtgttccttgagaagtgctgatctactggagcttatgttgattgctttaaggtgtagggcatacagttataatgccagatttgccgtacatatagtatgcagtgtatttggctcagttggttgcttcctgaaactatcaattgtagtctttccaatagtcggtcagaatcatgcgccgatacttctctgtgattaaacgaaaatgtactaacaaaaaacgcttgtaaaactggtcaggtcatatgttaaacttcttccagttcacgaggaagccctccactcgttggcctgaaataaacagattgggactcatcagaagaaacctatcaggattctacaccgatacaagatgccagggcgccatgtcaaatttttaatggacattagctaaaacactaccatagaatcagaacaccaccctaaagggcaggagagtaccacacaagtatcagttgtacaaacgacaaatttaaggagtgaatttgtgtgattgtcaacaggaaaaggacatcacatataacaccttcagaacaattttagcatcagtgtatatttgaaacaccattgaagacattagcattgaaatgccacttgcagaaagagaacatggctttctttgtcaccataaatccactacaaatgcataactaaacacaatggggagacacgttcatatgtcgtgaaaaaaaaaacatttgcctatgatcttattgcattacaatcacttctgcatacaaacacactttgtattggttatacatagccaatccatgattttattttacctatgcatgttctcctctctactagatgattaagaaatatactacagtcacatattatgcaataaagattgatgtaccctaagaaaaatatcagcataaatgcaatcgaaaacccagcgtggagaaccgcagataagcttggttaagattttaaaccatatttgttaaataaataaacaaaataggatatcattgagaaattacactgcatacttacaatccagtcaatatcttaattgtatcatagaagaaccattgcatggttatgacaggcccaacaagagtgattcgaacaggtaggcttcttgtgaacaaaccacgaaacccaatacttttcacagcctgcaagagtaggatgcaaatattagatcattgggatggtgagagtttgaattattattataagctggagacacaaaatcatatccttacatctatgatatttttagcctttttgttgtatagagatgagacaatgttatctgcaggattggaaacaacagtaccaactgcaccagatatgtagccagccagacaagtagccccaagctgctgcattgttgaacaatcctcctttttcttctgaatgacattccgatataggatgtccacagtatgctcaaatgttgaaaacattagcatagaaactgcacgaatagaacaaatggtgataagatatacctgaacagaaaaaacatttatactttagaaaccaaaagatccactaatgaactgacacacttaaggcgaaattgcgcaaatgtttccaaacatcaaatacaggataaaaggaacttctgaaataggcagatagatgttgcttgttgccatatgtgcagatttaaaagctcagagttgactgagcagaaagaaatatgatccccacaagacaataacaaatcagaattacgcatacagatacagcttagttcttgccccttacaattaagtacttcacacctagagttttgttgtcagcgatgtgacttgtgcagttgtacctatttttgtaccacataagtgaaaacattttcgcaaaagaacacgcttagatcataacttaatcaaaattatttaagagttgcgaaatgagctcatttaactatgtcgcacattactacaaatgatccagaagcatttcaagcatatcatacagacggaggtactacatacatggaagattccgtccccaaagtggtaaaaggcccttgtaaaacctgcaataaacaaataagctagaggtaagaggaattgcagtggtatctcagatatacaatagggcaccaaccaacaagcaaagctaagaatatgtagtatcttacttgaagcttacccggacaagccttcagtggcatacacccttgggaagccatcaatcaagccttttgcaaacataggttgtgtctgcacacggactttcaccgattcaaaggggcagagggcaacatcagctatgatttgagcagaggcactgctaataaagtaaatggtgctcttatttctgtccactagcacatcagagtacttcttcttgaaatactcataaagaccaaacttgcagccaccttggaaaccatagccaaagaatttccctgcccaacccctccaaagagatgaagctccctcttcttttacaagaatgttcagtcccgaaaatatgctattgtacttcatgggattcacctgccaaaacaattaaagggaagtagtaactattataaaaccgaaggtgccctgtggatcatttatgaattagtaatgattatgtattctaaccatatgaaatgaaagattccaaaccttccatttgatatggtatacaactgagcatttgacattgctaatttaatatgaacaatatcagaggcagtttaatccttagactgcaagagtctagtaatgtggtcaaattcgcaactcacaaaaaagaactcgctcttctgcaatggagcaaagcaggcaaccacagccacaccgctctcctgcaataatagcatacctgcatgttgaccgtgaggacgtcgagcggggtgatggcgaggtgggtggcgcccgccgccagcatcccgccgccggtgcacagcgcgtagtactcgggcgagaacagcctcatccctcccgttcctcctcctccaccaccattggccaccctcgccgcccccgcctcgcccccacgcgcgcccatttccggcattccgacggacggatcggccgcccgcgaaggaggggaaggggaagacgacgaagccgaaccgcgccgaggccgaggagagaagaagaagaagaagaggaagaagaaggttcgattccggcgttgtgggagactggaccggaaatggaccacgtagcgaggccccgggccttcccctttccccctctctctcggggccacgttgacttgtcaacgcggcagcgcttgccttaaaccctagtagcgtggtccacctgtcagtgtcgtggtcgtggagaggagattttcttgggccgtcgtttcgtgggctctagttgggccatgaacagcagatggcccaggccggccgctcgttccatcgtgagctatgctgggccaggccgtagtgatgggccataagcccataaagatgttgctgtctttttcgctgcttttttgggatgaccaaagaaaatgtcgtccaaaacattgttaagagtgggagaaaaaaagttactgtacaagaaatactatcatcatctaaagaagactgtggatgttggcttgtataccgcagtgcacatctagaaatcacgtaccaatcacataaaacatgtcattaagaacggggcctaacaccaaagctaaggcccgactaccatgagctagcaatgagctgggctccaccaagcgcatgcaacgattcaccaataaattaatgcctaattaccttactaattactccctactttctaaattgatcttcacataatagaatacaaagggcctgttcggctatattgtacagcgctgtttcacagccacgttatagcttgttgctgcagcaagaggactgggtgcaggctgcagggcaacgctgtacacgacagccaaacacgcccaaaatttctcaaattgatcatgatatgaccgcatggacactgatttcattagaatataattaatgcagcatgtgagaatgtgtgcatgctaaggtgtaattggcatggtgttttaatcgatgtatccattgtggtagaatgtgtgcatggtgttttgattgacgtggtttaaattattcttgattttggtgtataaatttatatgatgatcaatttgggaacaagggagtacttttcttagccaccaatagtgcgtatgaaacaacaacacagcagcaaacgtacttacataaatttttaaagcaaatactcacacaaatgataattgaattatatagatttgcccaaactatcaaaattttaataatctgccactaaaacagaccaccgctatgtgtgatcgtcgccggacctagaacatcaccccaaagcagagtcataaaaaacgacgtcttcacggaggtgttgctacgtcaaggacgtgtcagtcactcgttcaagaaaacgggacgtggtttttaacttaagagattcgatctcgccaagacgtacaaaatctggagttcctgctactttttcgctgctcggccgacactattgacaaaggcaaagtttattctgagagtttttttaccgtacagcagaccaaagcggtaccaaatcgtcaccgttgagtagataggatccaacggctgtcatcgctgggtaccgcgaggtaccaactcgtccttgtggtggcactgtattaggatgtggaggtggaagggtatttctgtattttcgcatggctgattcggtcttatccacttcgatcgtttcgtccgacgccgcctctctctccatctccatctccgcaccggtgaatttttccccacggcgaccgccagcgtggagaagagaagtgtgcagctgacggccccggatgaccgcgtcgagaacgacaagctcggcgccgccgaggaggagctcgtctccaaggcggaagcggcagcgactgatgtcggagcgtccattgaaaaagtcggcgccgcgtccgccgttgagaacacctctggcgtcaagggtgctgacggcaaggccgtcaaggcgaagggctcacggtgaacacacacacaaaactcacgtcgccggcaagaacacacacacaaaactcccgtgaacataggaatgaacaccatcttgtttggtgctgctaactaggcagctttttcccaattcttgtattgcttaaatatgcgattacaaggaaaggaaattatagcctccaatcagaccgaaacatgcatgatcacacgatggatgtgtaactaaccaaataaaacaaacactaatctagcacacaaggattaatctcaacagtcgatgacgagaagcgcggcggcaccgaggaccagatggcttgagagcgtcgaggaaagccggaccccttcgcgtacaggttgacggggcctcctcttctccccgtcccccggctgctgcgccgtcgacgagcagggcaacaacgatggcgacggtgcatctccacgggatgaatcagcggagtcacaccgcacgatgctgcgcttcggggaagagagaaaggaaaacgctcgagaggattggttgtacacgcggtgcaggagcggtgtgtttccacatgttcccatcatgccccttgcgagcgaacgacagggatgatttcggtaccgtgcggtaccagtaccgcaaggtactatctgatggaccagagcaaacctcttattctgaaagatgatcaaagtcgctctagaacttctgttccggattcagccaaacttgaaagtaacttgagatcgtatatacgaattacagcgagaaatctacaatggtagccaacttttacagataactgtgagtctgtgatctcgaatgaagacgatcaccgggcaaaaaatatctgcattttgtcgcatatatgtgtgtaaacaaggcagttttttggaagttctatgtctgtgcattggcacttactattatctaactgaagatagatggagttgagtgtacgtttcaagcaacacggccgtcgattcacacgcatttgttggtttttggccgcgtttggcgaagaaagaggaaagagtagaattgccggccggccgccagaagcagctaaaccccaaacacagctgaacggctaaagcatctctctgcaaacatcaaaaaaagggcatcaaacctctcacatcaaactctaatcactcctgcttaaatcatgagcctgatcgtggccgtctattcagagattagagtgaagcccgaatttctcttccgcgtggattgataagcttgaaagaactgcaatcgaagtgaaagatgaaaagaaaggtggcaatcaaagtgaagatgaaaaaaaggtggccacgcctgccggcacctcctgatttcagtagcaacatgtcactgtgccatcataatgacaaaccaacgaaccaggacatgtttagtactcgtttattcgtgcttcggttctgttcgagagatctcaagacgttaagaaacagtcaagcatctgttgagaatctgaaaattctgaatttttcagcttctagcttctgaattatatctgttgagatataatcagcatataaatgacacggtttctatcccgaatgcataaaaaaattaacatataaatgacacggtttctatcccgaatgcataaaaaaattaacatataaatgacacggtttctatccgaaatacgtaaaaaaagacataaatattagagaataatataatatcaaataattagaactttagaaaaggtaaggcttctaacccagatcatctaacccactactttgtagaactttagaagaggtaaggctttcaatccagatcatctaacccaccaccttgtagagatagctggaagaaccatatgcgtatagaggagaggagagacgatgagtttgtttggcaatggtgcaatcaaactgtacggcaaagtacgtgagctgtacgcagtcggcatattctttccccagatggggcagatcaattttttaccaggtcacgacgacgtccgtactatcagggcgaacgaacaaacagttacgcgtgcgaaaatatcccaacccaacccgcgcggcgggcagcaggcagtgcccccatgccggccacgatgtgaccggcggcctccccccgccgccatgaatgatcgctccactcgtccacttgaccaccaaaagcgacacaaatctgatgcctttttctccttttttccatcccaacctcagcttactggtcacatatctctttactattgctactctagctgtgtactatagcatcagtactaaggaagaagaaaatgacggttaattatcgttcgaaaaagaagggaaaatgatggttaattaacagagatgtgtacatgcatgtatttacagaacacatgtatctactacagttgcattgctgcgtagtacaagaaaaaatctctcggaacacgtatctactattcacgtttttgctaggtgtgtgtgtatgtacaatcgaatgatgcacgtacgcgagcgagagagagctggagctctacggcaccgatgtccggcagccgccgcggtcgctggcgccggtgggttgcggtggctgtgacgacgcctgtgccgcgtcggcggcgcagcacggcggcggggggtcggtggcggcggcggtgactgcaggcgacggcgccgcgaggacgacgatggcgcggcggcaggaggggcaggtggaggtggacacgagccagacgtcgacgcaggcggcgtggaagccgtggccgcacggcgggagcacgcggacctcgtcgccgcgcgcgaactcggcgaggcagatggcgcactccggccgctcctcctcctcctccgccgccgccgcctcggcgaacgacacggtcggcagcgacagcagcgccttcctcttgagccccttgcatggcgccgggggcattgcctcctccgcctcgacggcgaacgacgacgggttgcacagccgcgagcaccgcgccaccagcgccagcccgacgacgcagagcaggaagcagagcacggcggcgaggatgaggaacgtgtccgtgtggacgccccggccgcccgacgccgccgccgtcgccgtcgcggcggtcaggtgctccgacgactgcagcaagtgacgcatggtaggtgaaggtgagactgagagcactgccaaccactgtgccgacgaggggccagttaagcaatacactgacctaaaaatggtgaaaaatggagaaggcaatgcaagagttaggcgctgggagggtgcatttttatagtgtgaagtgaaggtgatttgtgctggtttaagtgattaattaaattcatgagctcttaagtgaagtgtcactgtcctgtccaccaattcttctaggaattattatttttttggttttttgtcacagacgtgtgctgctgccttggagctgaattctcctgtgctgatacagcagctttggtgcgtttgtccctttttatcctaaatctgtggcgtttgatgacttgatcgatccagatttatgcaggcacgaggtcctaaattatgttgccttttacttaatttattattactactggcagaattaaagcaaagcacattgcgacggtggtagtagctagctttgtccaatctgcacgttgtagcggagaaagtcgacgtggcgatgagcgtgaaagtgcatgcaatgcagtttacggaaaaaagtgtgattattccatgatcaagcgctaaaaaacaaagcagtattcgcggacgtagcatagcaggagagaggagaccgaccagggccatgcgtagggttcatgagccacgtcggatacatgtcaaagcacaagtactcgtacgtactccctccgtccaaaaaaacaaactctaattttcgtgtcaaatgtttaactgtccgttttatttaaaaaaattatgaaaaaaattaaaaagataagtcacgcataaaatattcatcatgttttattatctaacaacaataaaaatactaattataaaaaaatttcatataagacgaacagtcaaacgttggcacgtaaattcgcggtttgtctttttttttttaaggagggagggagtactactgcaagatctggataacataggctattaattagttagtcgtcgccaccgtaccaacctttgaggaaaaagaaaataaatggtgtaccctgactccgatccatcctgatcttctgtgattaactccatccatcagtaaccagtgtcgttttctgcatcaaactaatctggtgtttaaatcttctgaaaataaagatgaaaattaagtgttttacgtaaaacgaggtggtaatatcgtgtgattaattgagttttaattgttacaaacttgaaaaatggattaatctggaattttagagcaactttcatatagaaaattttcgcacgaaacacactgtttagcagtttgaaaagcgtgctatgagcatctaaaatttaatccaagtcttgttggagaagcgaacgcagcctaattcataatcacatagtattcaccttgtgcagttttgcctgtaaacttgtctaagttcagttctcaaaacaacttgtctaggttcaatgcacgatctcgatgtaatctatcgttaattctatgatttaatttctatcccggccaaacacaggcgaggttaccggtcgcattattttagctgatccaggacaggatagacggcacaattgtggaggtccattggaacacctcccatatacatttccctgtgccgtaaaggttggcgcacgccacgccacgccacggcgcgtaccgggcgccaacacgtgctcgccgcggcctaaaaccctcactacctcgtggccccagcgcgcgcgcccgcgcactcgccgagccatcgcgccgcgcgacgtgcgtgcgaaacgccgagaattttcggggtttttctcttctcgtaattggacgcgacgcgacgcgacgagaggccgggggggcgacgagtgcgcggccgtccccagcagcagcaacagcaaagcaagggctcacatcaagaacgggccgctctctctctacccaagttgcgacaatatgcgttctatctcgcacgtttctttctatcttcagggcactctgctatgtaatctagattcgcgatctttgatagaggcaaatcatttcacgttgatttacaagcccaaagtgcatctaaagacgggataaagtgcaagaggagtgaagtactgatcacctaaaccaaaccgatggacggatggataagtttcatcagaacggtggtataggcttttcgatgggccaaagtgctcaggtacaggtacggatcgagcaggagaggtcaagccaacactcgagggagagtgagcgagtttggtggcacgtcatgcgatcgcacgttgcctccatcggtcaaaacggcacatcattcgggtagacgccaggtggggatggggacgggtgcgtgcgagcttttctgctgtcctgccggcgtcgggagctagtagtggcggccgccgtgctccgatggggatgcctcggtctccggccaacgacgtacggctgcctgcgcaatgctacaatgctagtacatgcccatgcggttttgaaaggtcagtgttatgtttgtgtcgtctggtacgaagagagttggggacctggggtttgtttggttcggtttattgtcatcatttattaataaaagtcgttacccttgcctaaattcgtgtgctctaaaattttatcgcactttgcacaagtctaaataagaaatattgtcacattttcttcaagttattgatgcttgggacctatttgatacactacaagaaaacagctatacctaatttgaacaaacttgaaaaaccttagacgtgttaaactttgcaaggtgtggctgcaaatcaaaatcaaacatttgtgctgttgaagatgaaagggaacttggatctagcagccaagtaatggtatgactcggctgggcatactggtaacgagaggattcagagatcacgagtcatggtgtcactagtagacacaatactactgaatattcaggtacaaatgagataagtgacagtgtggttgaacggggggaatgggggcaaaggatgagaggagaggagacagggacaagtggcagcagaaccataggaacagtagagctgcgcagttggtgttcttatcttgttcctttgttccagctgagctgagtgtctatgttcttatctggtttgctgttctgtctcctcttgtacgagtagtagggtgtaaattgtttccagttgccaccttgggctaagttgggccgtgactcggtcggtgactctagtggcccatagtgcgaacgagacacagaatcggcaaccacagcccacgtagacttgcaaattgcaacgcgagtgaaaccacgtgctgtcacccctaattatgtgggcctaactgggctacagaagatttaggtgctatcgtcggacctcgaattggaaacaagttcactttacatcccttatcgaaggatggagttccaaccgcgaatgtcaaccacaaaaccaagtataacgtatctctcatgttgcaaaactaacgtaaacgagatcacaaggtagtattgacccgggtttcggccactgagagacaaatgtatacatttgcttccttcgagtgcacacgaccagtcccacttcgtgattggaggcgaccttcgtgacctcacgttcaccggtgtcgctcgacgagctatcctaaatcgatgagctaggtgccatccaccgtgagctatccccaagccgtgttccggcgaggaggctcctacttgtgatcaacgatggggcggtagcaggcaaatgccgcggcgatgtcgatgtcgatgttggtgaagagggaacggacggggacatgtgacgaggaggaggagagtgtcttggggatgggagagagggaggggggtgtgggcgtgtggcagaggagaaaacgtgacacgaatgggagtgggaaggacaacgaggggaagggtggacagcatggacgacgcgaaggtggcacattggagttgtgtttagcagtcgttctcttttcctttttctttagttttttttctctatggtataagccaatctggctgattgcggtgtgtaatcattttttttaatatattgacgtataattcttttgcgtgttcgtgaaaaatgcgaaggtggcgttgatgtcggcaccggctggcatgttgcaagcctgcttgacagtcgacgctgccctgccgggcttgatcaactagaaatttgctagggtccggaactcggatcagtcttggaggtaggggtgggtagaaaaggaccgaaccgaaaaaaccgaaatcgagaaattcggtcctagatagtgaaataccgaatttcgttcggtcaattcggttagtcaccttggttaaccgaatagactaaaaagaccgaattaataaaaaaatatctaaatgaaacctacaatctactaagttcaataggattaaactctaattttcacatccctgcttcttctaggcatgtaatctaataagagtctttactcatatgcgcttacgatttttttgttgaaaatttccattatttctttgcatatatgaaaatgttgctgaatttcggtcaggaccgagactgagacggaaaagatcaagaccgaatttatcggtcctgatattttttgtgttgaaattcggtcttcactttttaaagacagaaatgaccgaaagaccgaagaccgagaccgaaattttcggttagaccgaatgcccacccttacttggaggcccatggaccaataacgaatccaattgggggaacacagttacacaggtgctgaaacacattgcggcgtacgtcatggctgactcaaactaggcagagcatgcagcaaatgattggattttgggggcagtgtcattgctgactgcgattcgcatgttgttcatctccccgtagcttctctccggtccatccaaccgtgtcaacatcgtttaggcatacatgatacagcattacacaacgatcgctcgccggagtccggcagtcacatgctgctaatgctgttggtcccccctacttgaccgcgatcggccggttcttcctctgcctaaatggctaattttaaacgcctacatatatatatactcctactatacacatgtggttgatgattccgtcctgttgaaccaacccctgatctatcacgcattattggatcttgttggtgcattattgcagctgcgatatatcaatgtgtggtctcgtgcgttccctccagaaatgtagcgatctgagagacaggttcggatggccacaggctgctgcagctgtctgcacagctgcacagttttgaaattgaagggattattgcagtgtaaatacatgtattagggaatgacctaatatcaaataattaggagtgagacttgaatccggatcgactacccatcaccttgtgaagctagccggaagatctctttacgtttctcggattattgcagtgtactggcgtacattggcattgtcgatcgatgaccatctgccaggtgaaaacgtgcgtgaatcttgagtgtaaattcgaaggagtcttcctagcagcgcatagaaatggagagtgaatactctttgctgctgatggatgatcgatcgatcaacgctgcatttgatcatccgccaggtgcgtgcgtgtgaaaaatagagattaattatagtagattttgttaacctagctagaaactatcaacatcgcaattagcgtgcatacatgcacatggctgacaagtagtagttatacaagtggtttgcaagagcagtctgagttgatctctttcttctcgatcgaaggcgagctttgagtcaaaagtccaatttgtctacgttgaacgcccaggattatcatcaggtcctgacttaaactcgtcgccgcatagacctacgtatcagatgaatctgtcgacaaatgtacccccttgatgagatgaaacagtaaaaggataatcagagcagcagtgccagtagagtatcccattcagagacctccacgtcaccacggtgccaaaaggaaggaaaaggtagaaaaagggatataccgataggaacatgcgtggtcaatagagttatagagagataagagaagaggtaataataaaacttaaggatggctgcttgcatggagtagaaaattacaagggccaatcaatcaatcaatgatggctcgtgcaaattgtacagggtagcgacagggcgcgcggaattaggaaggaaacagcagcatttgcatttgcaattgcaacatgcagcggcgaagacgatcgatcactgatgacgactgggacagagagatgacaaggacggatgctggctgagttggctggctccccgggggtggatgcggtgtaggcctcatcttctcccttctctcgcagcagccgcagcggctgcgtgtttgaacacgctctctctcctagctagctctcctcttctctcctacgtatataagcggcttccttcccaactaattataatgcatttcaggtggatcgattgattccattacccaacctcaagctagctagctctccaccgtctgcgcccattcaggtcagcttctgctttctgactgactttgagttcttcccatgttttgtcctctgtctcgcgttctccttgattttgggagctggtagaaagctaagctagattttagcttagctccgattgccatggagatcgtctggagcatgattcgtctgccctcctgcttctttggaggaagctagctagttatgttttcttgtgcatttttttctcttcttctttcttcttcctcgctttgcctcgttgatttggtgttgcctagtcttgcaattagttctcaaactttgcttcctgtcgagcaacttgaggcaatgagctggctgttttgagctgcatgatgtttccagctacgagtactgaagatgcagtttctggtaactgctgtcagattaggactgcaattaacggctggctttgcattagcattctttcctttttcttttttttttctttttgaaaccaagccattctttcctttttcttgtttacatgaatgcgtgcgttcttttttcttttttgaacttgtcattgttcttgtaaatctgctaaagtgctaatttgacagctaggttcctgctaaaatggtttctatatacatgaacgaagtataaagaaacttccagctctatacggttctatcgctggcctgagaataaaaaattgtagttcaatgcctcatcagtggacaacaatattctctgatatttaagtttccattttctttcttttttgggaccttgcaatcattccgtaaaaggaggtgttgtgcccagcaacattgacttgttcagtgtgctcgagcttcacgtctttcaccctcttgtaggagacgatgaccaagaacagtgcaagcaatgtggatatgtcattttcaaattaactaacacatgctagaagatggaagaaaaaaatataaataaaaatggaatattaataactgtattagtagtactcaattgcgttcctgaagttctcatacggttcccatactccttttctttttctttttttaaataaaaaaaataactaatgtatgtgactaagaaatctaaacgtttcatttctttattgatcgattatcttagcagggtgtacgagccctgaagaactttgaatcatcttttttttattatttttttagagaagggtattttttacccggcctctatatctaaccggatatatacggccattgaaatagggaatttaaccccgcaaacaacccaatctgaaattcgcaccataagagatttgaattcaggaccttaggatactactcatgtcactgtaacctctaactttgaatcatctcctgaggactaatcacaagacatctgaaacatttccagaaaaggagagtttaatccaacatcagaaaagatgggcttcttgtcattgcttcttgtggcttctatgccaatcgttcaggtcctactcataggtgttattggagcttttctcgcttctggttacagcaaaattctaacctcaagcgctctaagggatatgaacaaggcgagctctcattagcacatcactgttcaatgcaaattaatctggtattgtctctggctaaacctgttgagatttctaacaggttgttttcactgtcttcacaccatccctgatgtttgctagcctggctaagacggtcacactttctgacgtcatttcttggtgagtttatactttatatatatatgcggttactacaaagcagctcagtcagacttttctgaattttttgaagtgtggactcttctgaattttaaaagaattcctgtttgaaatgacatagtactagactactagtacctttagaacactaaacaatgttacacaagtcatcttttcattcagaggcagggcatataagatctagcttcagtttctgtttgcagggtaacccaactggactaacagaagccttttatcatgcaggtggtttatgccagttaatataggaatcacattcattgttggtggcactctaggctggatagcatgtaaaatactgaaaccaccacagcatttccgaggaatgatcattgccttctgttcagcaggttcagtttcctatccggattgcatctttcttttgttcatactccggagatacataatactccctccgtttcgaaatatttgacaccgttgactttttagcacatgtttgaccgttcgtcttatgcaaaaacttttgtgaaatatgtaaaattatatgcctacatgaaaatatatttatcaatgaatcaaatggtagaaaaagaattaataattanttaatttttttaataagangaacggtcaaatatgtgntaaaaagtcaacggcgtcgaatatttcgaaacggagggagtagtatttacagtgcttcaactaacaaaaataaaacgcaggaaatcttggcaacttgctcttgatcattgttccagcagtctgtgacgaagacggcaacccgttcggaaaagaccggagcctttgccgctctcgtgggctctcctactcatcattatccatggctgtaagcaaaattatatttctgcatctcacattcactgaattatcgtgtgcctttttcattcagttgaataacagaattgatcgttcactctgtatctgcagcttggtggcttattcatatggacacatacatacagcctcatgcagaaggcaggcaaaatgtaccacaagatgcagtccaaaagcatccagtgcccggccgacagcgatgaagagcatcatcctgcacaaggtcatgatcaagtaaaattagacggtgaaactgcttacgctgatgaggaggcggctcttctggtgtcagctaaactggctcctgaacacaatgaagagaaccaaatggtaagtcgactaattaatggtcagtccagtgcaccattgtctggttcgttccatgcaaatcttcagagaaaactgatttgtcagaaatgcaggaagctccacttctgacttgcgagagagagattgctaacaaaggaggattctggacaaacctgaaggaaaccgtccaccaggttgtcgaggagctgatggcaccaccaactgtatctgcagtatgttcctgccaaaaccagttacaccattttcatcacatcaagttgatatcaatgctcattgctcatattggcagtgtcaactgattgcactgaagttgtctttgtgttgttgtttcagatacttggatttgttgttggcctagtcccatggttgaaatctcttgtcatcggcaatggcgccccactgagagtcatccaggagtccctccaactaatggggtgagtgagcatttacatgttaggtttctccatttctgtctgccttaaacagcatatttcaagtgtttcctcagcctttactcacggttcgtttgtctttcagcaatggcacgattccttgcatcaccctaatcctaggggggaatctgacacaaggtaggtgttaattactcatgaactaatgatatggaaattaactgcatcatcttgtgagttttctgaacttctctgaatgtatgtgcatgcagggctacggaagtcggtgctgaagcgtacggtgatcatcacgatcgtctgcatacgctacgtgatccaacccttgatcgggatggcggttgtccatgctgcctatggggttggattcttgccacacgatccattgtaccgctacgtgctgatgatgcagttcgcgctgccacctgcaatgaacatcggtagcccctgaatcccatgcagtttcattctgatttctgaagtttcttctgtccatgcttctaggaagatcttgatcacctgatcatgtgtcttgtgtgtgtgtgatctgttcgatccaggaaccatggctcagctgtttgatgttggtcaagaggaatgctcagtgatcttcttgtggacttacctgattgctgccattgcactcacgacgtggtcgacgatattcatgtccatcctgtcttgaggttgagggtgacaagaagaaccaactttgtggcaatattggtttagctggaatgattcagctcacggataaaatgtaaagaagccggagacaatgagcctctccgaaagagccgaaactgaggcttgcccatgagcaccacacgtccacacgtgtatagaaattgaagcagtatttttttagataatgaaaaatagcatggtggcccgcgtagataactataatttttttaacatattaaaaaatatttttatttttttcagttatttcaaaattgtattttttatatggactctatactctactcccaatcatcctcactttattaaatttctaattttgtagttcgaaattttgttatttctaaattatactcttcttatatggacttaatagtctatcgtcttctctaaatattctttttttatttgaaattttacttatttctaaactgtactcctatatggacttagactggtgtaacgcacatcagtcgtggcgttggtaggaaatacttaacaattcaataaaaaccctaattttcgaaactcgttctttggttgtggtcctgttgtgtctgtgtgcgccaagatctcactctctatctctctatcccaattccgaatccgaaatcaaatcctactctataaaccctccaaatcaaattttccttgtaaaagtctattacaccccttcttggtcattgggccgaatctcccttgctcggcccatttttccctttcggcctattcccctcacgttcccgctcgaagggagagctctctctctctctctctctctcgccgcgcgttgccgccggtgccttttttatttttcgccgtcgccgctgactcccgcgcgtgagcgtcgtggccgaccgcccggtcgccgccgccgccgtatgtctccgctcggcaccgagccagccaccctcccttttgccatcatcacttgcatcatctacccggccccgcactctgccgcatccatccaaaaaaacgggagtagcagccacagctctccacctcctcctcctccctctcccttttccccaatatggcaagggaccaagctgctttccctcggatgcaactagagatcgggcgcccgattttttggcaaaaatcgggcgctgttctaccaagtagatcggaaatatttcactaagtagatcgaagatgtttcaatcttgtaaaaactgaaacacaaccaaatcatctcattaaacattttgctacaacgtatgaaacaacggtttccaaaaaaaatcgggcgttgtttcaccctatataaaaacaatgtttcagcaaataacgaaaggatgtttcaattcactgcaacatttgatccatacatactgaaatatcacaagtacatttattgaaacattgttggtggtacaaaaaataaaacggatttccttaataaagcgcttccgtaatatgcgggtgattcgttgcaacgacacgtgtggtggggcgcgtggtggggatggcgcgggagcgcgcgggcgccagacgcgaagaaatttcgctttccctcaccgtctccttttccttttcctgactactgctcgcgtcacctctatcactcttggctcctagcgccaacgtgccgcgcgcctccaccgcctatctacgaactgtcgtccccgttccaccgtcatacaacgcctataaaacccacgcctctcctctcgttcggccgcttcccttttcgcagccgagctccagcaccaaaatccgccgccgtcactcccacgccgtcgtccgccatcgtcaagtgcgccggaggagccaatgctcttggaggcgcttgacacggacttcggccactcctctccttccccttccctgacccgaggccgaggcgatcacaccccgcgccttcagccctcttcgcagcgccacccctctcggtacccctcgccgctccgactcccttttccctctctcctttaggtgttaattagcccaccgccggccgccgcagctcgccgttgctagcctcccttggcgccacgtctctccccgcgattagccgccctcggtcctcggtcatgggtggatgtgaggtgattccttagcgtagttttgattcgattactgcttgtgaaattgctatggtgtgctggaacacgttgcttttgactgtggctgatgtgatcagctgggccagggaggccatccaaatcgtttggctgggggccaactcttgatctgttaaagattgatacattgtactagtccgaccgggcatggtgcactgtcgtgtccgcgttgttgagaagcactctcttagaaacatttgaaaaagttttaaacaaaatcgtatgcaaaaacaaacaatctttctatgaagcttgcaataaacacttaatttcgatgacttgctgagtataccctgtactcacccttgctctacataaataatccggttcttccaggagcagtctggcttcaagcaattttgacgaggtgttcccaagtcatgcttgtggccgtggggcagtcttcatttccgctttctcttttgtaatacacttgtgagctcgaggtctacccgtagcctcaacatgactgtaaaactactcttaattaagagaccactgatgttgtgatattctatcttcctatgataccagcgtggttttttgggactggtattggcttaccggttaatttggagcttctcacggtagttcccgtctggagctagtttggggcgtgacaattcgacttttagaattttatacctacacagactcttgtctactctttcaattttttatttcttaattctgattttctgttatttcttattgtatttttatatgaactctaaaacttatctttaaatatatattttttaattttaaattttagttatttctaaattgtactcctaatcatatatggactcttaactcttctttgcaatattcatttttctatttcgaattttagttatttctaaattatatttctgtatggactctaacctctagttttttcatgttttttaattccgaatttcacttagttctaaattgtattcagactctatttttctcttccaatattctttttttttaattttgaatttctgttaattctaattggtttttttatatagactctagctcatcttttaatatttctttttaattccgtatttaagttatttatggactctaaactcttcttccaatattttttattttgaattttagttatttcgaaattatatttttatatgaactctaaactctagttttagtttttctttttttaattccgaattttagttagttctaaattatattcttgtatggactctattttcctcttccaataattctttttttatttccggatttcagctattttaaaattatatttgtacatggactcttatttttctttttctccgattaatatgaaaatttctaggtgctgagagcgaacatggaggcttctttttctattgctttaataatataataaatagatagattcaaggattatagactgggcataggtcctcatacacacaaaaagaaaagattgggtacatgattatttatgtatcccaagtttttggtccatttggtttgcaactgaaaatacaagtggcaaaaccataggaacagtaaagcagcaattcgtgtcagtctcccactccagcgtgcgcatgctttcgtcggcggccggccgcgcgcgggtcttgttggcaagcgggaggagcggcgacgccgcggccaggcacccacgcgcgtcgccccgtggtacagcctccggcgactccgacgatgatgccgctcctccccatccgctccggcgccgcctcctatgccgctgctgaacggggtaggttgacacggcggaggtggcgcggcgctggcgttcgtggtggcgagcctcgggaagggcgggtggcggcgctgttccggcgggggttggcggagtggtcgtcgctgcgtcgggtgttcggtgtcgatgccgtcgagagcgacagcttccccttccgcctccgcgacgtctgcgcagccacgtgctcgggcggacggccgcacagccatcaccgcggcttccggcagggtggcggccatgggcaactccaccgatgacccacatgctccacaacaagcaggagttcccccttgccactggcgccgtacgtcgtcgattcggattcggattcggtgagcaccgcgcattcatgattataacaggctcacagcatatagaaatacactcaaaagtctagtaaaattttaagtacaaagactgtaaacagctagacttaaaagcaaagcactagaaggaagatcgaagagcttgtttcggcataacatacacagtatcacagattttaacagcacccaagctactatctcagatgatttcacacataccctttattcaattcctgccatccctttattcacaataaaagcacacaaatagatcacttcttattactaaccgatatgttaaatagcactatttgctactccctccgtttcataatatttgacaccgttgactttttagcacgtgtttaaccgttcgtcttattaaaaaaaattgtgaaatatgtaaaactgtatgtgtacatgaaagcatatttaacaatgaatcaaatgatatgaaaaaaatagataattacttaaattttttgaataagacgaatggtcaaacacgtactaaaaattcaacggtgtcaaatattttaaaatagagggagtacttaacaatcgattacatagggatgtatggaaatgtatgccagataaatggcactgtttagtaattgcttggagggttttctagatcacgcgtttcggttggggcagtgatcagaagcgatcccttcgagcttctggctagcttcacaagttagtgggctagccggtctgaatttgaagcctcactgcttctttttatttgatattagatttttccctaatattcgtgtttttagctgagcacggccgcacaagagatgacaggtgatgagggacttcaacttcttgaaactgtcccaaatgtgaaccttatatccctctttgtcaccaagcatcctgaattcctcctcgatatcatttatgtaacgcagtcggatgtcgtcaggtaccttaaatttctggaagtaggcctgctggaagtactcaggtacatctaatttgtcaactatgttcataaaatcctgaatatatctctcctccatatcttgcagtgcctttgtcttcttcgctgcccgtttatcagccatcatctcaatccgaaactgctgtgttttctcccaagcccggatcttgagttgcatttcgtggttacgcatctcgaatttctcctcgacatcattcctgaacttaagtagggtatcttcatgtaacttacaatccgtgaggtagtactcctggatatgctcaggtatgcctttcctggcataaccaagcttgataaattgttgcttgaacctctcttccatatcttgtagggcttgtgtcttcttctccgttgccgcctcctcaatccaaaacttctctgcttctttccgagcctggaccttaagctcccccttgtgatcaagtatcctggaatttcccttgaaaacggcagttatgaacttgacccggagattgtcaggcaccttgtagtcattgcagtgttgctcctgggagacccagcctgatgtgctcaggtaggtcataacacttgagaatccttgcagtctgttggttgaatttgtactccaaatcttgtaaggcctgcgccttcaacttgttgtaatcctccgaaatgtaacccttaggtggttcctcttcatcatcaggcatcctcctgaatttaatctccacatggtttatgtaacgcagccggagatcatcaggtaccttgtatttctggaagtaggcctgttggacgtagtcaggtatgtctattttgtctaatatgttcatgaaacgctgaatgtgtgccttttccagatcttgcaaggcgtgcagcttcttcgctgcccaataatcggccattgtcttgatccgaaactgctgcgattcctcccaagctcggacccggagtcttgtttcgtgattacatatcccgaatttcttctccacatggttcttgaacatcagctcctcgtcatctagcttgatttccctgatgtaggcctccttgatgcgctcaggtatgccttctatgtcaaaagcatgattaacaagtaattgcatgtaccactctttcatgtcttgcagggcttgcgccttgttcgccgcccccgccgcctccgtccaaaacttgtctgcttctttgcgagcctgggccttgagcttctcttcgtgatcaagcatcctgggattgccctcgaaaacggcattcacgaacttgagcctgagatcgtcaggcaccatgtagtcattgcggtgctgctcatggagatccagcctgaggtgcttaggtagttggtaacaggtgagaatctttgcagtttgttggttgaattcctcctccaaatcttgcagtgcctgagccttctccagcgcccacttgtcggccaccatctccaccgcccgcaactcgatcgctcaagatttttccaagattgcggtgggaagctgtgccaatgtgaagaccgaccagctttaaatcaggggggaaccgtggagagcgcttccgaagcgaaacggagacggaaaccaaccaacctgatgatcctcgctcgctcctcccctcttgcgcgcgcggttgctccccgaatccgaatcaacgatgggatcggtccaaagccaccgccgccgggggaatgtatccgcaactagaatatgcattcttcattttcagctgttaagttggatttttttttcctcgaacgattttcagctgctggattaaacgtggacgaacgggattgatcgctacagtaatcaacagtaaatcaatgccataaaatgtcgcatcgaatgtttgacacacagatgtagtattaaatatagaaaaaaactaattacacagaatgcgtgtaaattgcgagacgaattttttaagcctaattagtacatgatttgacaatgtggtgctataatgaacatgtgcatgcagggctgaagcgtacggtgatcatcacgatcgtctgcatccgctacgtgatccaacccttgatcgggatggcggttgtccatgctgcctatggggttggattattgccacacgatccattgtaccgctacgtgctgatgatgctgttcgcactgccacctgcaatgaacatcggtagtccctgaatcccatgcagtttcactcttgatttctgaagtttctgtccatgcttctaggaagatcttgatcacctgatcatgtgtcttgtgtgtgtgtgatctgttcgatccaggaaccatggctcagtttgtggacttacctgattgctgccattgcgcttacgacgtggtcgacgatattcatgtccatcctgtcttgaggttgagggtgacaatcaagaagaaccgaatttgtggtaatattcagctcacggatagcacgtaaagaggctggagacgacgagcctctcgattctcgaacgagtcgtacttaggcttgtcagcaccacatgtgtgtaggaattgaagcaatattttttagataatgaaaattcaaggagtatagactggacatagctccttacacaaacaaaaagaaaagattgggtatatatgattctttctgtatccaaaattgttgcccaattaaacttgtaactgaaatacaagtggcagaaccataggaacaacaagatgcaattcgtgtccctatattcctctttcttttcttttcttttcttttttccttttttgagctgtgtcattgcctggtttgctgtcccttctccttttttgacgcgttgggaacttggggattcgttgggtcatggctcggtcagtggctgtgacggaagaaaatttggtagaacggcggtccttcccctatccgtagaacggccgtcctacgaaattttctttcggctgtgtcgaaactgaaattcggcaatataaaagaaatagcgcaaaagaaaatagatatatgcggagacaagaatttagacatggttcagaccatctcaataagagataatactcaactccaatttcgggaattttatcctcaagttgtgtattgatctaatgatctggttgtgaatacccaaaggggtgtcctgccctccttatataggcaaatgagtagtattacaagatagaaatttatccccatacgttttaagtttacttaatcaacaactagctgggtggcccgcgcaattgcgcggctagcacccaaacaaaatcatatattttttagtataattttacttaaaatttattaaatagctatcttattgtcttaagactttgaaagaccaaaccttatcatcctcgtgtttctaattatatagtttttaaaagtcacacctgttgctaccccttatatcatttccttctttatttgcttgcttgatctaccactatttctattcattcttcttggaacctttaaaaattggattttatatttttagagtttattgtcacgttgggtttcatttttataatttctaggtgtcccgtcaaacgttgccattatactcctctatggcccatccactgtctcttctctttattgtcattgagattttaaaaatcgaacataattatcgtcttggttcagttttactttctagaagtcccgtcaaaccgtcagcggctttgccattgtactcctctacgtctcacccactgcctcccttctttattgtcattgagattttaaaatcgaacatgattatcattgttttttttttactttttagaagttctgaacctttaaaaattagacttgtagtttcattttttataatttttagaagtcccatcaaacgatgccactatacccctctacagcccgttcgtcgcctactcttattattggaattcatttcttattttctagaagtcccatcaaccgtcggcggctctgaaactatactcttatacaccccgcccgctggttcacctttttattgccgttgagattttaaaaatcgaatatgattatcaacggagatttttttttactttctagatgtcccggcaaccgccttacaagtttgcttcacggcctgcctgacgtccgtccttttaatcgtcattaggattctgtttggtgtattaacggtttttatatatcgtatcaaccgcctccaccctactcctttataggccagtttcttaatttatctcatcatgtgttttagatggtcttttctttcgataatctttatttttatcacaaattttagttatttataaattgtattcctaattgaaatcttatttttctttcttctatttttagaattttttttttaaaaaagtcaataccgtattgtgttcttttaatgtttttattttttattttcaatttaagttgtttcaaaaatgtattcctacttgaactctcttttaatttttctaattttggatattattttaatttttattctaaattttaattaatctcgtattgttttcttttatggattcttattttaatattgcttatttttaattccgaatttcaggtaattttaaattgtattcctacttgaactcttcttttattttcttttgctaattttggatttatttatttttattctgaattttaattaatctcgtattgggttcttatatggactcttcttttaaaattccttatttttaattccgaattttacctatttttaaattgtatttctacttggactctcattttcttttttcaattttggattttattttatttttatttttaattttgattaatctcgtattgggtttttatatagaaacttctttcaatattgctttttttaattccgaatttcagctatttttaaattgtatttctacttggactctcctttccttttctaattttagattttattttatttttatttcgaattttgattcatctcgtattgggttcttatgtggaaacttctttcaatgttgcctatttttaattccgaatttctgctattcttaaattgtgcttctacttggactctccttttgttttttttctttttctccgattaatgtgggaatttctagctcccacagcgaacatggtgcctcttttcaaagctgttttaataatataatagatagatagatagataatagatagatcttaatagacaaggactataggccgttccttgatacacaagtcataatcttatacatattctatatacataatctatcccctataactagtcggatagcccagccatatggcacctgatacccataatctccacaagagattgttgggcgtcatcgtcatcaccgactggccgcctcgtccgccgctaactagtgtcttcgcctttacggttggcctattacgctgtcattgttgggtgtcctcgtcatcacccaccggcttgccttcgtcgccgccaactaatgtctccgtcttcacggttggcctattatgccaccgctcatggacgtcctcgttttcaccatcattccatttcttcacaaaacatcgttaataaaaagtgacccaaagtaaaatttactctatcaatgatttttataggtaaattaaaatgtaacatttgtcatgaatctaatggtcataatgcactttaaataacttcactatcttcaaatgcatattttttttgttagataattaaaattaaagatacatttataactagttagttttaaaacatttaaaatgtaacatttgtcacgaatctagtggtcataatgcactttaaataacttcactatcttcaaatgcatatatatttttgttagataattaaaattaaagatacatttataactagttagttttaatacaaataaataaatgtgatgtaaaatatgaaaatgtcataaatcgttgtataaataatagatttgtaaaaacatatgtaatttttgggttttgttttgttgggtttattggtattgaaattaaactttgttagtgataatatatttttatatatttacaataaaatattttataatgttttaagtactatgaaaaaattataaaggaaacatattatttatcatgggatggatatgacgatttgttttgtttaaaccacatattaaaataagaggaagtgaaacgttgcagagaagaagtagcaataaaccaaaatctactacacgcatctctttctgctttctgctgtgtggttaaatattttctaaaaaaatactacaaagtataaatatagagactttgtcttatttttctcgcactcatactatgcgtaacattctctttgtggttatatttatgttaaaaaaatattgtgagggatggagataaacaaaaaaaatggatagaaggttttgctaactgaatttgtgtattgcaagtatcgtatcgatgatttattggagttagatgttaatcatatatttgaatgggctagtataaccttgcatgtcatatccggtttgttttttacctcacatgtcatgtccggattcgtattcgagggtttgtgtgatactcaaatgagagaggttttgttatttcaacggtattagctaattgtatcgcattgttagtggatatattattgtcttcctgtttcatgtaaaattttaaacaaattgttttttatctaaatttaatatatgtaaattacttttaggctttactaaatttacttttatatgtctaagaagtaacttagtgaaatctaaaagtaatttagatatattataaaagtaatttacaatttttcatcaaaatataatcgtgtgagatcttgcaagaaagatttaattgttacgaacgcaacggtgtaatcggatcgtagatcaaatgagtagtttaagagaaaattttatttgaaatataggtggataggatctctcatagatggagtggtagctggtttagacaaacgagctaccgctagctgtgtagccatgtccaattgatatatataactcatgaagcacagggtcatgtgtatacatgcacatacataaatctgaatctgtagtacatacttcagatatatgtacaattatcgaaatttctattgagtgattgatcgctggcggtgatcttttttttttcttttttttcttttcctctttggtaagtttatacatctaaagtttacatatctaacgtttatccacctaaagtttataaagtaaatgtttataagtcaaaagttgtatatacccaattcaaataattcaaatttaaattcgaattcaaatattttatattttttctcttttagtaagtttatacacttaaagtttacacatctaaaatttatccacctaaaatttgtagagcgaatgtttataagtcaagagtttatatacctgattcaaattcaaattcgaatttaaatattttatatttttcctcttttagtaagtttatacacctaaagtttacacatctaaagtttatccacctaaagtttgtagagcgaatgtttataagtcaatagtttatatacccgattcaaattcaaattcagatttaaatattttatatatataatatttctatacataaagtttatgcatgtaaagtttacggtataaaatctatgtaaatgaatgagagtattataattttttttctttttttaactaaaatttgtgtttttttaaaaaattttatgatggaagaaaagaagagaggggtaagggggagggggaggggcggcgatcaaccgcccgttagcatcacccgtgcaattatacggtagggtgtactgtgggatttcggttggtgccgcggtaagcgaatgaattagtggctggctgggtctacacgtacgaacacgtattctttcccgtgtactacctgttatacgaacacgtacgagtacgtacgccggccatgcttccatggaccgaagtgcgcgacaaaccaaccactcagactctcagagataagcccggccggccggagacgaaggccacgacaccgcattgtccatgacgatctcattctcatctagtactccctacttattttaatgtattttaatgtacgatatcgttgattttttaatcaacgtttgaccatttgttttaagatagcaccatatatcgacaccgtacggcgcagcacagaaaaccatcggcggcgtacgtgacgcacgcaggcggcggccggggcagccagccagccagcccatcggcggcgtgaggcttagctcgagcggcgtcgttcccatcttgctcaatctgctttcaagagctctctacctttccccttctctctctcttctctctcccatatgtagtgtgaacccctttcccaactcacccctctttttctacacgcgtttttaaaactactaaatggtgcttttttataaaaaaaaatttctataagaaagttgcttaaaaatcatattgatccatttttagaaaaaaataaatagttaatacttagttaattatgtgttaatagaccgttccgttttccgtgtggaaaagtttagttccaacctccccaccagcgaacacgggtgcaaaagattccactaatctgacaagaaaaaataaaacaagaagaaatttcattttagaatatatagatgaaaggcaaaacaagagagaggagaaactgagaaaggccttgtctagtttccaaaataaaaacttttcacccatcacatcgaatgtttggacacatgtatggagtattaaatatagaaaaaaaaccaattacatagtttacgtgtaaattgcgaaacgaatcatttaagcctaattacgccatgatttgacagtgtggtgctacaataaatatttgctaatgatggattaattaggcttaataaatttatcgtgcagtttcctggcagaatctctaattgtttttgttattagactacttttaatatttcaaatgtgtgtccgtatatccgatgacaatcaaactaaaaaaaaaattcaactaaacaagtccaaagtatagcacagaacgaagtaattcataccttgaatgaacccggagttgcatgttgagttgttgactgaaatgatccagttgtggctatattttccagctttgaagatcccgtcaacgagaccaaggaggagtggcagggccaactggaagtacccctcgtacaccgaacgatcactctgagccgagcacaccacaggtgacatcactgttaccacgcgaggaagagcaataaaatttatcaaaaatttcgtcattttgtgtcctgctcctcgccgccagcacagtacgtaactagctctgttctgcctcttttccgatctgcttctgcctgattcgatgaatacatatatagtgtcacgttgctagaagcacggcccttttcactattggtcgtcgttgtttgcattattgcattgcaaatgcagctatagctttcgtacgtctcccctgtccagaaatgtggccaaaccggagaggttagctatagtacaaattggaaagttaataatcctacgtgatcatatctccatttaagacctcgctcattaaagcgaaatcacgataaaatcaactgtttataattaattagcgttatactaacgtaaatgtgacgtatgatctcttacgattatacagtgtttaccgtgtgtccttaccgataaaaaaaatgttatcgtaccctaatggtaaagctcggtaaccgtgataaccatgtggttacccgtcaaatgcggaggaaaaaaaatgcaagcctaagattgaatttttcaatttttgttagacttattttttttataaaaaaaatatctacatctctataggattaattacttaaatggagttttggagctaagcataggactcaagctctagttaccataggcctaactgtgcccctgttatcccggtgaacaactataaaaggatagggaccctttgaatcgaaggaataaaaataatgtagaaatagaaaaaaacgtagaattctgacaggaacatacgtgtaaaacaaaagattacaaaacatagaaaaaaaaagaatgattgtttgattgaaccgcagaaattggacgagagagatagattcaaatgaatttttctaagaggttagagcttttcctaatgtttttctaatatatatatatatatatatatatatatatgcaatgagccattgcatagaaatttcatagaatttaaaaagctccaattctttgtaccaaaaaccaaataaaagaattcctgtaggattggaatcatatgaatttcctacttgaatcttttgattgaagggtccctaaaatttatcaacaatctaaatttccgtttaattcttttaaaagaattggtggggttacggatatttaacgttactgtacaaacataattgctacacgtgctaaatttttcttactaacaattatctcaaccgtttgatttaggtaaataaaagttatgtcttttcctaaaatatatagaagcaatatacacaggttatcaattatac

SEQ ID NO: 64393 - DNA, 19464 bp, Oryza sativa
gggcggggggacgtgcggaccacgtatttgaagggagtggtcgacgacgaccgtcgtggaggggtcgctcccccgtttcggccgttgcagagcagagctttgtttccagcgcatttactccctccgttctagcagccccaattttttttgtttattcatatattatttgaaattgctcattactaacaaataaaaaagagtataatatataccggttcttaaatttgagaggagatatcgattagatccataaacttgtaaagtgtacattcaagtttatttaagcgtaaattatactggcaatgcttaaacttgtaagcagaaaagcaggttttacataggtccacgaaccgtatattgaggtctctaaacttggtttattctattatcacggtccaaaatcttatttgatcgtggtcttgtctacgtggcatgtcatgtagacgacgacatgacatgttattatttttttccctcccttcttcctttttcatttctctcttcttcgaccttttccttcaacaacagcgatgcttggcgacgacggcggccggcgcgggaaagcttgaggtggctccagtggaggaagaagataaaagaagatgaggaaaaagaagataaggaccgccagtgtattctactctttaattaaccacagtaagtccaaacttcatttgactgaagatgaccgccaacgagacgctccacgtatgccgcaattttgcatccaatagcgataattttacatccgtccccttcctcatccaatactaccctaaatcaccccctcttccccaaatacatcaaatctagatgtatgctagagcgcaagaaagaatagtggtacttagatacacaagcgtcgattcatcttctcccccaaagttgaggtccatcgcggctgtcgtgtcaacagtggagccgcaccacacacctcctatcgaatgccaccactcgcgcggcccaaaatggcgcctgaataaccccgcaacaccgatgatcgtcggtgttacctactcccttaccattctctctcgaaactattgtattgggaaagaatcagagtgatttgggtgttttttaaggggattcgggcggggtagtactgaatttaccatcaactatgacgcagagagggcgggatgcaaaattgttgcctacgtggagcttttatatacgtttacttaacaataaaaaattattagagtaaaacttttatatacctgtacttaacaagttaaaaggttgttaaaagcaaatacagtaaagaaaactaggatgagaaaaatcaaatttaaaattaagttctaaaatttaaatttttttataagaataactgaaataatggggtgtggagttaaaaaatttaatctaaggacatcttttaacagttcttacttacacaccaccattcctattttgatcaatttttcttcatgtgcttttaatggattctaggaacacaccggtgtgttcggaacgcctggttcccaacactaagagcccgcacaaaaaccgaagcagcgattagcgggtgattaattaagtatttactattttttttcaaaaatagattaatttaattttttaagcaactttcgtatagaaactttttaaaaaaaacacatcatttagcagtatgaaaaacgtacgcgtgaaaaacaagggagatggtttaggaagaggtgctgccgaacacagccttagagtaggtacaataagtcactttagttggcgatagtgcatgcatgctaatgtgcttagttggcaaagaaattgggagagaaaaggtgtgagtgggtgactaaataatcgccggctgcacacatgctccaacacatttttcatggggctctcgatggtcagctcccttccatggttttccaaattgccggtgcggtaaccatgaaaaaccgtgtaaaatttattaaaaatttaaattattttttaaattcatttaaatttaaggaggttaccgcgatttttctattaccgtaccccgtggtaagaacagtaagtcgaatgaaccttgtcccttcccgagaagaactagtggacggaataatttgaagtgaagaagaaagagaatgactggattaaaaaataaagaatgcatgcataaaaatttatgtgtaggtgatctagtagttaactattgtatttatactactcttattaattatttttgttggtgatgtgaatattgtaggtgatctaatagttaactattgtatgtatactactcttattaattatttttgttggtgatgtgaatatttttatagctaacaacatgctgtattattagacttgctcttaggccatttctaacccaaaatactagacatagtttccataaactccactagacactacttttccaatgcaaacaccactgtcactattccatacttaaatttaatgctacttatctcacatgatgtcttggatgttatgtagaaaacatgtctcatgcaagacatagttttcttctttttcctcatttattcacttgccatatcattttctatcttagatggcaacttatttaatactatggatatcattctagtcattgggttaagaatgctcttactgacagagtactttgttattccactgttccagtgacagccaatcaggcaatcaccaatattaattcattgatatcgttcgtccattcaatcattcatcaaatgcagactgcttgattcgttgcaatcgtccattcaatcattccaatgcatactgcttagtgcgtgcatagcacggctgcatccatccagtttccagactttttttttctcaaaacttaattattttcttaagatccagttctcgttttatatcaagctatctttgcacgtcgacctcacgatctttacgggcacaaatgcatcagatattcagatctttaacaatcggtaaacttgtgaagataaccgaaaaaacataaacggaagcagaaaccggcacaaatcgtagtcgtgtaagccacggggagaggaggagaacccgaggccgccgcgaaagacggcagccgggatcacccacaactcgagccccccatggcaaaatcactctacgcccccagaacaaggccgtcaagagtggattcgttctcttgcagccgaaagaagaggcgaccaaacaagcacacacaacaaaaagaaaaggagagattgttccataagtaagaacaaaaaatattctgagaagaagatgcagatttcccttctgatgatgatgagcgagatggatgcaaagcagtaagcaagcgagtgacgaaagtgagtgtgtggatatggcgagatgcagcacgagctgttccgcggatgggaacggcaggatgaggcggcggcagcggcggcgttgcgggctagggatttcgtggggaggtctgcggcgtttataacggcgagatggggagggttttagcaaggacgtatgggccgggcccagggcgttctgttcggcctcactgtcgtactgggctttccacaaaggaataagttcatttaaggtcccttaacttgtcaacgaatttgattttcgtccttcaaccgaaaaaccagatacaacgggtccctcaactatcaaaaccagtgtagatgaggtccctcggcggtttggatggcggttttggctgacgtggcgcttatgtggctaatttgactcggtcttaatctgacgtagtattgacgtggcgtttacatggcaatttgatccgaaaaataataaatcgacccacatgtcagtttcaccaaaagaatgaattaaaaaatggtggggcccacatggccccacatatcattgtcacccctcctcttcttcctcctctctcaccgtctctccactctcctccctccaggcgccacggggccacggggaggtccggcggcggcggccagcgacgcgggagaagggcagtgggcagggcatcggcggcgggagcgctgggtcttcgctcacgacgtcggcgcggaccctgcgcgggggctcgtggaggagatcggggccgcggcgccgcccgtctccgacgagctagagctcgtgcgagcgcggtgccgggagctgcacgactgccgacgagaagcagaggaggtttgaggtgtacaggagcaacgttgagcttgttaagaagttcaactccatgtgcaatggctataagctggctgacaagaagtacgttcgccgacctgacgaacaaggagttcagagccaagatgctggggttcagacctcatgccgcaattcctcagagcaatgcctggagagagcagtgatgatattctgccgaagagcatagatcggaggaagaaaggagcagtggtggaagtgaagtaccaagaagattgtggtgtgtgagcaatagcatagtaaataaagattcaaacctgtaaaaatgttggagattaatcgatggaaatctgggtgttgtgtggatgcaggttcttgctgggcgttctctgccgtggcggcgatagaggggatcaacaagaacggcgagctggtgtcgctgtcggagcaggagctcgtagactgcgacgacgaggccgtggggtgcggcggcgggtacatgagctgttcgagttcatcgtcggcaaccacggcctcaccagtcaccacggaggcgagctagccgtaccacaccgtgaacggcgcgtgccaggcggcgaagctgaaccagagcgcggtcagcatcgcgggctaccggaacgtgacaccagcagcgagcccgacctggcgagggctgtggcggcgcagccggtgttcgtcatcgtcgacgccggcaacttcatgttccagctctacggcagcggtgtctacacggggccgtgcaccgccgtccgccgacgtcaaccacggcgtcaccgtggtgggctacggcgagtcccccaacactcccgccactgacgccccgcccttcccccgcgtcgtcggccgccgccgccggacctccccgtgaccccgtggcgctggagagaggagaggggagagatggggagagaggaggggtgagaatgctacccaccattttttaattcattcttttggtgaaactgacatgtgggtcccatgagatttattatttttcggatcgaattgccacgtaagcgccacgttaatgctacgtcagatgaagaccgagtcaaattagccacgtaagcgccacgtcagccaaaaccgccatccaaaccgccgagggacctcatctgcactggttttgatagttgggggacccattgtatctagttttcggttgaaggatgaaaatcggattcgttgacaagttaagggacctcagatgaacttattccttccacaaacttcattggcaatttttggtcctgcctgcaaatctccaatctgcggccccatttggtacagcttcaactcccaactccaatttatctagagcccaaactgtgtcaaacagtccagatccttcattttttggagcggagttggtggagcttctccacaaaattgtgctaaggggtggagctgggtttttgctgctccaccgctccactccaccccaaaagacccactaccttttaatttttagtgtatttacaccaaaatgccactgaactaccccttccaaccctatctcctccagttctctctcctcctctgtcttcctcggtagacacaagcggtcggcagcggcgggcggatggcgcggcggcgagggccacggacagcggcggcagcaggcacgcgagcggtggcgcggggtcgacgacgcacgtgcggtggcggcagcggcgccgacaagcaaaccgccggcggcagggcgggcggcgacagcgacgcctgccagctgttcgacaaaatgccaacaaaggacttggtggagtggagctaaccaatctagccaaacactttctattctacttcagctcctataggagccagctctaactggagttggagtttagagttaagagttggagtttggagccctaccaaacgggacctgcgactcacgcgcttctatcaatgcttccctcccctcccccatttttttatgaaacctaagccaaccgagctggttttatattcagaaaagtaagcactgtataggggtcaccaacggtgacaggagaagaacaaggggaggtcagcacaaagggaaaaaaatacagcttaagggagtaaactaaggtgctattctcgtgaggatttttgcaccacatactgaccatacatgatttttttccaggatttttgccactagctgagggatttggagctctgtgtctttgaagactcacctatttctctcgcaccagatttcccagcagaagagcatgtgtagcgattgcatccctttcgtgtgaaacttgctttgctgctgtgttgttcttgattctcaccaatcgattagcctttcttccgggttatgaaccgggaaagattgatcgtggaccattcttgccgtcgctttgtcccaaatctcccgcgtgaatggacagtctttaaataagtgttgcgccgtcttcaaattcctgtaacagaattgacagaaattgttgtttggccactgctgaagttgcaagcgatcggctgtccatattttgttttgtaggagtagccatgcaaagtttttgcatttggatggcacccatgtcttccatatgaaggtggcagcccttaagtcttctctgccggcaaattgagccaaataagctgattttgctgtgtgtttgccggtatttgttcatctctaggtgatggtgtccttgatttcttccactaggtttatctcccaggtgagattgaacaccatgaagtacgtgttccaacttccaacttccgacctcctagtagttgagcaccaactttcgttcgaagggtagcttcgtggcatgcttcatccacaacaaccagaacctatggtttgattttgtatactacttcctccgtttcacaatgtaagtcattctagcatttcccacattcatattgatgttaatgaatctagatagatatatacgtatagattcattaacatcaatatgaatgtggaaaatgttaaaatgacttacattgtgaaacggagggagtaagttttatggttaatgttagatactaccgcgagaagatgcaacaaaacaaagcaagaataagagaaaaatatcataggggtggatccactcgcaaaagacctcatgagctgagcaccagcttcagtcgaaagggtagccttgcgacagtcttcgtccacaacggcctggaccggagcaagagcaccacccaagacgtggggtgttcttctcttttcacaagcacggagtgacaagaatcacctagaaatcaaacccatgccttgaggtcttgggcacaacttggtaggcaacgggccattaatctaccagtacgtcggcggggaaatgtgaggtcgatagtatctagcattgtcaccatacacgctattataatatcgatatacgtagaaattaatgtattccaagtgaatttagtaaacttttagttatgtgtcaccaagattttattcaacatcaaccataaaatcaggtttcattgaaaattccttaacaaaggagaggatggatggctaattttcttaaaacacaaaagctttacgcgtcaatatattatagaagctatgaaaattcatttacaagatcgcaccatgctagcagcaggaactagggagtgggaaggttacaacgacagaaaactaagtgagacatacgccaggaagatacaaaagatagggaggggagaaggcaactacggggtggtagatactcgcaacagagctccagcgccgggctctgatcagactcaccagaggtgcgtctcctacaagattccatcgaccaactggggataggccgatagggtaagcgtttctctctttccacaggcaccaggacacaaacaacacaaaatgagtcgaggtcaggcgatgtgtaattgggcggagtttagttccaaactttttttttaaacttccaacttttccatcacatcaaaactttcttacacacataaactttcaacttttctgtcacatcgtttcaatttcaaccaaacttccaattttggcgtgaactaaacacatcctggtcacgcatcgtcaaacgctagatcaccatattcttttcaaaagaatcagcaagaatatatagaacacaaatgtggaaattgatacattcatatataccaccacacacagattgatgacatatagttacatgctcgatctgtacataaatgaaactcaaagccccaaacagtcacacgctaagcatacacgtagtaacacgacacaatcttctcctcagtacgaaaacaacagaaatcacacaagaatccaagagaaaacatgtacacttgagtactgaggagaagatttgtgttcggcgccacaacccttcaggctaccaaccagccgcttctcaacatcgcagcaaccggattcacgttcggctgctggctaatcaaaaccttgggctcggaggccgcgagcgtcgcggcgtcgacctctcggccttcgccttgctcggcgacgggacgctgctcagcctgtccgcggagcccagggaaaggcgcctgttgatcaccgacggtgaggtcacctgatggtgatcgggcgccgtcctctcggcggtgacggggacctcgatcgccgccggccgagccgccttggccttcacggacttggtcgtctgcatgtagctcggcgtcagcggcgccgcgtcgtctctcgccgggccgccgcctcctcctccgaggctcagcctcctcggcagctccccggaccgcaggctcgtcgtgcgccgcagcgagaggaggacgacgccgcccttctcgccgtggaccgggctgacgctccccgccgcgcgccgctcgcagctccgcggccgctccggctgcaggctcgtcgtgcggcgcaggccggtcgtcgccgtcgccgacctccggaacgggctggcgcccgggctcgacggcggcaccgccgacgtcctccacggcgaccgcggcgtgggtgtcgacggcgacgggcagctcggcgggcgggtgaacctggccaacgccggcgtcgacgtgggtatctgcaccgacatgggcacccgcctcccgctgccgccgcctttcaccgccgcggctgcacggccgctgttcgccggcgtggtctggctctcccacggcctcgccgccgccatccatcgctccgcccagctccatccccagttggggttgccggtgtccatgaacattggaggcggcgaggctcgcgcagatgaaggtttcctgttactccactgctcgcagaaaccatacaaagttcagaaaaaagaaaaaacgagcaagaaacaggcgatcggatgtactccgtagcacggatataaccatgtcacctgatgagaaaatgcgtatgccaacgccctttgccgccttaaagcggcttcttgcttcatcgtcagcacggtctcaatctgctccttggactgatgtccatggtcccagctttcaccaatctgccaagacattagcattgccagttttctttactgatttgttacaacggcaaaagtatgagttttaaggatacggatttttcatccctcgaagagatatcccctcgttatttacatatcatctaaatagttagtattaaaatattttttaaaaataataatatagattaatatgaaatgtcactttacaaacatgcacaaccaaattcgatttttacaagttacaataaaaagaacaaattaaactgaaaataattatcttacattcgtatctatatttgtagaagttaagttttaactcatgtttgtggagtaatatatttcatattaatttatcttgtcatttttaaagtctttttgataactatttaagtgacatgtacgaattgagcggatatcttgtgacgaaatgactttcctcgttataaggtctgaagatgcaaatgacaacagcatgaaacgatgcgatgagtgacaggagcaagtgatcatcaatgcattattgcacctttattctgtcaaggctctgtttaacgtggacctggcttttcagggccttcttgtcctcctccgtcttcacccgcctggagtgtatctgggtctggaccctcgtcatcgtttgcatgcagtacaaggcttcgtaggtctggcgcttcacggcgagcccctccagcagcagcatcaaccgatccaatcccctcgcccgttgcgatctccttccctgccatcgagtgttaaaatgttcccaaatcaaaccatcacgagccatgaaaccatttgagatcggcaaaaaaaaatgatgaaacgaacagcagaagagagggtcaattaccaggtagaccctgcatgctttctgaatcttgacggcggcgagctcctcggcggaacgcgccggagctcttggcgcggtggtcgtggggcgggtcaccgccgtggccgtggccgtcttctgtgcggcggcggcggcggcgtccgaggatttcgcctccttgatcccgtcatcccgctgccgatcaggcggcgcagcttgtggaggaggaggatgatgatggtgaggttgctgccgagccgacggagaggtcaccggcggcgacgacgtggacgcgctcgacttgctgaattgcagtatcttcttcagggtcgacctcttgcccttctcacgttcgaaaacatccgccgatgatcagtcaagttcatgcagaattgcgcatcggcgatcgaagaagatttgatggtgagaagtagtgcgatttaacttttttttttctctgtgacatttcgttaccttcttttcgttctcgtggctgtcattctccgacgtgctcagggctctctgcacggcgtcgaaccacttcccctttttccccatctctcctcttctcggggctaaattaacgctggcaacacgagttcaggggttgtaaaagaaggtgaatttttctcaccgttggcgccgccgggatggacacgcagttattccggcgatcaacctcgacgacggcgacttatccgccaagccgtgggccccacatgacagccacctccgaatggcgcctgtccctacattccagtatgtccacaccaccccctcgccgcgataaacgcgcgcgcacgttttttttttaactccggctcgagaagtctagtactagatcctctccgacatccgtggccccacatgtcagttccccgtgccaccgtatgggcccgtggcccatgggcccaaccggcccggcctctcggtccatttgctctcgtctgcctctccgaccacgaccagagctcgcctcgccctcgccgattaccagttcaccacgcccgcgcgcacacggagaccgaggccgcgaaaaccctagcgccttcgtctacctccagctcgtcgcgcgcggcggatggtgatgagctcgcgctccctcagggctcgcgactagggttctcttctcactccatcgctagcggcggctcagattgggaggtattccggtgtttttttggtgctaaattttgccccccgtattggtgttttgcaggtgacgcgacgctgcgattgaggtcggcgccggtggccgtggatcgcggcgcgatggagctggagggggatccgaggctggtcggcgttgcgttgggggagtacttgacggatggggaggaggtgatggtggtgggaggggcgggggaggtggccgtggcggcccgtgtggtgaaggtggatggggggaaggttgtggtggccatggatgaggatgccgctgcaggaggtggcgtcggagtcggagtggtgagcgatttgctgtacgcgacgggatcggcggcagtgggtgaaggatacgggggtgagtgtactgacaacatgcaggagctgctggatggaggtggtgcagaggagaggatgttgggagtggaactcggtggctttcgtggtgaggcagggtggacgcttatgccggtaggagatgctgctatagagacttcagaggaaatgtctgatcctgtcacactgcaatactctgaaacaggtaaagctttgctccaatttggtcactgctctgatcaattgggatgctctgccggttgattctgacatgttgttatcatcacctcgcatggcgtcactgaatagtataattgcagggctcacaggggatgatcagcgtgccaaataccgcctccctcctcttgacggatatggttttcgagcatctggtcttgtgtggagtaaattgaaaggtcatccttggtggcctggtgagatatttgatacttcagatgcatctgagttggcactgaaacaccagaagaagaagggcagtcatttggtagcatatttcggtagcaatacttttgcatggtgtgatgaatcccagttgaagcctttcatgtcaaactattctcaaatggcgaatcagagcaattctgatgccttcattagttcagttaaccttgctcttgaagaaatctcaaggcggatattgtcagggatgtgttgcttttgtcttccagaagatctctctgacaattgcatgtcttacatggttgagaattctgggctcagggatggagttacttgctctaaagttacacggtcagagatcttggaatgtttcaatgcagaaaattttctaagttatctcaggtcattggctctgttccctggtcaaggaggtgagctgctggatttagtgatagcatgctctcaacttacatctttctttcaatctaagggatgccatgaacttgcatcatttggaagtggcagtgagttggttgatgatggcatggactcttcttccaccaagaatgtcttgttgccagaagctgtcacctatgaacagaaacctagtgaaggtaagcccaaaagacgtaggataaaaacttgtgttaaaaaacctcagaatgatttagagttgacagaggaaaatcccatatccagtttgaacaatgagtgcacttttgttgattgcatgggcttgaacatcattgggaaagttaaagggaagagaagtgaaaagaggagaaaatatgtgccttctcctgaggtacatacaactgatcatgggcaggacgactcctggtctggattctgtttaaacaatgatccaactgataccctcggggaagcaagtgccaaaatgaggccaagacgtaagcagagatcatcgaaagaaacatgtgcaccttcatcagatctctcttcccatgtaccacctctgcaacttggattgcttggtcctaagaaacagatacaactgatagaaagataaattatccatgccgatgaacagagaattgatgagatcatgccctccgcacttgttttgagttttggcagatcagctgctcttccctcaaaattggatcttattaggttgttcagtcgctatggacctctgaaagaaaatgagactgaagttcaccagaacacgaatactgttaaagttgccttcaagagacgttttgatgctgcaaacgctttcagtgttgttggcaagtatagctattttggaccttcgctttgtagttttcggcttgtaaatttgccattttccctatccaagttaagccctgaagatcctggcacggaggttcctggtaagcatctgttagttgcattcacaattcaatgagcaaaaatataagtcttacggtaccttatgatatgtgtttcttgtagcttgtagggagtctggagtggatattgtgcatgttggcatcatcagcaaagttgataaagctcaaaatctgtagagaaagcatcagcgtttgatatggtcgatccagcagggcgagctaacaaaattgtaggtgagggcacggctgaagaatcagatgagaaaatcagttagcttttcttccattaaaacttgtttatattcaggtttgtctgctagatgaaagtgttgtctcatccgggtgatgcattttgtatagaaaacgggaatccgacactagtattaaaatgttagtcttcagtaactagagcatgtatatagtcatgctttttctgtacaaacttaaggtaaaccactgtccgtttatggcaattagatatccttctgaccatattaagattaaatcaagtaggggaacccttggttgtttacactattcatgatcagctttgggagcttttgggcaagctactgagatgtaacttgtgttacttgtcgtctatgataagagaatgcactgtctaattcctcgttgatgccggaagctaattgtgtttgcaccactgtgggtctgtggcatgaggtatatgaacttaggacggttccattttgaaccctctcatcccttcagccctggaatctgtgtgctactaactgatttgcagccttgcagatgagtgaagtgttggttgagctcatttatcgtaaatttctattctattggagagagatcacaaatttctcttatccattttttttcctaatgtcatttgtgatattgattctcgatgttagctcattttatcctcttttttttggtcattcatcaatgtcttttatacaactataaacgcaaatgttctgtgaagaatcaagaattcatggcgcgtgatcttgatcgagatggagaaaatgagagattgatcgacgatgtaaaggaagacaactgctagaaatcaagcaaaacataagcgatcttgggcttcgttggctatctacgctacgcaattccgtatgatcataagaccatttctgactcgtatgcacattgcctttgacgctgaagtagcgtgctaacagccacgacgcgggtgaaagagagaaacaaactttccctttttctgaggatagagaaacgaattctgtggaactatttttcaccactttaaccagaatttttttataactttcaatataattttttgaactttttaatcgaaattgaaatttcacaaaactttaggtacttcgacaaattattgtaaaactataggtttagcgcaaaatttctcacgaaactacatattttaagatggtgtcataaaaataaagattaagtagttaatttatcataaaactacaatgtttatagctctaacataacggcggtgtaaggaatttaaaccatagaatgtgtaattttgtgataacttcaatatgagatttgtagtttttgtgatatttaaccttaaatatgtagttttgtgataaatttgtcataaaatctatagtttggtgatagattgatcaaaagaacagtggttttacgaaatttactcatcaaaaaataactcccactacaaagtttttgattactttcaatacaattttttataactttctccagattttttttacaactttgataatacaaactttttttttactttcaatacattttctaataacctttctctgtgaagaatcacattgaaaaataaaaaaatctataaaaaataatgtttgcataaaaggacctcgtgcaggcttagggtttaagaatgtttttttttttggttggctccaatgttaagatcatgaggagagagatgagtaaaacttataaatagattaaaaaaacaaaaaaaatcaaacaaacatgtaaagctgagatgcacaaaccatagtttttatgcctcttttatactttcatacagggttttcttagcaaagtgttaaactgaatgaatcttgttaccgttatcttattaatctcaagtgctacaataggcataccgagttaacaaaagctctctttccaatatagtcaaacaaacaaagttgtaattatatatactaaacaacttaaaattttacaaactatttatttaactggctaaaaacgcttctcataaaactcgccaataaaaaagataaatcatttataattgcacggtgtgtacgacactacctctaactcataattttataccataactatcaatagttaaaacaatatattttataccgtaccttaccagtaaaattgtatactcggagcattagtctattaaatataggaaatcactatcttatggatatgattttaatacaaacattcatgtagtagaaatatcacttttttgagggatcgaaactcgcagcccttgagaaaacaattaattgtgtaattgtcataaacaaaaaatcatacaacactcatcaaatacactatatcataaattatgatataggagtagtactactttgttttccttctggatcaactggttccatcccatcttggcatctttccttccattgcctctctccacggtctcacctcaccgtgcaggttgctgtgcaccccccaaacgcaaacgcgatagagacgctcacgactgcacttcctgcaggctgcactgcactcgcacacacctccaccctcctcctcccctcccccctgttcactcccgcatccaattcccccccatctctctctctctctctctctctcatccatcgccccgaagtcctcctcctcctcctcctcgaggacctcgacaccttcctagctcaccgcgcgcgcgcctcgccctcctacgcaggtaaacccccccgccccctcgagctcgccatcccgcgctgatctgcggcctagggtttcagatcgagggggggaaattccgcgccgctgaccttctcccgcctcgatccctgcagattccttcgccggtgggggtggggggagaacggcggcggcgttgttgcgatgagctcgacccacgtggctgtcgaggccccggatccggggggagacgggggcctcggcgaggcgaggctggtggatgctgatgctgctgctgcaccggcggcgggggatgcggaggggagattgggtggtggtggtggtggcagctcggcccccgccgctgcgggggacgctgatgtgacgatgacggaggccgtggaggaggaggtggaggtggaggttgcgggtgatgccgaggcggaggctgcggtggtggcgggggatgcggcgggtgatccgttgtatgggacggagtcggctggtatggttgtggatgagcccgttgacgccgccgagggaggggtagatgggggagatggtggcgaggaggggttggaagcggaggctagggttttgcagggtgaggctgcgacggagcccgttccggcaggaggagatgttgccattgcttctgaagtggcggcggaagcacatgattctgctactcctgagcatgccgaggccggtaagcggaccgatgacagtttgatgtactgtctcttactcctttcgcgtcgctgaataatggttactacatttcagaatccaatgatctcgaagaaaaccatgttgatagaggaaaagataatggcgtggcggtggcgcactgtgacgacgaaatgcagaataatgtggaggggagctccgagatccaagaagatgatggagctcccacacttgagcagcaggatgatgagtctgaaatgcccctgccttctagtgtgtcgaattttgaattatgcgctagatacagccttcctcctcttgataaaggagaatttcgagtttctgaccttgtctggggtaaagtaaaaagccatccttggtggcctggtgagatttttgacccttcagatgcgtctgagttggcattgaagcaccagaagaagggcagccatttgatagcatatttcggtgacaatacttttgcatggtgcgatgaatcccaattgaagccttttgtatcaaattattcacaaatggagaaacagagcagttcagatgcctttgttagttcagttaactatgcccttgaagaactctcaaggcggatattgtcagggatgagctgttcttgtttaccggaagagctatctgacaatgggatgtcctatatggtcgagaatgctgggctcaaggatggagttacttgctctgcagttaaccggtctgagattttgtcatgttgcagcccagaaaatcttcttaattatgttaagtctttggctctgttccctggccaaggtggtgacttgctggaattagtgatagcttgctctcaacttacatctttttatcgatctaagggatgccctgaacttgcatcattccaaacaggcagtgcatgggttgagaatggtgtggacccttcttccatcaaggatgatgtggttgatgaagttgtcactaatgaagagcctcctgctaatgataagcccaaaagaggcagggggcgacctcgtaagcagaaacctcaggatggtctagagctgacagagaaaaagtcaacatccaatctttctactgataatgcctatgatcatcctgcggaaaggcagatggatatggagtttgatgaatttgacggtttacagagcaagaagaaaagaagccttgactcgtttgaagatcctgagaccaaggcggcagctccatcttttggtagttctttcaagatcggggaatgtattcggcgagctgcaagccagctgacaggatcttcatctattgtcaagtcccagaatgaacaggtgcctcataagaacatcgctgaaacagaaaatggagattttgatgtctctagtgatgatgctatcaatgagcttagtgtggagaagcgtgcaaaaaggagacggatgcataggcaccacagtgcagaccccaaggaattgttatcacagctgtgctcagtggctgtggagccaacgcacggatatagtttctctgcaatggtaattaattacttcagtgattataggaactatgttgtttctactactactgaagcaaatatcgttgagaaaactactgcaaaaaaggggagaaagcggaaggttatgccttctcctgaggtggagacaactgatcacatgcaggattcctactggtctggcttgagtttgcataatcacccaattcatgatctcagaagagcgagtactagcacaaggccaaggcgcagaaggagatcattgcgggaaacatatttccatgcacaacaaaatctacagcatggactattgagtcctaagaaacagatacaagtgatagagagatcaattatccatgttgatgaaaagatggttgatgaggtcaagcccactgcacttgttttgagctttggtaggtcaagtgctcttccttctgaaactgatctggttaagatgtttggtcgctatggtccactgaaagaatctgagattgaagttcatgccagctcgaatactgttaaagtagtcttcaagaaacgtgctgatgctgaaagggctttcagttttgctggcaagtttagtacatttggtccttcgctccgcagttaccgtcttgtgaatatgccattttttctcagctcacaaaccaataatacagaggcacactctgagtaccatggtctggagattccaggtaaacaatccttctattactttttgtaagctagtgtaaaagttggttaacattttagaaaatatttgcatgtttaataataccacagggcatttttttttttgcaggtcccaagtga

SEQ ID NO: 64394 - DNA, 6483 bp, Oryza sativa
ctccgcaagacctaagacataaacccggggctcaccagtacaaaatcaactactttcccaattcccaaccacggccaccaaagtctcctcccgctcccggaatgcggcaaccccgacaggttcctccccccgaaacttcaaaaccctaccccgcctaccacgattcgatgatcccgccagagcgagcgcagaaatcccgctcgatcggcgcccaaattggagccagaaaaaaaaaagcaaagaggggaacgctcgcacgtcacgtaccctggggtccttccgggatcaggaggatgaggaggaagacgaggagaggaagctccccaccctggctcaggctgcctttggcctgggctgtggggattcggaggaggcgactcgaggaagctttaaaccgaggagaaagagagcgagagatggagagaggctacgggaacgggagagaagaaaccttcggtccaaaggcaaatgtggagtacgactacgagtgtatgactgactcggttcggctgcttgctgtcacgcggacgcggcgcacgacacgttagcaaactttcgtgggctgtgccgtgaccgtgaagacgaaagcccacgaagaaattcgcccccccacaagcgaagtgtatccaggccgcccggccctagcctcgtcgcagctctccgcaggcggcagggatcgcctcccgcccgacccggcgcggcggtgatgatgtggcgggcgggtggcgcgtcggggtcgtcgtcatcgagaggcacttcctcgtggatttgtatcaggtgcagttggtactatcactataacttacgcagtccactgccacatgttagatccgaatctaacggttcacatgcacccggatactgtagaacactgtagcaagaaatgttcagtattttttgcgtcagtactgtagctgaagatctggtccattcatcaccaaaatgaacggttgtaatcgcatgcattagtttaacttgcagtcgctattcctactgcaagtgatcccaatcccttcctcgtccgcaaccgctgctcaagatgacaaagatgtgttgaccaagacgagaaaaatgtttttctatgaacaacacattcttgcatttagagaaaaatgttttatctctaaataaaaaatgttttgaataactaaaataatgaaagatagtggaatcaaagattaaaacatttttgtttcacacatggaacataaagtttacaccgtttgaacatcgacagattctcaaagaatagatgataaaaatgtaaaacaccattaaaatacacattgcaatatttcaatttaactcaaataaacattaagataaaatagactgaaatatcaaaaatcacaaaatttacaggtatagatttggcttatttctcttctccggtggccaaatctagacccacgtcggaatggttaagcgatgtggtgtgcgggcgtccaacgcgaagagtttttgatataatacgggcctgtttaggtcttctggcaaaattttacaccatgtcagatcgaatgtttggacatatgcatggtgtattaaatataaacgaaaaaataactaattacacaaattacgagacgaatcttttaagtctaaatgcgccatgatttgacaatgtggtgctacagtaaatatttgctaatgatggattaattaggcttaataaattcgtctcgcggtttacagacggattctgtaatttgttttgttattagactatgtttaatgctttcaaatatgtgtctgtatatccgatgtgacacgccaaaaatttacacccctgatataaacacaccctacttcagtacttgtatatattaggcatgagtaggccgtactatgtactcacatttgttttccatcaccatttgactcacaaaacatcatcactcatgcatctttacctcccattacaaaaggacgatgtactggagatctggaatgcaattaataatattatataaaaatcactccccgtaccgtaataagttttctttttagtttctttcatttgtaccaaagtaagttcatttataaagtagtcattgcatgaagtttgtgaaactagaaaataattgtattgggagtattgataggccatgtttagttccctaaaacttttcccgaaaacatcacatcaaatctttggacacatgtatggagtattaaatatagatacattaaaaaactaattgcacagttagggaggaaaatcgcgagacgaatcttttgagcctaattagtccatggttagccataagtgctacagtaacccacatgtactaatgacggattaattaggctctaaagattcgtcttgcggtttccaggcgagttatgaaattagttttttcattcgtgtccgaaaaccccttctgacatctggtcaaacgtccgacgcgacacccaaaaattttcttttcgcgaactaaacaggccctgatatttttataaagtaggtatattctatttatgtttgtttgtattgttacatgggttagatgaaaaataaacttattttgagatgggcggattatgtatagagtaaggccaagttcaaacacacatgaacaagaaaaattgcaataattggagtagtatgtttttcaattctacaggaattgaaaaacacatgaaacaaaagatgacctttttgattaaaccataggaaaagctgaaccaataaagtttccaagaggtttaatctcttgcttattttcctttggaattggcactatgaacacaatttctatggaaagtttcatatcttcttcatgtgaatcagaggggtttattgggaaaaaaatacaagggaaatgaatcctccaaaaatcttttgccaatccttcctctaggatttgtttcctatagattattttttttgatacaaaaattttcatatgattgtaatctgctgacctgttccatgggaaaataagcaagaagttagacttcttggaaactttgtttgatttattttttcgtgtgatgcaatcaaacagcatctttcctgttttttgtgttcttcaattctggtagaattgaagaaacacaacaattaagtctctacatttttttttcttcttatatttttcttatcatgtgttttaaagggtccttacatttaccatgcatgtcaatgccttttcaaatactatcggagtatcgaactatataatttaatgtgctaaaaagaagccattcttgcgactgaggtagaaatttccaccgtcatatcatattgtcacttgcgaaaaggattcctgctaatagaaaaaaagataagaaaaaaaaaaggaggattcctgcttggtgagtgcgcatagtacgaacgttggaacttgaagtctccaccaccttgctcttttatttttgcatcccagctgcttatcatcatctagtagtatcattctactatcaaggtctccaataaggagttcatgtagcccccaaaagattaagcatattattagccacttgcagtataatgtccccagaaaatcatttacaagtacagtctcttcgctccgttcatagtctttgccccttttggaataaagggcagtgtgtggaactagctagcttatgcacacagcaacaagtactggtgctaaacgattagtggaaccgatccttttttagtgacacaattttgtagtaatatcagccgttagtgcacaactgcacatcaatgatgcattcatggaactgagtagcttggacgtacaattatcatcatctttaaatggtgcagttctttctgaaccttccattgtgacaactgtcatttgagttgatcgagcagctaatccacgcattagagagctgtggggtcattcggccggccgcttagtttgtattgtagttttacagggttttgtcttatatcagctaatcctgcaatgttaagtttgatagtaacctgcattcatcactcgagtggacgaagaagaaatcggcacagtaagttgtcgacgggtttgtacatcacatgaacttgtccctctaataatattggtggacgcaggattttgagagtgtgggtattcaagatttacactatgaaattgaaacaataaacgcttgtgttactaacggaaatatgtgtgttttttttaattaggtagataataaagtacagaaaaatatagtagaagatgaattatcttgttagcttaccatgattttaagacatgatagatgtatttttcaaaaaaaaattgtcttgcaaaagaaaaaggaaaataggagaaaacaatcactgtaaaaaaaagcaaggcgttgctgagaatctaagggcctgtttagggagttttaaattctgagaagcagctgtttaatagccagcttctgagaatctagaaaaactctgaaacccagcttctggcttcttatttcatttttcaaaatctgtaactatagattctcagaaactatggactgtttagggtagcttctaacataagcagtttttgggaaaagctgcagctagaacaagcttcccaaacaggaactaaggcttcaccactagctaagattcacgggttaactaaccgggcaacaacaactacaagttcagcaagtcagtagtatagctaaacttttaagaaatatatgtgggtattcacttgaatacctatgattaggatgtactccctccgtcccataaaaaaccaatctagaactggatgtgatacatcctagtactacgaatctaaacatatctctatccagatttgttgtaatagaatatgtcacatcctggtttagatttattttttgtgggacagaagaagtaggcctatgctctctgacgcatggggccatactgtaggggtggacatctcacctgttagggacttatatctctctgattatatgtcgaggagttgcttcaagttgtttggtttgaggtttgaacgttaatccattggctatcatcgaaagtaaagtaatacctctgtctaaaatataataacttttaacacctagaatttgtctcaaaatataacaatttcttcatcaacattcatttctcaaccaatcacaaccctccaccattcacttttcttacctaccttcacttctcaaccaatcacaaccccttcctatttaattcttcctacttttataataatcgtgtccaactctaaaactctttatattctgggacggagggagtagcaattattatcatacataaaaagatgtaattgggatgaagcatatggtttctcggcacaaacaaaactaaggggtgtttagattaggggtgtaaagttttggcgtgtcacatcgggtattatataaggtgtcacatgggatgttcagacactaataaaaaaactaattatagaatccgtcagtaaatagcgagacaaatttattaaatctaattaatccatcattagcaaatgtgtactgtagcaccacattgtctaatcatggagcaattaggcttaaaatattcgtctcgcaaattagttataatctgtacaattagttatttttagcctatatttaatactttatgcaaatatttaaacgttcgatatgacagggtgtaaaatttttgggtgggaactaaacatggcctagcaatctgaattttgcgtccgcctcatgcgcctcggtaaaaaaaagtattgtcatcctctacgatgttattgctagtagtaaatagtaatatatatttttttataccgcactaggtatgattggtttttttttgggtagtatacatatttggagtggaagaagtaggctattagagaatacgaatccaatgataagattatttaagttcactattggcttttttgttttcaaaagccatgtcgtaaggacaaaaagaaaaacttttactgataaattattatctgcctagttttgatgatttatcaaactgttatcatgaccactatgtgcaaatgtactatgcatgtaaaccatttcatacccattgtttcgctcgcctatagctgattatccctaaatcttattaacaacaatagtaatttatggataaaacttttaaatatgtgttttttgacttgtaagtagatattggaaaacaaattatactgaacaaactattaagataattgaagttttaatattgaaaattttgactacggctgataagttgatgatctaatttgcacacaaccatattagccgctagtgtgtccctttaacaaacacacgataaatgtggcgaacaataaatttgtcaacctccctaaatccaattgaaaactaaattctggcaacctagcaaaatgcgtgttagtgattgatgtactccctccgtcccataatataagggattttgagtttttgcttgtaacgtttgaccactcgtcttattcaaaattttttgaaattattattgtcggtgacatggggccgggggtatcgtgactagaggcttgggtagccgcggtcacccacgtggcctgaccccctcggggg

SEQ ID NO: 64395 - DNA, 6078 bp, Oryza sativa
gcgcgcgccgagggaaaggaagagggtgagagattgggagaaggcggcagagaggaaaggggagaagctgaagggagcggaagagacccatggatttgtggggcccatagcggaagaccacacggcgacggcaccacaactggtattgttgcactgtagagcggaggcggatagaattttcctgtatatcgcatcggatagacctggagactcctgggtactattcgcctgtagcacctgagatgcccctcccaaaaactataaattctacagatttgccactcttacgagtggttctaaacgatttgttacttgactctatgtcatagacacataagggcccacatgtcataggcagcgagtgacaaattcttaattgccacaccttaaaagtggcaaataattaaatgtccttagtcgacgacgacgatggtagaaaatgtttgggttgccagaaaaaaaagagagagtagagcttcgcattctcctaagtccatgaagaatacacaatcttgtaaatgttttatacaacatctcactatcatgttgtgtctcagttatgaagaggcaaattgaaaaaaattgtgaatacataataggtctatttcgttatccttttgctacagctgtgtgggctataactacaagccagtaacggtggtttatatcttgctgactacaatcacaacaacgttttagcatcacctaccaaataggcccaatgtaaaaatatgattcggttagaaaaaccaacctatgcaaattatggtgcatgttcctcgcatcattcttgctaggcctcaacagcaaagagcgaaacttataagcatcggttattgtctttcttatgtcataaaattctatcgatagaacacaggtagtagcccaatgaatgcatgcatagctagtttgtcagattcgtagctagaaaataactacattttttggatggagtaccaatcataagttaaccagctgcctcagcaattgagagttgaacgaattttgtaaagaacgcccagaaggttgggcaaattacattttgagaataggaatatgaaagaagagctaaaaagaaaaagaaaagaccatcaagttcttgtctcggccaaatctaataggaaagagaactagtgttgagctgtagaagatgatggggacggctaatgggcgatcgatccccatctcactgtacactcctctccccccttcctccctcccctttttttcttcctactacaccataattttttttaaaaaaaataaggggaaaaaatttatgtatagaaatattatatataaaaaaaaattgaattcaaattcaaattggaaacgggtacgtaaacttttgacttataaactttgggtctataaactaatatttgaattcaaaatcaaatttgaatcgggtatgtaaacttttgacttataaactttgggtctataaactttaaatgtatagaaatactatatataaaaaatatttgaattcaaattcaaatttgaatcagatataattcaaattcaaatttgaatagggtacataaacttttgacttataaactttgaatctataaactttaggtgtataaactttagatatatagaaatactatatatataaaaaaattgaattcaaattcaaatttgaattgggtatataaacttttgacttataataattcgctctacaaactttaggtggataaactttagatgtgtaaactttatgcgtataaacttaataaaagagaaaaagaaaaaaaacaaaaacgatcgccgccagcgatcaatcgctcagtaggactttcggaagatgatgcctaggctcgaacatgtatggggcttccaagaatgggaggttgaaggagttttggcaagcaaagataatatcagtcatatcttatatatctctcactggaaacgaaaaagaaaccatcaccgatgcgggaagcttgtaggagaagaattgagcgatcgtcatgaccttcttttcgtttggatagaggacaactggacaagtcctcaaccccaagaaaatcagctgaactcccaacggtaggcgttgatggagaacccaacaaccaccgtccatgaagtcctgcatgcctatcaagtcatgacaagaatagccaaatgcccgtaacctcttgagttgcataaagaaaggaaaaggaagaagaacgaaatgaacagaagtacaggtttaacccaactagcctgcccctactagggaccaaagaaatcctatccatcattctcccatcacgtgacggtgagccaccgaaatcacaaagagggacataaaggttggggattttcgtggtgctaggaggttcgcaagagctccataaaagaagagttttcagtttgttagtactttacatttgtatgtgtagtttgtgtaggactatgggtaagctagacaaaaaaaaaatccacggtaggaaaccatgaaagcaagagatcatatatcgttaccacttaacaagcgaagcaatgggacgagagtcagtcagattagccctgtccagcggatcatagatcatttagaaataataatgtatcaaataaagagtcctacgattaagtcacattcttataaattaataataagttatctatttcacaaaacagaataatactttattcatttcattataaacatagtatatactctatagtatatgatacaattcgtctctctagggcatatagctgatagtttgcgtgctgcagctcagcttgcgtgtgtgttgattgtgttcacgtcaatttgttttccaatagtaaaggaatcgctcctgaaaaggaggataatgcctactagttacaaacaacaaggacaaggcccagttttgcccttaaaaccttaaaataggattaaattgacctacagaatcctttacaagctacaaattcttcagatattagaatacaccaaaaaatgtggcaacagcaaacagcaaaaaaagtactcctcctatcaggccaacctggaaaattgtacattcatgtaagtgaaatacccaaaaacctaaaacacaataataccgagagcattaactattaaaccaaaacaagaaaccaagttaattgtacaaaaaacttttaccagcttctcagataggtagttggcaaggaatgctcccccaacaattgcaaggaaagttgcaaccaagtgtccagctatggctccgcttgcgacaccaaaaggagactacaaaaacaaagacatgttttttttatggtaatacaaatctaaactaaattatacatatgcattctgttgccaagtccaaaacaaacctgagcagcacctaacgcaattgtagccagcatagagcgatctccccattcctgccagtaaaaatcatttggtgagcaataaggtgttagttcactacgccctttgttaaaaaatagaacagctattttgtttcgttcaaacaagactttgaccaaccaataacctattagaacataatttttgtgacacaaaatttatgttattagattcatattcggagtactttcgtatgattatgcttttgtatggcataaatgatacattagtacagcaatgttagtcaaagccttattgtacatgggaatcaacttactgcaaagaaaacaaggctgaaagacttccaaaggacctcaagaggactagtcaactttttagccacctgccacaaagtagaaacaaccttcagttaaaaaaaaaaaaggtgaagagcagaaaacttattttgatacttaagttttgccaccccccccccaaaaaaaaaaaaaagaaaagaagaagatggttttaataaattctcaagagcagcagatgcaaatgttccaaatatttagttggctactgcatgcttccagctttgcagaaagtaaatgcaaaagcaaaacatttatatgatttgacaaaaactcttcacagaatcaacattctgaaaaagcacaaccttctccttgacaagctcctcagcctcagccagctccccagattcagagtttccctgaaggtttccatttgcattatctggaagttgccatgcatcttttattgacttgaaaccaaaaaatgccaggagagcaatcgcagcatactctcctataggtagtgctgcaaaaaaaaataataataatcatgtatcaacaagtatgtccattaggatatcagagatacttatggaaacttccaaaaagtaaacccaagtgcagaaagaatgccaaatatgagtactagaaattacatagagatattgccagagaaagcatagtagtttatacttgtttgaaattgtgctggtacagactgaaaaatccttccaattataacactcacaatagtcattagggaaagagcagccattgacccaagtaaaacctgttcacaaaattacacaggcacataaatgttagagtgactagccaaagggagacattctctaaaataaaaatgaaaattgagggaaaaatatatttctctaaacccttaatataattcagttgcccggcggagaatcttaatataattcagttataggtagaaaacaagtctttagtttttcttaaatgacaaaaccatcattttgaggttgtatcttttagttcggtagtgacattttattattaatcgttttttacatggaagaacatattaaaagaagagagcaacactgtgaagagaaaagaaacaactcaaataattggacaataacttgagacagatctaaatcaccatgcccaaacgtaccaatgctctctgatattgcatcgcaagaagtgcagcaatgaaaaatgtctgcaacaaaagaagggtcagcgcaacaaaatttctttgcttgcccaaacatattaagcatatagcataagctttacagaatggtaaaaaaaaacaattcttgaacatagctccaagctaggagaacactgaagatcatgtagctacaactaaatgatagtaatacaaggagaaaaataggatctacagtaggtatgactccaaaacagtaaatgagtaattcactatgaagataatacaaatccaatttgactgagttgacactcaagttgtaaagccttgaaatatcataatttaggagcataaaagtacataaaactacttactgcttagcttcatgtatagaaaacaacaagaaggtctcatcatctatcaaattgcaacaataaatactgtgatgtagcatgggaaagaaatgaaactatagacatttggttggacatagcaaatgtggatgacctatttatttcagaaatggagcatcagaatgaaaactctaagaaccatagaatccagacttcataattagtcaaaagaaggtaaagagcatctgtaatgcatctagaaggataaggcaagagaaaaagtcaactttaatggactgtataccttatccccaatctcagatacaaaaatcagtgtaaatgctgccgtgaaacctgactttgcaagcatcgctacaactgcagatggttgtcctttaaagaaaacaataaaagcggatgccagagcacatagaagtagcactgcagcaatggattgagggtaacgagatcctgaaggtggttttgttctgccaaccaaagccaatgtgcagtttaatgctatttagaagagattgggatgaagattgagttaaacatagtagagtataggaactcacggtttgtttgaatctctggtagcagaactatccaaatgttccccatggctacctgcttcgccaccttcatagcttccagctccaacatttacattggatgtctgcactctaacattgtgccgtattggtctcaaccatggtaacctacatctcactgttaaaataaaactatgcaatcaaaatagtataacgatgcctgtccaaattcaaacaagaaatcttacaaaatggagtcattatgcctgaaagtagcaagggaagatggttttaggtggtggcatgaatctaaggctcctttgacattaaaatgaattgcggatgaatgtgtagagttggaatccataacaaacaatacgatcaacttcatcaacgagtttcacaaaga

SEQ ID NO: 64396 - DNA, 1847 bp, Oryza sativa
  unsure (1)..(1847): unsure at all n locations
tttatcttggaatttgcaatggcatagtaatccaaagcccaccaaattatctctcctgtgcatacaataaagaacctatctaatttttccatcctacacaacttaggagatcgataacctgaaatcggcaaaacctgatgctagcttgaaacaacaattggggtctaaaacttatcataggctaaacatttacatttattatgaatgcaacgcccataattttgggtttctctatgccactatggcactatctgaaacattttggcccttcctccatgacactatctgaaattagactaggggttgtttagattgatgtcatttcaaaccataacattttttggtaaagttgtcaaaaatgtgcatctatttagtttttttaccaaactctggtaaatacataagaaaccctgccaaaacttggcagtattgccaaattgccaaaaattggtaaagtttattttggctacaatctaaacaagacctagattactgtactagtaaggatgccacatatgtttgattgagccacattgactgactggcctgatcatcaaccatgcaagaagcgttcgagcacaagatccctgattattactctagtggggcgtgagagaagaggaggaagggagcaggacatagagatgcccagaccttgtccttccacgaggcaccgccgccgcagaagcagcggcggccctgccccatcctcgcgcctcctgctggcggctggcactgcgacgccgacggaaatggccgttgccatggatcgaagaagctccggcgtcggtgacgtggaggaggaggagcaggaggaggcggcggcagtgggaggggaggcgcccgcggtgggggtagagggtgaaggggaagncgncggcgtggggggagagggcgaaggcgctgagccggcgccggcgacggcgacgagaaggagaggaggcgggcggcttatcggcttcgggagttcggtagcgcacacgtgccaacagttcttcttcttcgtctttccttttccttttttttaaaaaaaaattattaaatttcagagaatcaaagattattataggctcgaaattacatgaaacaacataatcctccgttccataaaaaaaattgtagtaccggatatgacatattcgtccagattcatagtattatttttcatagtattggcatgggcggcttatataacttgggtactatggtcatattccaaagttaactttgctaacgtagtagcaatttttttttaaaaaaaatggttatcttatatggttaaaacttttatacaatggatcaaagatttttttataaatttaagatttagttttagaatttattggtatagtgtatcgatgaataattggtcaatggtaccattttgtgaaactctgctcacataatacttaggttatatgccaagtaattattggtatgcatgttgaccattattttttgggtcatgtaaattttaccttcgaaatgcatgatgcatgaaaagttgttagaatacaataaactaattagcgcagctaagctggcgatgtaactaagcacacgtgcgtgtggttgcgcaggtgcgccctactcaatgggtcttattggtcgaagaaggtataggcattctttttcatattataattgatctaggagagatggaaagttatctaaatctggtatttgaaagtaaaattttatgatagatactttttcaatatagatttatttcaaattttaaaagtgagtaagctttcaactctaaattttaatttttcaattcaaaattttaaagtattctacccaaaatatttcaaactttttaacctaaagtacaaaaactttaa

SEQ ID NO: 64397 - DNA, 1546 bp, Oryza sativa
actgttgtgtctagggattcaagtgggtagtcccgctatccacataaaaacccgtttgctagtttatttttcacatggtagtacaaaatttagaagaaaaaatgaagtagaagtaggataagtgggcaaaaaaagcccgcttgcatccgtggttgtgccatgtaatgactgttgccaaatgtggcttttgtgctagttaactctagttgccaaactgatgtgtgaaggctttatattgcctcacactatgcccaattgttgctatgctggttaagtgaacctaattatgtgctgctatgctggttaagtgaacctaattatgacttattctgctataaagattttcagacttgtgtgatccaaattgtgtcaactattctttcctgagattgaatttatccctgtcgattgttatgtgaagccaattgtgctacccacttgttatgacagacaaacacatattctgctgtaaatgaatcaaaattatgtcatgccatataaaaaaaatcaactagcacagtttgtaacatattcttgccaaatactcattgcattcataatgcaagttgtagctgcaaatactacaacgtgcagttcacattcttgataccatcacagatacgacaagaacacagaatatgacaacaatcgagagataaaatctctcattctctaccctagtgtttacgtactaattttctctgcattctcacaacccaaggctttgactgactccaactattgcctggcagcatcaagctctctgctcttctcctctgcattcaacctctcttcttgaacagccaaaaccagatcttcattcttcttgctcattgaccaaaccaaatctcgcaagtcattcaacaaatctcacatataagtggttgttggcccatcaaaccaagaaaagaaattgcatctttgaagcatctaggcccctgttgttagttttggtaattaataacaagcactaattgtggactaaccgttgtctttgagctatatacatttaagttaggttcacatcatgtgtgcgcatggatgattatcgatggattaaaattgacggcgcaaagcaaaaggaagagaagacggtaaactagtgttttcattttaaattgatcgaggcgttgggcgatcaaaattgtgctagtttatttataggtttgccgtactattaagaggggtaatgatctagcaaagatatgattttaattgccacattaggtcattatgcatttagacttgtgctcacatttcacaacacacacaaccactttgtattcattgtctcggcctgaccaggggcagtggcggtctgacgggcgtgccctggccggccccaagtcggcggtctgaccggtgcataaggccggtctgaccggcgggaccggcggcacttgtgcggtcagaccggccccctggaggccgggatggtgttgctcggggtggccaatacagagccgacggagccgtattcggtcagaccgagctgatggcggtctgactgagccgaggctggtctgaccggccaatcaactgtggt

SEQ ID NO: 64398 - DNA, 6606 bp, Oryza sativa
ctcacatttcacaacacacacaaccactttgtattcattgtctcggcctgaccaggggcagtggcggtctgacgggcgtgccctggccggccccaagtcggcggtctgaccggtgcataaggccggtctgaccggcgggaccggcggcacttgtgcggtcagaccggccccctggaggccgggatggtgttgctcggggtggccaatacagagccgacggagccgtattcggtcagaccgagctgatggcggtctgactgagccgaggctggtctgaccggccaatcaactgtggtctgaccagccaagccaatggggctctctgacagggctacaatggctagttttctagccgttgcagagtagcacggtctgaccggccacatacctccggtcagaccggcaacacacagagttgggggatttcgcccccaacggctagttttggttggtgagagtataaatactccccctccagcagcaacgggcctctcttggtacccaattcattgcatacaccccttgcatctctcacacacccacttgagctttgtgttcatccatctagtgtgtttgagggttgattagccaagagtcaagtgcattgcttcattgtagagctagtgtggcacttgattgatcatgttactcttggaggttgccgcctcctagacggcttgtggagaagttgccctgtgacctctccgagaagattgtggaggaggcccggtgccggtttgtgagttgtttggagttcaccaccttcggagtgaaggaagaactacctcgagtgatcgaggcttgggtagtcctgtccgtgggctggctcccgccttgcccacccctttacgaagggggcgtgcggtggcttcgtggttaagtggtggagttgggctcgcctcaacggggagtaggaaaccggcgagtttccgaacctcggtgaaaaatctcttgtctccttgtctcatttgattgtcgcatttacatttgtgtaatttacattcctagagacatacttgagatcatatcaccctaggattgcaaaactttgacataggagtgtgatttactttcctagagaattaattgagtcactatcaccctaggtttgcaaaacataacttagttgcttagttagacttaaccctcaccaagcctagcaacttagtttagttttgattaggtgtcttttagtttttaaatcgcctattcacccccctctagtcgacatctcgatcctacaatcctacaatccccaaccacatacttcactccccgatccaaatcaacccaccaaatgtgaccaaataggcaacttacccagacattgtgacatttgaagtaccgatgcctagggttttcgatgctccacaagatccaccacgcagccttgctgccacacttgcacatcacggtcggctggtaatcaaatggcccaaccctatacaacatgggagaagcagatggccaatgggaactcgccaatgacgagtagctcctcgaactagccatcgctgacacaccgctccccatgttgccgccacgtcgccatccccgcaacctgcacctttgttgtcgccaatgtgtcgagggctagtgtttttatggtgtggttggggattcagcttgcgaagaacacaaacatatttaactatttaccactcttacaagtgacaattaaagatttgccactagaccccacatgtcatagacacatgagggcccacatgtcatacattgtgaatgacacatcttaaaagtggtaaatggttaaatgcacccctactcaacccctcaatcgacgtgttggctcagctagtcaatggggtcaaagatgccaggtcggatgaagctacctcccaacccacctgagaagttgatatgcattggtttttggagttggcgggttttacagttaagcgatgtgattcaaccagtagcataaattgagggatgcacaatagacttgttccttgtaactatatcaggtatggatagttagattttttttttaattttttgaacttttttagcttttaattttaaaactaaaccctttcaaaatttatttccaaaatctgaaccttttggccacgctagtccgcttggcgtgacaaagcaacaatggcacgccacctgcagcgggcgtgaaagttttgtcctgcgacgccagcgagagcggtgtggccaaataacgctgccacgtcagtgggagcggtgtgacagtattgttttgccacgctagtttggctggcgtggccgtgtggccaaaaggttcagatctttaatataaattttggatggatttatttttaaaattaaaaaaattaaaaaggttaaaaaataaaaaaaaatcagatagttatggatccggctccagccaaacccaacccaactcggcccggcccggcccggccgatctctttacctattactccgtacgcagcattctccctcgtgtcattttcgtccacgccgagacgagacgagacagtcgggcgacgggacagcagctgcagcctgcactgcagcacagccgtcagccgcctccccaacctcccgccgccgccgccgccgccgcatccgcatggagcccgacgccgcagcggccgcggccgccggcgagagggaggcggagatcgagaaggccttccgcgcccgcctccccgatttcaggaagcagccagagtgagcgcgtccgccctctctctccctttccctcttccaccccccctctctctcaggctgtggtcggctctcccgcgcgggatggtttggtctacgcgggcgcggcttctagggttcgttcctgtgtctttggctgcctgcctcgcgtcgcgcccgggaggttgttggcggtggccctagggtttttcggcggcggcagctggtgcacgcttgcggggggtttggtgtccgctttttgggtttcgaaccggggaggggtttatggcctggttggttgtttccaatcttcgattttagttcgggattcttctgctgctgcgggtggtcggcagggttgtgaaggagaagcaagggggagtgatgccgattcctagggtttagtgggggggagggaaaccaacaatttcgtattagcaggtgtgtgcaccaaatatttctgttctacctccaaattcgtcaggttctagctaggatttgacaaggtggtacttctgatttcagaaatgttgtgatttcagaaatgttgctgggcgacggttggttatttagttgcgcagggttctgaagaaccacgtgtagttgcagccttgtattcagcatttcagctatttaaggataataatggctgtgcatcagatttcttgtgtctctctaggtatttaaacctgtaaggaagaaatgaaaagggtttggcgatatgtgagtgataaatgtatatagctgctgcatataaagcatcctagggttgcattctccctaattttcacgcaggcaggagaggtcgatgctttcttctaattactagaaattcgaaccttttctgctctctagatctcttatattggtcaactatgaggaatgacaccacatatatttttctttcttttcagctccttaaccctcgaaggtgtaaggagagcactggagaaggacatgggcttggagaaacattcacttgacgcccataaaaagttcataaagcaatgtgtagacaaggtacgggtggacattaatgtatatggggtttggtgcagtgcaataattaggaaaagaagaacatttgtgcaactaatgtttttgctgtatgaacctgggagctgtacaattttggaatttcctagtgcaatagttaggaaaagaagaacacatttgtgcaactaatgttttctctctatgaaccagggagctgtataatttcctagtttaaactcttgactcttcacttccaacaaaaatagaaaccactgataatatcttgtgttcaaggccaatttttgacttttcaatcgtctgtggaaactaagtaaacataagtacataacatattttgtcaataatgcggaataaatgtttgctatttaaacacaccgctgcagaaacaattactcctgcttgagtgcattaatttgtgcaagtgattttgtgatgcactgtttcagttttcatatactccctccgtcccacaatatagctacctttaggttcaaattttgtcccaaatataactacctacaatatgtagaaagtaacttttaccacactacttcccatgctacccctagtaggccatatcatcccatcaaccctcgagatccacacccacccgtactattcttgattcccgtcacctcaccatctattaatgagggacttttagacctttcactccaatccagaattcctcaaaacactcctatgtagctatattttgggacggagggagtacattagcttggggagctaacatgtcagcatgcattacgattgggcgtttgagctgtgcgaaaagaatcagttgaacaatcataaacatgttattgcagaagcaaaaaaatgagtatgttaaccattggctctgagtatctgactagtaccggtttctgttgttacagcagtacataccaagacaagacagttggcattttaaagattatattgtaattaggatcctgcatgcaaatctcaaatttggtagtttatcatggttggttacgcatcttcaggattccttgtttagagatggacagatggcttcttagtggtcaactcaagccatcctccatctatataaggatgatatggtattatgatgtattttatgttggagcaatggagtaacaaaagaagataatccgaatatcagttttgttgtgttctcttctcttggcctgctattgtgtagatctagtccctcctaaccaagtcccgcattcacagagcagcattctacctcaaatcatcactgtccaatgtctctttaacgggtgttggctcatgttgtgaactagttcaacatcagttgccaattctgatacaataaaagaatgactagagtacaaaacaagtatttacctaaccagtatttctgaagatgaaatatattaagctcacatgtgttgatataatcttttcctttgaggaatatatattaaaatcaccattcacaagcaggagccacaaggatctctttggaacttagacactgtagagactagagagaataattgagtctgtccttatatttgttacaattgtgttatggaaaccaaatgtcttgatatttcaagtgtcaagctgtttttcttgaacctctcttcacccagtttatgcaaattggtaatgagatcctttaattcagatgaataattacctttatttaaacttctgaaggtcataaaacttgttcagttgtcatttatactttatattcccagttggaacctgttagcttgtatttgggaactttcaaactttattgaactctgatttcagtacagtaatactcattttttcctttttctttttggctaagcacatcaacaggttttttctggttctgatgatgacaatacgaataataatgcaccagagaaggatgaagctaaagatgaccgttcttctaaagaagaatcagaagatgcccaaccaacatctgactcgaacaaaatttcctccaatgctgatgagccggtggcaaaatccagtgagacagatagagatcaggagggagacaaagatcatagttctggcagtgacattagtgaagctacgataaaaaatgctattgtcaaaagggcctcatattttagagagaactcagagtatgtgtcctcaacttgccattcttaaattgtacttatcattgaaacttaatagttaacatgcactccaaattatcatgtgtcagattgatcagcgaatcattgtacttgacaacttgtagagttgtagtctcaaaagcctcttgctctggaatgtaatgaaaccttgtttttttaaaaagaaatatttaaccccactacatcacagagcagatatctgaaaagatactatcatgttattgtaattttttgacactagaaaacaaaactggaggttggggcagtaaaatgagtcaaccaaaatatagtcaaccttttgtgacctgattgagtaataatagagaaaccatttagttgttccacatcttgcggtgaaacatatgaataagggacgaaagtagagataattgctcccattgtgtgatgcaagcggtgagcagggagatttcgttgcgtgctagttcacttatacaattctgagtgacaaatttgtggggggccatgccgagggaggggggggggggatatgggtcttagctggtaaaagaaaaggccattgagtcattcttaatgtagaccgtctaaaaatgaacaggagcccagttgtgtgcactgatctgaatatacatttggaacataatgattgaaactgttgagttttacaaagaaaattgcctatatgttcttaaaacatatcattcttgttgttaagagtggtgtgcggccaatattatataggacatgatcatatgtgatgcagttctttagagttatgaaccaattggcgataaacggaaatataggaatttgcttatat

SEQ ID NO: 64399 - DNA, 12551 bp, Oryza sativa
gaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagagagaggcccatgtggtgacccctgatcagataaaaaggaggaaggggggttgggactctggggaatgggttctagagcctgaactctctcccgctctccgctctctgtattccttcacgcacagatccaccagaacacaggagtagggtgttacgcttctcagcggcccgaacctgtctacgtcgcccgtgtcttgtgcatttcctctcccgctgacgttcctcagatcgagggcgaagaacctcacttagcgcccccggccgaaccggcaaaggggggcctgcgcggtctcccggtgaggagccccacgctccgtcaattatttattttatttgtgacttactttactttattatctacggtactttaagcacaactttttattttttatatttgcaaaaaaaaatgaataagacgactggtcaaacgttacaaagaaaaactaaaaatctcttatatcgtgggacagattgagtaatagattggcacgggtacaaccaatacgtcacagtaccagctaagcagtagtactagtaattttgtgctggcgcaatttctggttgagactggttgttagtacttgtttgctatcaatatcatcatcggacgcacagaatacttgattaccacagagacggtagcagtgaggatggaggttagtctccgggctgccgatattttaacctcgctttctcgcggtaatgacaaggtgacaaccacccccaaaattgaccgcaggctgggataatattttccgaggagaaagattgcaaccaccatgcctatggggtatattttttttatcttcctcaattctccgactccaaacatcgataatacacttgggtcctctcatcctatcaatgtttcgctgcacgtactggcgtactgctgcaaccccactcctgttctcttttctgagcgatgaacagtgtgctgcagctgaggctttaaaatcttttcatgtttattctgaacatacaccggctacatagtgaaagcaaagtcataacatatattcgtattggatagtactacttcatccgtttcacaatataaatataagttattctagcatttttcacattcatattgatgttaatgaatctagatagatatatatgtctaaattcattaacatcaatattaatatagaaaatactatattttttatattcatattgatcattaacatcaatatgaatatgaaaaatgctaaaatgacttatattgtgaaagggaggcagtagtacaggcagccactcgtattagattcggaactgaagacacacctaggacctgaatcttctgtggcaacccgttgtgcatcaaattcggtattctcgaaaacatataacaacgcacttataactttttcttgcgatgaaaaatactataaaattaaaggttccttttagaacagcaaaaaaagaggaattttggataattgaaatttagttggaaaaagatccctagcttcatattctctgaaacaaagaaatggctccgaatgcatatggaatacaaagaaatatctcctacaaaaacagacctcatgttttctctttattccgtctcaaattcctgcgcttttactatagtgctatcaaacaataccttttttaataaattcttataaaaccttaaaatttaactacttcatctgtctcaaaatacaataatccagaaccggatatcatattttttattactataaatatggacaaatagtatatacatattcatgctactaaagaatttagagaggtgacacattctagtactgaaaaatattacatcttatccgaatctcttgtattatacgatgtaggaagggaggaataacatagtactcgtcgtttgagtgcgtttgttatccgaattccagtactcaaaaagattcgtgagcggtaaataaaaaaaatcaccgcggtggagagagcagtgacgctgcgactgttacgtggggccttagactgatgtggcgggagtacctgaataacctgatctcttgtgtcacattggcccccgtctctcttgtgcagattctgcagctgccatctcccccgcgaataaaaccccccctctctctctccctctgcccaccaaaggcaaaggcaaagcgaaccttggtcacagagctagaaaggcagcgcctctttctttctttcttttccagcaccgcgcgcgcgcggagacgcacagcacaggcgcacgcactcgtctttcgcttctcgcctcgtcgatcgctttttggattcttcccaagcgagagagagagagagagagagagagggagagaggggcatcgcctcctgtctgcccccattggcccaagcgcaccacccccctttgtggaatcctaaattcttgcctcctccccacctccactctcctctctgcttcttcttgccatgcgccgccgccgagggacgagggtcagtgtgggctctgtttgtgtgggtggtttgtggttgttgtcgttgttgttgctgcggcgtaggtcaggtgtttgattgtttgatcgtgagggttggggggggggggtgcgtctcggggttgtgtgtgtcgcaggtggtggtgatcgcgcgcgtggggttgggggtggggtggatgggagctcaggcaatgtcgtcgcaccaagggagcgggggcgtgtcgaggcaggggtcgctgtgcggcctcgcgctgagcgaggtggaggggcagctgcacggcgtgaacctcgacgacctgctccgtacgggtggcggtggggcgggggcgggggcggcggcggcggggaggaagacggtggacgaggtgtggcgggacatacagggcgcgacgggcaacggcttcctgcggccggcgggggcagcggcaggccagatgacgctcgaggacttcctgtccagggccggcgcggactccgggagcggcggcggcggcggcgccgactgcgcgcgctgggcgcgcgcgcaccaccaccacgtcgggcgccccgtgccacggcccctcgggctgggcgccgggccggtgctggacgcgctgtaccacgacggcccggtgtcagggagtaagcgcgcccccgccgcgggtgagggcgccgccgcggagaagacggtggagcggcggaagaagcggatgatcaagaaccgcgagtcggcagcgaggtcgcgcgccaggaagcaggtgagctcctcacaccgaccatctcgatctctctcgcgcattggatcgtgctcgcgcccgctcaagcactaagctctggttggcggcgcaggcgtacacgaacgagctggagaacaagatctcgcggcttgaggaggagaacaagcggctcaggatgcacaaggtatgcttcgattcatcatatgaaaatatgaaattatcaacactccactactcaaccgcagcatgcccagaaatatccatgaacttgaactccattatctaaaaatattgcatgaactttcctgctcgtgtgccaaatcaggtgtccaagcctgtttttgttcatcactttcaggaaccttaaggatttgtcacatactagcggtattataggatggagtttctagcctttgttattttgggtgttcttttgctttctaaactcatttggatttctagtatgggacaaattaagacactgtcgcatgtagtaggtcactcaggccaattcattgctaatgtgctaagatttttggggccaccatacaatgatgtataaatggggtctaccatctatttggttggaacaaacaaccgggttgttttcagcggtggagccaggattgccactctaattccattctaagggacaaaatgcaacatatctagtatagtacgtgcttagagaattgatacttttatgattaccatattcttgtttggtttcaccttaagtctacttgagttctctttaggcaggtcttggcacaattcttttctagcatgatgatgcaagcttgagaaaaagaaattgcaacagatcgtagttgtgctagcaaatcaagcattcagaaactataactgcctgccttcaactgaaacacccccgtacgctcgctgtttggtttacagggatttattccaagcccctgtcacatcggatgtttggacactaatttagagtattaaacatccactaattacaaaactcattccataagcttggactaattctcgagacgatttttttaggtttaattgcgacataattttgacaatgtgatgctacagtaaacttttgataattatagattaattaggcttaaaaaattcgtctcacggattagctctcatttataaaattagtttttttattagtctatatttaatactcttaattagcgtccaaacatcctatgtgacatgggctaaaaagttttagtcccatctaaacaccccctagccttttgttttatttcgttgtctctgcgtgattggcctcgctctgaagtggttatgagaggacgtctggcgatgcacggacgatacagttctgtccaatcaaatggtgttccgtcttgtcctctgttgcatcttgcacaaaggaaaatttctctcttttcctctggttaataactatagggactagctatatagtagtctaacatttgattgagaattattctaaaaatctgtcaaatgtaaatacaatacaattacaatataattttaataattataatatatttgtattctaattacggtcctcatcgtttggcatattcatatgcttatcaaccaaaaattaaattttcaacgttaaatttagagctgattttagggttttttcatcgaagtttattttttagcctttgcttttagatcgctaagaacatatatatatatatatatatatatatatatatgttttattcacaaattatttttcgtttgcaaatatgtcgtttgtcttattccaccaatatgccaaacgatggcaccctacatatgtaactaacatgcagttacaataaaaataggatgtaaatttgtgtgaagtcatgggtaggcccgcggggaggggtagtcacgtgcccgcattgtcacaggatcgatcccaaattatcccacccagtaccgtgcttttttacttttttttcttagaagcacaaatcttgatgtgtatcaaacggctaacaggaatctcaaacacatccaacggtttagaaactgagatttaaccatcaattttctgtcaacaaactgttagcaattccgataactatatactcgatttttcaaaatatcatccgaaaatagttgtgctctacaatgctgcctttgcttgatgatgagttgatcactctacaattggtgcccaaccatttctttcacaatgcctatcgtgtgtttgtcggacagacactctttctgtattccacttgactaaaagttggtgttctttagtataagctctttaacataaggatggactaaactaggggtttagagaagtttattacatcgtatgtcagctcgagttcctccattggcatgcatcagcatgatactaggatgatggaacttcatgtcaataaataatattgggccatccttttcaggttagtgtgaaaattctaccactatccatgtgctaacaaagtctgcacatctatctcgaactgcacctctctcatagtttagtggttttctttcacttgtttatacgccttcctatgcccatgtcaagaaatctgaagacagtatgtaacgttgcaagtggcaacttctccgaaagacgagatttatgtcctatactttgcatctgggagactgggagtatgaaacgcttgcctcattgtcctaaattgatattgctcggatatgaaacgttcagcaacagataaacttagttaaattcgaaagggtgcgtacgtttagaaaacacaaattgaggccgtgtttagttccaaaataattcttcaaacttctaactttttcatcacattaaaacttttctacacacataaacttccaacttttccgtcgcatcgttttaattttaacaaaacttccaattttagtgtgaactaaacatagtccgaaacgatctttttgtttgtatgttttctcttttttttttccgggcgtaaagtcgtacttaaggcaatagtagcactgctttgtttacccacatgcagcgcagtctgtaaactgcatgcatgcagcatgcagcagattcagacttgcagtacgtggaaagtaacaaagctccgtttgcgagctggactagtgaactgtgttctttttgacttctcagagaacgatgaactagtaggcatttgctctttgagatctgcttcaacagtggagatttcttttcatagttcgatgcccaatagtgacactgatggtttactgtttgcaaactgacggtgtttttatgcttgctacaggcacctgaaccggtagtgcagtatgtgccgcaacaggagccaaagaatcagctccggcgggttaactcggccgacttctgaatcatgttaatagtagaagtaagctgccctggaattaaaggtggttcaagctgtaactgccatgttgaaaattacttagctagtaagaacacccttttctctgcagtctccagattgttgggtgctgttgcaagagtgttgtactcctaacttgtggtttatgcagccgcagcctagctttcctcccgctggtgcaatgctttctgtagcctgtgattgcaagagtgccccagataaactgtaatgttaccgtattcaaaatgggaaaatggcaatgctagtccaaaatcatactccaactatttttcgcacaccttgggagtgtagacaaagcagacaaaattcaggatagttttgttttgctgaagaaaaataacagaaactttattcaattcaaagctgagatatgatctatacatcattcttatcttgatttataaaggaactggattaacataagtcttcactactgatacatcaactgctgtcagcatcttcttcaggcagtatcaatctaaggtcctcattgtccctgtagacttgtaccaaagcggcagccttgtatgcaaagaaacccatcattcctggaacaagctgtataaggaggagaaacagttgctcaggacatgttagggcaatttagctaacaaagttcaggataataacccttgctacataattgtcacagttaacaagggagataaatgaaatgcgtgtaattcataagatggagttgaatctgatatatgcactgcaatagctcagagctgtgcttatacctcaaaatttaaaatgctattttgaaagtgatctgacaaggttgacaatccaaaaaatatagcgggtatcacaagccttggagacgaaagagctactgaaataccacccaacaccttctctattgtattcttcaaatcctcgcttcttatgccgattctagcattgtcacatatatagggacaattaatgacaaagtgagggcaaaagattgataataaaaaatgattaacattttcaaacctaccttttcactttcttcttcataaaaatttctggaacatctttctttgacaaattatctgtgtgccgatagagaagttgaagatacaagcaactgttcaacataatgtgactggttagattattttttatcgttgatagttgcaatagaagttaacccagtctgttgagagagtagccccagcgacattatattgaaacaaggtaccacaaacttctgagttcttaagttcaataggaagcaaattgagcttacctgaaagcaactccaaaagcataactgacagcagcctgttcaattggagcgttacagattcagtcacaatcagcaaaattatagatagagttaagccatttgagctcaggagataactttgattctgtttcatatcggttggttatgaagttagtggaacaggagatggcttaatgttgactcacactaccacaataactcgaaactacttagtcgttttaacgtcggcaaagagtaatgtctaatttgatgccaattataaatttgaaaaatctatttacctccagagaaaagactaggagacagtataaactgcacgcagctccaattcctgtggtcaggagcaatagttcatccttaagctgagagagattatgattgatgaccatcagttatgggatgcaaaagcttcactgaaaataattcatcagaaaaaagaagcacaggagagctgaaacgaaaacctactgcttcatatcttagaaggttgagttccttccttctttccctctcatcctgccgatcctgtcatcgtttgcaacagcattaacatttctctacaaattgcttccacaaaaaagatggccactagccaaaacaatgaacaattgagcagcaaacccagaacaccatgacagacacaagaccttggcagaaagcctcttgctgacaggaaggctgctctcaccggagacccaatctctcgtcgccgcaatcctcaacattccctcgcccatgacatcctgtacaaccggatgattctcagtgttgctctgcaaaaattacaccagacaaaacactttgaattggtactatacatcttacagcttcttcaggttgcggtggtgcgacatccgctgaattttcttgttccgccgccgcctctagcacgccgaggtcgccgccgttcctcctccagaccatgtcggagatcttggtgacgaagtcgccgtgcgcctgcctctccgcgaggaacatccgcaggacctcctccccgaggctgtccccagctgctagcatcagaagcagaactcatggaatcagcaccagccaaaccagaaaaaaaataaaccccgaatttgttccgagaacactggccgcgagctagaagtcgactgctactaccttggagggaggagtagcggagagcggaggcgcgcggggaggcgcgggcgcgggcggggccgagaagagggcgcgcggccgcggcgtcgaggccgcggcagcagcggaggccggggagccccatagccatggcgattccgagcaaagctgttcgctcggctgcggctggctataagccgattagccgaggcctctcctccgtttcttcctggtctcaaaaccaagcgatgtttggaggagccgtccctcgcaaaccgaaccggcaaaaatatcttccttttgggcctcgttttctgcctccatcttatggcccgtttacgaagtgcaaaatttatgtgtcgtgcggtaatctaaccgtttcacctgaaattcattctagtacacataggattttgttttccgaatttcagccgagaaatgttggtaagtgcaatatctaaagaaaagcagagggggaagaacagtcaggtgcttaactggtagactcaattcaatagaattagctacttatctgttaccaaaatatttaaccaagcgatgacacgaccaaatatgcatgtgaccgtattcttcgctcaagagtcaagacattgaattcgagataggtttatcaactccatctgaagatcatctttcactgcactgctcttgaaatacagacgcatcatgcagaacaatgcaggcaacagcaagtattcaacatggaaaaaaaaagcagtaataactagtgagaacgcaatgtatcttgtccataaatcatagcaggatggtcatgtcctgtcctggtaacatccacaaacatatagcataagttcagggcaccaattgttatgccagttacaggaattattcaacggagaggcagtgtgacatccttgccatgaaggcagttcaacagacgggcactcgttagcccggcggccagttcatctgcctgcctccgaggagatgtacatgtatgtggtaaacagattggcctgcaaataaagatatcaggtgactgaagatgaatggtctaccaaatataggttctaatgtataagaagactgaaatgagacgtacatccactggggccatcattgatgacaatacggtagccatcttcaagtccctcctgctttgcaacaactttggcaacatagaggaggtaaccgagtatttctacatgcctctcttctgcctgtgaagatgggaaacatgaaatgcatttagtttcgaagatactttattcattttacttgttactcttgttaacgtttacttgtcactcaacatgagtccatgtcagttttttacgggcttggtaatttgtggcatgtgggtgcattccgaggtaagaatgcagtgagtgacaagaaagccttactcatcattcatgcttaggcaatctcccacatgcatgcaccaactcatggcgcctgcattagtgaggccaaaggcagtccataacagtaatcacattcatctacccaacatgaccaaaatgacatttatatattctctatttgggtaaggagtcagcaggttggattacacagctaattgctcctaggcccacaagggagggcaaggacaaatgagaaatgggcaaatttgaaatcacgaaagggttagtaaatttaggtaaactataaatcgactacatatgaagagaaaggttgacataaactggaacataaattgtgataatagatgagtgttaaatgctacctttgataggccagttaatccatccttcactttgggaatgatcacaatgtgggtcggagcttgaggatttatgtctctgaaagccagaacctgggaaacaaactcacagttcatgcccaaaacaaattcacattggagaattaagaaatatgaacaaaagtgtttgatccaaaacataagagtaatgaactgttgcagttctaggatttagtcatttcaatgcaataacagtagaacgacaggcatccagtttacttgggccttaggagttggaaactggagacttgtattgcagtactttagtacctagtgagagagaactatgtattcgacatttctggcacccgtgagaatgacctaggtaaggatatagctaatctctccgtacagagtgctccgtcataccgtagtgagcatatgacagattcatgtgaagggtgtggtctcctagacattattggtttgcgtcaaggaggtgactgccatgacaaaggtgtccggcctaagcagtttctggcattatggaggacaaggcgaactggtatgttaagtagagaagggatggggaaacagatcaatctgtctcttaaccagaactagtacaaagtgcatcctttatatagatgatgacttgtcttcacgaccatagactccagtagtaacgattaaaacaattataacagaccactaagttgattatgccctcaaaagttccttatcctactcatagttgcaaatataacaatggtatcaacaatttattcaactgctcctgattccaaaacaaagcacaatcaagcaattttcagtctaactgggtatagagaaaagaaactcagtgggaaatagaagaaaggttccaaaaaaagctaagtagttggaagggcaagttcttatcagtgggaggccggctagtactcatcaactcggttttgagtagccttgcgatgtacatgctttccttctttgaggttgctaaaggcatccttaagaaactggacttttttaggtctaggtttttttggcaaagtgatgagcacaaaaagaagtacagattgaccagatggagtgtgttgtgtaaacccaaggagtgcgggggtttagggatacaaaatcttgagattcagaataaatgcttgttgagtaagtggttatacaagctgatcaatgaggagggggtctggcagaatttgttgagaagaaaatatctttctagtaaaaccattatgcaagtgcagaagcgaaggggggactctcacttctgggcaggactaatgggggttaaggatacctttcgttcttttggttcatttaaattgcatgatggctcacaagtgagattctgggaaagaccgttggctcgggaatcagtctttagataagaaatacccttctttgtataatcttgtaaggaataaaaatgaggtggtggccaaggtagttggaagggtacctttgaacgtttcctttaggagggccatagtgggagacaatctccatgcttggcatgagattgtagctaacgtggttgacttaagcttaaaggggcaaaaggatgtgtttttttgggaggctaacaaaaatggaactttcacggtcaattcgatgtacaaaaagctcatgtatggtaatgtaataccgaggaaatcttttatttggaagctaagacttcctttgaagataaaaattttcttgtggtatttgaaagagggagtcattttaaccaaggataacttagcaaagaggaggtggaaaggtagcccttaggtgttcttttgtagatctaatgagacaatacaacacctgttttttgat

SEQ ID NO: 64400 - DNA, 6679 bp, Oryza sativa
ttctttttgcaggtgattttcagggggacatattgggcaagactttggtccttgttgcttaaggaagaggatggcactttggtgaaagaatactgcaaaatgttagagatgagagttttagagttctactccaactatggctggaacttcagaaggagaattcaagattaggttggcacctcgtgtctgtttgatgtggtgtgcctggatggtggttttctgtttttgttggttgttcttgacaccttttgtggtccaagttattttgtttttgttacccatgtaatgggtggagtttcaatgctcatgtatgaacttggttggctgtgtacatcccgttggatgtagaggccgggtttttaatccattatctaaaaaatagagaaaagaaactaagcagtagtaccttctcatcgtcaaataccacagtggaaggtatttccttcttgatgatcttgtcaaatctgcagatgcaacaaatttcagaaatcaattcaattgcacacttttctgtgcagaatgtaaaacttcaccacattctaaatcaataatttgacatcttcagaaacttaatcttgattacaaggaaaaacttacacttgactaccatcaagcaaactgcaaacagcatgctcttttggcaacaaatgaaccactgatcaatgcttaacttgactattgagttccaatgcgctgtggagatgtattatagttgtttgtcagacattttaaatttaatgaaaagggtatcagacgatttgcctactgctttaatgttcaggcattcagggctcacttcataatattaatccgttaaacgagtgtttcagtgacacaagtaggattggtatttggctattagagaaatggtcaaataaattcctcaaaatgatgtcataaacctgactggggtaagcagagacagatgccacttacttagaaggaaaaaaaaaaactgggccataacttatggagtaaaaaccaaagcaggctacagtacagattggtacgcaagctagtgaaaaatttaattaacaatcatgcttgcactattgtacagctcaatagccccatttcgtatttgcgccaagctcttatttgtggtgtgcctcatttccagtagtaataattagtaaaggaccctaatcacatgaatccagcaattccatctacacgaattacttctgcaaacgctcgctcaagttcggtttaaagagacagggaggtgttcgaatcaatgatctcccagcgtactaggccatgataaactagtgatgccgcaatctgccaatccatgagatcaagaagcacacacgagtactacactgcctacaaatcagagcgggttttgcggcaggagagagagaggtgctcacatggtggggttgtcgttgggcacggcggcgagcgccgcctccttctccgacgccatggtgagggatcgatcgaacttccccgagcacaagtggtcgccgccgcgagtgttcttatgtggataaaaggcacaccagagacgcaaaccctcgttttccacgtcaatttactattctgcccttacaattttgggtcatgcggctcatgccatgcccattttggttaaatctaaaataccgattgcagggtgcaaactctactaaatcattaggccacgtggccaaaccaaaaaccaagttcacatatcatcaaaatatgccacgtgtccagaagagcacgttcattttgaacgtgtgtgaagagtctagataaaacaaaggaaaaaatccagagcattctaaactcggttgaaaaaaatcacatgataacacgaaaagaattagtgaaaaagattgcatgccgaggaaacaatggataagaaaaaaatagtatccaaaaaactgccacaagttttttaaaggaacaacttttaaatctaactataatataattccactataactataccataacaatattgtaacttgtatataagtattaaaatactatatgcaactttatatcacttatatagagattacaatatagttaaagtagttacactattgtgtacaatgtaactatagtgtagttacattgtagttatactacaactatactatagtaacatttaaaagttttttttgccaaaaaacttgtgacaactttttagcaattcccaaaaaaatataaacagcgagccgatgttagctgtcgtaaaccggcaacgaggaagacatttaccgcaatattttccggatccacggaagctgttgccaacgagcaagatccactcactcaatggagcaagcggagggcgtcgagccgtactagctgtgatagtccgcgagtgtggacgcgccaaccagccaacgagcatcgaggtcgagcacgtcctcgccatccacggtagcaatgaccacgaccccaagctcgaccacatccaggaggaagaagagagagggatgaagaagggctcaatgaggatacccagctttggacaatcaagggacgagggcgatcttgccttcgctaccatcatcttcctcctcttctccttgttctcgcaagcgttgtcttcctcaacggctgatgcctttctcccagcaccgacgcgacaatccttgttctcgcaagcgccattttccccaacggttgtcgcctttctcctagcaccgacacggaaatccttgttctcgcaagtgtcgtcttcctcaatggccatcgcctttctctcagcaccgacgcggcaatccttgttctcgcaagtgtcgtcttccccaatggccatcgcctttctcccagcactgacacggcaagtaaagctccaatgccaggatccaacgaccaattctctaagccaccagatccagcatcctttaacccatcggacccggggccacgatctctagtgacgctgagacatggcgggccgcgatggcgatgagcggtgaaggggacgaatcatcgaagattcaaggcccttccactttctattactaggtgattctccatgctttgctacgggatcgctaaacaatttttaatatatttttttcaacaagtaaactaagagtaaaaagaatagaaaataatgaaacgtgaagttttatcagaacttatcataaaataaacaaatgatacccgtaatttaatgtggagcatattgataagtatatgttaaatattataaaaatggtatgtatatttgttaaaatattgtagaaataatgtgatgacatgtatatttgttaaaatattgtagaaataatgtgaggggtgaaacactttgttttttttaaaaaaaataccaacaccaattttataatgagttaataacttaattataattttagaaaaacaaaggaagaaacaatagcatgggtggaaaaaaagagaaaatttgatgattttctcaacaatatgatctgttatgttaaactggaacacagaaaattccattcaactatgatttttgcatgagtttcaaagaaattaaattgatttctatatttttttatgaacaatgtgctaattaataacacaaaaataatatatacggactataaatcatgcgcgccaactggcgcgctgattttctagtgacatctatattcagattgcgccgaagtttaaggcttgctttacccttttggcaaaataagacaccgcaaaaacatgacacaatcgacggcgtgctcctcaaggctcgtgcctatgcagacgaaggtcggggctacacctcagatctggctaggagagagaaaggaggttatcgtcgctatcgccgaccgagcagcagctgatgcttgccaccactagatccgatgggggagccaccagatgtgggaatcctcgtactaggcctcgcaactgtcagcgccagatctggcggtgaagccatcggttctggaagtccagtcactgtcgaggaggaggaggaggcggtggtgagggagggggatgaggagacgaagcagcgggtggtagtggtggttagttggttgctcgcccctctgcagccgcactcgtgctcatacagtggttcgcataaccccaccgcccacgataggcgcttgatctccaccgctggtggtgcgacatagctgccgcctgtggggataaatggggagagaagatgggagtgaaggagtgagtggtggggagtgaactactaagaataaggtgcggagagatggttattttatagtgcaaagtatttcttttccaggtggctatgcaggagaacatttgcgaaatttattttcagaagcagttgtccaagaagaccactaatgaaattagggctatttttaccgacggttgttttaaaaacaagtgctagtgataatagattttcataagcggtcattaaccataagccttcggttattttttacaagcgtttcaaattttatccattggagaaaaaagatgtaatgccagaaaaaacctattttgtagtagtgtttattcccttccttgaaatatgaaggcaaagtagattagatatcatggttaatctttcagtgattggaacagatcgaccagaaaatttcagataaaccacgagggactcagggcccaaagaattacgtaatgtcaaaattgatgattcttccacatggataaaatatgggtcaaataaacagaaaccgccatgaagttggtcaacaaacaaacttcagttgactcggagcggaggatgggttgggatttaaggcggcacaccatataaggtgaaccattaacatatagcatgcctaattgagtaattattataaaatttaaaaataaattttattttttaaaagaaaaaactttcgtatagaaaactttcatgtaaaatataccacttagttatttggaaatcacgttgataaggaaaaaaaataaagtaggcttgtttagaatgcagcctgaagtatggatatgctaatgttattagggcatctacaatgttgaaaaaaaaggcagcattaaacatttaatgctactaagttttgtacctttgccattgtagagatgcactataagcatcaccaaactaaaatgcaccaccctaagcttaaggtatggtcacaagacaataaaactaagcttaaggtatggccacaagacaataaaatataggatttgctattcatactaataaaatacaacattgcattgaattgtttatttgtaatcatttggctgccatgcgggaccttttgccattttctttcttttggtgggacccagcggggcccactttattttcttacctaggccctgtttagattccaactttttttcttcaaacttttaactttttcttcacatcgaactttcctacacacaaatttctaacttttccgtcgcatcgttctaatttatttaaactttcaattttgacgtggaactaaacacacccctagtcataagcatgatacatatggatatagttgtggctctttctagtggaccccactcctattactcacggtggcataaacgttggtcttgcccttagaaatttagaaccaacctttctttttctcgggttatttaataacttaaactgggcccggatatggtagaagtttctcacggtactactggctgctaatggtcaagtaagccattattattaattaatactcctagttttttttctttaaatttaatcaaatttataaatggtatactaatatttttaatacaaaataatgtattattaaaatatatttaatagaaataatcttttgtcgtagatgatgataatttttttataaatttgatcaacttaaggaacttgggacctgttgatattgtagccaaaataaaccttaccaaattttggtattagcaagttaataatattgtcaaaattttggcaggattttttatatatttataaatttgataacaaactagacatagaactttttttggcaactttgacgaaaaaaaatgttatggttgaaaataatatcaatctgaacagtgtcttgaactaagaaaaaatcgtatgacttataatataaaacagaggaattatccggtacaacttgcctttcttagccaccactgacaaaagcattacgcaggtggtaggctaattagcaaagcttattaagacctctcgagcccagctagcaagctatcgtgctgcctggaaggtccgaagaagcggcggcgttgaatcgagtagccgacgtgccatacgcccacgccatttccgcgcctacaaatagcgagatttttccttgcggcttcttccaaatcttcagcggtctccgccttcagatacacctttgatccgcagcgatgaacgggggaagcccggtgatgacggagagagagcggcgcgcgtaccggtacgggcaggcgtcgtcgccgacggcgcgggcggtcgggcagctggggtgcatcaggaagtcgtggtccaacgactcgctctcgagctacggcggcggcgggagggccggcggcggcggcgcccaggcgtgcgtgtgcgcgcccaccacgcacccgggctccttccggtgcaagcaccaccgccaaaacgcctccaacctcggcgccgccgccgcggcgccggcccaggtggtcgacgttgacgcggacgccaagcaccaggaggcccaggagcaggaggagaaggcgacgtgagggcgaccatggtttgatcgatctggcaaacttgtgcgtgtttaataaa

SEQ ID NO: 64401 - DNA, 6100 bp, Oryza sativa
gaagtacaggttgaggagactactacaactgagaaattgtagaggataaagaactagctgaggagacgacagaaggtgaaactacagctgaagtacaggttgcggagactacttcaactgagaaaattgtagaggataaagaactagctgaggagacaacagaaggtgaagctacagctgaagtacacattgaagaaacttcaacaactgaaagaactgtagaggataaagtggtacctgaggagacaacggaaggtgaagctactgctgaagtactcgaggaatgtacagccattgagaaaattgtagaggataataccatagctgaggagattacagaaggtgaaactgtagctgaagtacatgttgaggtagctacagcaattgataaagctgtagaggaaaacacactagctgaggagacagctaaaggtgaaactacacctgaagtacacgttgaggaaactacaacagcagaggaatctgtgggggacaaagcagtagatgagacaacaaaaggtgaaactacagctgaagtatatgctgaagaatcaaccgagaaaactgtagaggataccacagttgaggcaccagatgagaaaactaaaacagccaatgatcctgtagaggatgccaccgttgaagagccagataagaaaaccgcagccaatgatcctgcagaggatgccacagtcgaagagccagataagaaaaccgcagccaatgatcatgtagaggatgctacccttgaagagccagataagaaaactgcagccaatgatcatgtagaggatgtgactgttgaagagccagataagaaaaccgcagccaatgatcctgtagaggaagtcatccctgaagagacagataagaacaccacaaccaatgatccagtagaggatgtgactattgaagagccagatatgaaaaccgaagccaatgatcctgtagaggaagccaccgttgaagagccagctgtggaagctgggacaattgaagagattgctacggctgaagcacgagatgagaaaaccatgataaccgaggaaactgcacaggatcccatggttgaagatgagaaaaccatgacaaccgaggaaaccgtacaggagcccatggttgaagatgagaaaaccgtgacaacggaggaaactgtacaggatcccatggttgtagatgacaaaaccatgacaaccgagaaaactgtacaggattccatggttgaagaaggtggtacgaatatcgcagctgctgaggaaactgtagagcatgctgctgctactgctgaggctttggctggacaagcaagttcaaccgagcagaacgggtagcataagctggattcttgtaggttttggatgatattgcggcagtcggctcaactgattcatccaatctggatgtcgtgtggaatcaactctagcaacatagcgatattagtttctagtaactacggcgtatttgctgccttctatataaaccttacatgtagttgtcttgggagcagcagcagtgtgtcacgaatagaagagtttcttcagaaacggtggtgcgacagccagtggaccagctactggattagcatccgaattaagccatgttctttcctactacattttaagggcctttgggccaatctaccggggactcatgattcttgtaccaatcttccattttgtaaactggctgtgttctgtaggttatttctcctttattccatcatagtagctcatatttttcaggctgattctacatttctggttgcaacttatctaatctcatcatgaaatgtacattttttttccctagctgcttgattacttgtttatctgtgctagaaaggttgatgagtggtaataatgtccatttccgcttttccttgtcttaagtaattatgtttgtctaaattgcaaccagttgtactttgatggttcagatagtcagtaaacgttatttttctgtaacttctatcgagttgggctgaatcctaacaggcatccagatttttcagccctgtttggtattttatcccctgcgctgcaatagcatatataagtccaggcaaatttttctaacgcaaaatagcgcccacccaattggcgaacatcaaggtgctcacaaaagcttgatcacggctagattggatgaaattagctcttttttatttctttttttaattggaaatgaagcatgctcacaaaagcttgatccgatcttatcacggctagattggatgaaattagctcttttttatttctttttttaattggaaatgaagcatgctcacaaaagcttgatccgatcttatcacggctaaattggatgaaattagctcctttttatttctttttttaattggaaatgaagcagccaagttttgataaagcaaccttcagttagcaacttggcgtaggtaacataaactgagcacgtccccccaaaaaacaagtactccaatagataaagccaacatcgttcacatttcacggtaaatgtgatacgccaacagcatcgcactcttgtttggacttcaagagcgaccacacatgggagggagagaatgggaatcagagtaaaattgctaccattacagagagcatctatttctcaatagtacaacacgctagttcaggacgaaatacaacatgaatatttatgcctcccaatacagattatatggaaccgaatgacagccaaagaccaattgttaaattatcctgaatatacatacaacaacagagctagaccacgaaccgaaactatcctcacggggagtaatttacatctgagaagcagccttggctcgacgcttccaagcagcatcagttcctggttgacaaacatgggacctagaggtggtagcaagttacttccttcactgctcaccatgaggtgtaggtatatatattagctaacgactgcagcaccaaataaaatccacctgcgctattagcaaatgtgtcggcacatgaaccattcccgtacaagatatcaaaaattcgaaatagcatatggttcttcgacggattaggtatacctagcaacagttgcatgaaaaggtcctatcttcagtttgagacatccccattatggtactgggcaaggcaaaagaaagaaaaaaacatcagcaaacgtatcgagatcagatgagattatgcaagtggcaatatcttatgccagaaatattgaaaagtgaactcttacactcaaacagtaactttgtgcatgtttcagtttttttaatggattttgcccagatctaaccaaaacaaaaaaaggaagggaaacaagctctggctggatgcattctgctgaaggaaatgcacctagatttatggatttatcattcatttactgttcatacacaaaatatccagtaattctttgatctcagtaactagacaatgaatcaacctaaaagggacagtccaacaacatactctctgtaccaaaaaaaacaacttgctttgaatctggacaaacatttgtctagattcattgcaaggaattgattttttttggtacaggggaagtagaggatggagaggccaatcatgtttactactccaggaacttccaaacagtagaagtctcctaacactgaagaaacaaaaggacggcacaataaggagattaaaagttatcttctcatgtgtctctttaaaatgaccagtggcagtagaatggtagcaggatggcactactagatatttaccagagaatctcacgttcatgttattattagaacaaatataggcataataaagctgataaatctaaactaaacgtactacatggccagtaaaaatatcctaaaacaaagaggaaaaaaatcaaacacaactgtgaatcaactagctaatggaactccccgaagtctaaaccacaatattgtcttgtatgctcccaagacatgacggtatattcagcaaaatactttgacaacgatcaaccatgtgtatatgcatactgccagtaattccaaacaattgaagataaatcacctgaggttgcatataacccattccttgattgtatgctgcttgttggcccatctataaagaataaaaatagtgtaagttcacatcctgttggacaggaacaagaaaacaaacaagcagacactaaccccttgggcacttgaactgcttcctccatgagaaccaagtacatcctttttcacagagccatcaccagcctttgcagttaatttactatcaccctatgttttaatgatgataaaagagctgagcaatactcaacacatctcagattttgtgtaggcatgatagtacaatcatgaatcataatagaattcttggtcttaaccatagtaaaagagtgctctgcttgctgtatggtgcagaatcatgattcatcttgtctttttacctattgattttcaaaggcatgtagcatgcaattttttggcccatatagaattgatacagggaaacttgataaaaaatttgtttcactcaagactatacgaagcatcatagtacatccaattgacaagaacaaggtatatatacgatctaaaactgatggaattattggatcccatgaagagaattctatatgccttcaaaatttggacatagctagctgcacaggtgagctaagctcatgatgcagacaggattgtatagatcaataattcattttcaaggctgattttatttatgaactttatatatcttgaacatttgcatcttagtgtctatgaaatatgaatgcctcttagtgtctatgaaatatgaacacaaagaaaagcatggatttgtaggaggcactcatcatcaagcaaaaaaatcagtagcctatggaacatgataacaaaatagttaaataccacgtacctccatctgcaaccagcacagccattcaccaaacaaaaacaaacaagagaagccatattagattgataaaggagacttaacaaacgaaaatgacaggcatacacaaagtattaatgttttaactccaggctacactaaaaaaaatgttgtagagaatttggtctttttttaaagctacactatgatatgtcgtgtaagtaggaagttttatcttcaggtaagtaaactttcagtgtaaaggtgatctttttataggatctctggttgattcaaaacattttactgtatttgcattggatcttataaaatttaagattgacggtaaacatggtaaatgaattaaatagcattttagtagctcaacgattcataaaaatttggacttggtacaaggttagtaggttactgcaaatgatcactgctgtgttttcaggtccaagcaacagctttcaattaattaattaatgtactaacaccatattccaaccattcctttcacggtataaaattggaatcataaagcaagatttgctgacaagaatctttcttccaaagcaacatgagctaaagaaattagctcataccacaaacattacaagttatccatccgtcctcaagttgaacaaattactagagtatactccctaataatattaaggttaccaagcaagttattagtaattcagacacacctcgaaaaagcaaactagcgatgtccctacctaactcgcaaagcaataactaaacctttttaaatcaacagagaatcaccccaattccaaacatccacatcagtacgcacctctctgtacttctgcaggtagaccttgaggggctcgatgtagtcctcgaagcccagcgtggccatcgcccacagcaagtcgtcgccgttgatggtcttgcgcttctccctctggcatttatcgctcgccctgtaatgttgccccaccacaacaaaaacccagtcacatctcatcgccgccaacgacaagtcaaacaacgagctcaaagctcaaaactcaaaagaagacagagcagagcagagcagagcacaagaggggggaggacgagggcgacgactcactcgctggtgatgaaggagatgaactcggagacgcactcctgcacggtctccttggcgtccttggcgatcttcccgttggccgggatggccttcttcatgatgcggctgatgttggcgatggggaggaacctgtcctgctccctcacccccccac

SEQ ID NO: 64402 - DNA, 7898 bp, Oryza sativa
tcctccccccgggctccccggcccatcagccatcccacctcccccctcctgcaccaccaccacccaaacccaaaccctagatccatcagtccccgcatcccaaaaccctagaaatgggattcgagcgaaggagagagaggcgtaggcgtaccttatatagaagcgcgggcgcgcgcggagagggcgccacgtggagaggagagagaggggggttgggcgcgaggtggtgaagcgaggaggagagagagagagagagagggggagaggagagagagaggaagcgggggtgggaacggagcggaggtgaggcggagaggcgagagggggagatcggacgctggagaagagaaggcggctgaggcgggcgcgattgaaggggtcggggtatcagggccgttcgtggaggggtatatatagggcggacgcgggcgccgccgcgtggggggtacgggtgagggtttggctgactgggtttgcctggccggtgcacggtggaccgggtgtaggggtctaggggaggagatttctttttttcttttttgctttttgggtttttcttttgcctttttgtagccttttgttttaggttttttttagaaaaaaaaagttttggattgaggtgagtttgtcgtttggtgagagtgcacacaacgtgggggttttacagttttacatcacaaatagaatgtgagatttgccataaaaaacatttatgatttgctttttttttcccgcttcttcctctgatacacgaggcatttgattttatgccgttcttaatatacgagtgaacatttgttatatatcaccattcatcagtggagggtaattagccgggaatattagaagctaccgctgctatacgtgacgctgacctcaattatttttgactggatggagtattttattaaaggttttacattgccataggttgtaaagcagtgtcattgtaacaacaattaaatagctacttcaagcgttaaattttgttttaaaatatagctacttcatcacttgttatattatctcaaccaattacaaccatatttcgtatagatttttcacataatttttcatctaaactaatcacaattatcactcgtttaatttcatttcgcttcttagtttctgtaaaaagttctacaagtacttgtatttttaagcaaagtgaataagttaagtaatacctattgaatacatacatggataattggatatgcttgtaaatcgatcggcagtgatgacaagtccagaactaaggtatgcgcatctaagccatttaattatattataggtcagcttttactaaaacgactagaagactgtgatagtcctatgaaaatatcaatactgaacgataggacgacaagatatttacaaaaggcagacatgactaacgtgtttttctgagggaacaaacagatggtatctgaacagacagctttatgtcaagatgttccaagcaaacaacattatctttttggacagaattactattacaattataactaacaaagtatttgaggaccgaaaacttttcttcagaaatgattatcatctcttgcaccgttgcacgtgttctaccctttcactttgcgtcccgtatgtgtaaagtcaactgcggatcgcaagatgttgcagctaaataacaaccttatcatcctcatcctcggacacaattacaattaaataagatcggcaagatcaagctgcctgatactgcaagtgattgtgcaagtgagaattttcttttaggttttaaggcttatggacaaagcaacaacatgaggggagtagtatactagtagttagtatagcatatcatcatctccaggacctatacttaaccggcatatattcgacagatgcgcatgattgccttccgctatttaaccgggacagacagacacaggactcccatcgcatctggaagcgaaccgtgtcgccattttctagcgacttcggccgtccagcgaagcaaaacttttggcgtcaacgcgaagctttgcggaaacacacaatgacacaaacacaacagcagctcaaaagtgaatgcagacacaacctcatgctgaagccaacatgaccacgaacacgtacatgcgaaatgtgtccccacaaaggcaaggcatgaccttatcgaaaactttaaccctgcctatatcaaaattttcgttgctaccgattttttgattgggtagagaaccaacccaagcatagagcgacctgttgttgaaaaagaaatttacatcgtaagaattgatccgtcgtgaaatctctgcaccacgagcagacagtcctgaaactgagagctggtaacaaatgcttccaaacgtattaggcaatataagctccaataggcgaacagaacgatggatagtaatagtattgaagattttcaccagccacgtatatttacaccaaaagagaaggtttgcatcaacagcagcgagctaagctgagagtcgccatgttcgcgactacttgagcacacctacaggcaactaccactatgtacagagaaggaagggcatgcgccacctcagttttttccctttcctaacatcagctccacccgaatcatatgtcttggtaagttaagcagtgaaccacccacatttacaccatgttttcctacgtgatacttacaaaacacacatttctactgcgtgtgatggcatgcgcagctagatgctatcagtttcaagtcaagataagtggaaggacccctgaccttccgtaatcgcgtagagtagtttctccctcatcttgtcctgcagattgcgtataacaatttggtgtcaatgcaaatagtactggaaatcaagaactaatcacggaataatatctttaactactttaaaatctcagtcgttctccctccccttccaaaaaaacggctctagaaaagcccatgaaagaaaggcataaacaaaactgaattacttttttatcttcggatatgttgcacgcacaggcatgtaactagtctccaaaatatgcaagtgtggttttgagattttgacttaaacctaggcaaaaccgtcaattcgttctagttatagtttagtagatgatgtctcatacggtgacataaatgagggattgatttaatttatgaaaattccagaatataccagtggactgttaaaaagctaatcagaacagtagtatgttacagaccttggaagaataggggggtaactttagataattagcacaagtcatcacactcggaaggtcatcatcagcctcgttgctgttatgctgctgattatattacaaaatattagggaagatagtaagaaaaaacaaatcctaaaagaagtatataatgaaaacagacctttcggacaaccgtcaacttcggatttagcgcagctaacccacccggtgggagtcgaggtgaacctgttataaattgcaagaaagctctgcgttgatggccttcaaactcctgtataacctccaacaactgcaatgtatttggcatgtaaagaaaagagcctttactaccatttcagaataaaatatttaaccgtctaaatatatgaatactgaagaacttacattaatgacaggagggctgctggaagtgtagccatgatcaaactttatatgatccacaagtttcgcaaactgttcacaaacaaggatcagcaagggcggtagaatgaacacagaagtaacaacaaactccacaaaagaaaggcgcttacatcccacgtatcttgttcaccgcagagtaatcgctccagctcatcctctgagaagacctggagcatgcttaatggaaatacctgcatttcccaatgtcagtttcacaataaaatggattcctaaaggacaaatgccaacaacacagctttcctcctaattataaattgagacggagggaacggcacctaaaccctcaacatatctgaatctgttcaaatgaattgaatggcgatgaaaaattctaagatagcgattcgccctacctccctgcccatttccatactagcatatcatattgctaatgaaaaccaccatgaaacatacctcattgaatcctgacttaaaagcttccagctgtcttgcaattccacttctaattgttgcatcaacaacaaaagaaacatactgttctaaattgtcagcacttacctgaaagcaacatgaacaattaagtaagagtctaatcagctaagaaactgaaagcattgaagtgtatgctcatatgcgcttacattatccaagctattttctaaagaaagaacatattctggatatcctggaagagcgaactcaatagcaagatcctcaatcctgcaacctcgataagacaaatcagatgtactcttgcagtccccacttgaacttgattctaaatattttctccgagcagcaagtgctttaaactccataagggtcattgctagttcaggatcaaatgagtgaatgtcatatatattaagttcctaagaaagaaaaaggttatttagagacttggaaagtatgaaagcatagcaaacttcatccagggattcagtccaaaatacctgtcctagtataagcctgtaaaatgctttagaaaatggaatgtcgagaattctgttgtctttaactgcctttgcaacgacctgaccaaggaggtggaactgtttattcacttctgagaaggaagaacaatccacatgggtggaccatggtttaggaaaaagtccattaggggcaaccacaaatacagaaccaccatgaacattatccaggccagcttcgccggagagctcccctctccacatgcctaaaccagacttctgaaactcatgacttatcaatgtatagaattccatcgtaggacccaagcctgtgcctacttcctcttcatattctacttcaagcattgcattactccgagcatgtgattgcatcactttagcagcagaaacaagtatattgtcgcgatcaactttgaactttttccgtgagaaggaaggcaccctttctgtcattacaccactgccacttgtatccatcatattcccatgttgtggggtcaaagaaccaaatgctgtcagctggaaatacttccatcttgcctcaaaagaaaacaagaagggacatgcagacatcagttcagtgcaccataaaggcaggcaacgagaccttaaaaccaagggatcatgcatctgttgctccagtttatctgtcaatttagcactgacaaactcctgctgtggaactacagaaacatcaactttcagatcatcaaggtcagttatgcttccatgtacaaaagcacggtttctctcatcagagacgaggtgaaaagagtatcggttcaacccctctagaacttttagcataaacaatatgtcatatgatggacttgatctgtcaagtttgcaaggaagtttgccaagcaacaggctagtgaagaaagggagcgtctgacaaatatatccagctttatcgggatgtgctggtgttgttgcacaagatgaatacttaagaggatcatcaatttctgggtttgtagccgttctatatgttacatcatgcacaatgcgccaaaactggttgtccaatattatgtcagaacctgcattaatctgatcctgcaggattgattgatacagagtaacagattggtcaagctcttttcctttcaagctaaataacaattttggttgcgcagcatgatcacttgtgtttgtctcttgttggcctgcacctgcacatgcattgcagtattgaagtttccagaataagaggaagtatgcaaacaagagtttaaacataagtgtttcacgatcgccagactacgcttactgtactactcctgtacttaccagatgacgaaggccctttatttgagcctggttctacagatggactttgatttcctattataacaccctgaaaaagagaaccattttagtcttaaaagacaggatggccatcgaagtaatttacaacgctgtcttttgtcagatatagcatagcaactgctctttttggtacagaacatgttgctctggaacagcaactaaattaatttgaccaaagatgtttctgaaatattttttttggatacatgaaaacataacaggtaattttagtacaaaaagtatacatcattagactcttttaacgtctttattaaaaactagcacggtggcccgcgcagattgcgcggctagcatcattatattttctctcatataatagcatatatgttttctcattatattattaaaatatattacaatgacaacataattttaaattttgcaataacttttcaaaactactaatgtgtaataactactctagtctcctcttctaatattccctattttttaattctgaatttcagctatttctaaattgtatttctatatgtactctgctttttttttctgagattaatgtgagaatttctaggccatgagagcgaacgtggaggctcctttttattccgaatttagttggttttaaattccaatatgaactatatactctacttctaaaattccttattttttaattccaaatttctatttttttcttaattgtatttctatatggactctatactctacttctaatatttcttatttttaattccgaatttcggttatttcctaattgtatttctatatggactctatactctacttctaatattccttatttttaattccgaatttcagctatttcctaattgtatttctatatggactctagtctcctcttttaatattccttattttttaattccgaatttcaattatttctaaattgtatttctatatggactctaagtctcctcttctaatattccttattttttaattccgaatttcagctatttctaaattgtatttctataaggactctagtctcctcttttaatattccttattttttaattccgaatttcagctatttctaaattgtatttctatatggactctgctttttctttttctccgattaatgtgagaatttctaggacgtgagaacgaacgtggaggctcctttttttcccaaattttagttagttttaaattcctatatggactctatactctacttctaatatttcttactttttaattccgaatttcttttttttttcttaattgtatttctatatggactctatactctacttctaatattccttatttttaattcagaatttctattatttcctaattgtatttctatatggactctatactctacttctaatattccttatttttaattccgaatttctattatttcctaattgtatttctatatggactctatactcctcttctaatatttcttattttttaattccgaatttcaactatttctaaagtgtatttctatatggactctgcattttctttttctccgattaatgtgagaatttctaggtcataagagcgaacgtggaggctcctttttttttccgaattttagttagttttaaattcctatatggactctatactctacttctaatatttcttattttttaatttcgaatttctttttttttcttaattgtatttctatatggactctatactctacttctaatattccttatttttaattcagaatttctattatttcctaattgtatttctatatggactctatactctacttctaatattccttatttttaattccgaatttctattatttcctaattgtatttctatatggactctatactcctcctctaatattccttatttttaaattccgaatttcaactatttctaaagtgtatttctatatggactctagtctcctcttctaatattccttatttttttaattccgaatttcagctatttctaaattgtatttctatatggactctgttttttctttttctccga

SEQ ID NO: 64403 - DNA, 6406 bp, Oryza sativa
ccccatgttaaaatccgaatatatttttcactctcagctattaatataggatgaattacccccttacctaatctgaagcaatttttatcatacgccacacacgtaacaatccaattagcatttttcttttaaaaaatgatggggtccagctatcatagtctctcacctctctccctttccctttttcccgtttaaatgtccctaattgtggcattgacggcggtgaggcagccggcaggcctcagctgccacctcttctttctttcttccctattctcgaccttggcaggcgatgacaccagaaacctccggaggagacgcaaccgccgagcgcgatgttgtaggcagctgaggtaaggtgggctctccatgggaaggacaaggtgtacggcggcatcggtggtggcggagatgacacgatcgaagtagatttggttatggagctcgatgaggcgcgtggcggcgtcggtgcacgtcgcgacgggggaggaggcgagaaagagggttgcgttgcataggtgcgttgatccccactctctagccatcaagctcgacatcgtcgacaccatccacgtgctcctctccacactcccgtcgttgcttcgtgcactgctcccatttcttttcctcctctcgctatgccctgcatcgtgtccgtgtgtgtttttgagctttcttaacttttagcgccatgcgctttgctccgctttatagcaagaccgggaaagctgaggagagatggggaaacccaactgctgccggtcgggatggacaggaaaggggcggggataagcttgtgaagaagcaagcttattgccccaaaaaacaaaccgacccagcaagaaaacgtatgcgctttagctccaccctcaccctgcacgccgtctcggatgccctcctctgcaacgccatccccgtcacctccgctcactcctactccacacctacgtgtatcactcctcctactcttctcttcccatgctaatgagctcatgttcaacaccctcgcgctagcctcctggcctttctcacactttcgcggcactcgttgccacgcaatcctctgtcgaccgtcacgccgaggccatccaagcgttctcccgaatggatgagttcgacagttgtcccaccgccttcatctacaacactgccctcaaggttcatcgccgccgccgcccagctcttgtctagcaacttgctccccttcttcccctcgcgccacagtgccctctcgaccgccgctgcactcgacgcccctcaacgatacctgcctcgcccctagcaaacaaccgagagagagatgtgtgaggtatatgacaagtgggacatgtttttttaatctttttttttcgattggactgtcacgtaggcgtcacatgtataccacaggtcaaaaccgcttcggattgggttaagaagggtaattcatctagtattgatagttgagggtgaaatatgtctggatttcgggtttgaggggtaattcaaatcagggggctaattcagacttttttctggtttaaattgttgaatcttgaatatatatatatatatatatatatatatatatatatatatatatatatatatacttactctgctttaaaagaaacttgaattagtgaattcgacacctcaccttacaaatacccccttgaactttctaatattgatatgaatattctctatagtaaaacaaggatgggtcacatctcatgaaatatatatatatatatattcttatgaatttcagataatgttataatatatatatttttctatctgtactaaagtacgtgcattcagctagtagttgtaaattccattttgagccttaaacgattttcaaattatacttttgttacaaaagttttcacttacaacttccagaaattgaaaaacaactacattcgttttaaaatccaatatgaaaaaaaacaagcaggttttctgtaaagaaaaggaaaacaaatggaatatttttgctgcccctttcgtttattatggagtattttgtgattttgtcggtcgatctgtcccaaaatccaaacgaacgggggtgatggacttgcccgtttgaaacccccaaatcgcaggctccacagagaccaacggccatatccccaactttggattttggccaccgccggcgccgccgaccccacgatttccctccacactgccacccacatccgtcgtctccccccggccgctcccccgctccggtttgaaatcccctccgtgtccccagatatccgccgatcccctcttcgaaaatcggcgattgcgagtgggagttattgagaccccccccccccccccccaatcataggatactggttgatccgcgccgactcctctcgtctgctgctgctgctgctgctctgcgctctcttcgaggaggaagaagatcatcaggttagtcttggtttctactagccgtccgaacttggtttcttttgcaggcgatgttatgcatggtttcacttgatgagtctcgtcggtctcgaattctcgtagattcgttcgtttttttcgattttttttgtcatcttttggttgtgggaaaattatctggatttcttggtgcgtgctcagggttagtccgtcacctgttcgaccgatttcctgaccgaaatactcctttccctcgcaggagcacctgttccgccgcctctgtcctccgatctcacagtcccatccgcctcgccgctggtagcggcaagcaagccaaagacgccgcgggatcccaatatcccatctccacgggcagcagcgccaccgccacggctggagcaaccaaaccaagggacgcgggcacgttctactgggaaatcgccacgccgaattttgtgtgtgccaagcggttcgtgccgaagcatttgtggtccttttttttttgactcctccatattgtctataaaaaaagacttgtgatacatttactttctgatggatttgctacttagaaattctaatgcatattagttagcagttgcgtttagttgtacaccaactgctcagtgtctcagcctgcagcaatgcaactacttggaacagctattgatccaaagcttgcactattatttgaataatttttacttttgatctagaacagttgcacacattttagggttactttgcgcttaccctgatgttttctccgtgcagaagagtattagacgctcctgaagatgagaaggttctttccgttccgctcattcacaagtaatgctgggaatggcaaagcatcagcgggacatgataagaagaatgagaacaaactggatggagggactagctgtgcctcccattctcctgacacacgggcattcaggtcaagaagccggcatggaaaaccaagcagtgaggaatcatccactcctcagctcaggaggtgcatgtcattgacgtcgtcagcaattgatcgttccttgaatgaacggacaatgaacttttcaggcgatattccatgctctttctccaatagttctgatgtgcctcgacacattggggatgcggagtaagtggattaaagataaaatttacttgtgcttgaggttcccactgtctgtaacttatgcttcagcaacatcaataattaataataataactgaacactgtgtcatcccctatttggaaaattccaaacaatctgttttttcccaagtaagtggtagttttacattttaattggtttgacagagctaaaaccaagcacaaagtttggtggtgcattatagactcactatctgttactagattttttatttctagctcatgcccattgtgttactaacaaaccacttatgaaaacttattcaactttcagttaacaatgaactgtttttgaaaacttattcagctttcagtcagcaatgaactctttgcatattatcttgagcagatgtaacctttagccatgtttagccccatttaattatgtttctgtttgtcctaattgtttatcataactgtgatgctggagattttccttttaaacttactattatcatgcatggtattctatttagcatgatgactgaaggatggtagaaataaaaggttacaatctttctgtctgcaggtactatccctggtcacaagaaagacacaccaatatgggagaatacacgatagaggttccaaaaacacatggggtacaggaaagtgattcacctcagtcaagatgctactcatgctcagcaggacactctcctgttagttctcctgttgtgttaaaatgcaggccttctaaattgaccaatctttcaagcaagaatgaagttctagatctatatattgatggagagcaagagtcaaacagtctaaatgagaaacataagctaaaattacctgtcagatcctcatcatcttatttgggacggggacggccacctagaccccattctacagctccatcttcaccaaagtcttgcaaagaaatcgttgagagctatagctactcaaacatcgacatgattgatgcctgccaattagctcaggaggaaacaaagggcatatggaaggttgcatctgtgtgtgcagagcctggagatgatgcacaaatgcttgaagcatcttctgaaaaattttcacatatagaggagtgcaaatcacaaagtattgctacattggaagatatttatgatcgtttggaagatgcacaacctccatgcttttgtgacacttcaatggattatatttcaggcactacctcaagatgctttgatgcagatgtctgttgtcgtgatgactctcatggttttcatggtaataaccttgaacaagacactgatgagaagttgcttagaagagctaaagaacttgatgagtgcttcatggttcctcttgaagaaaataatgagcttaacatgctgagggataatagtttaagctcaactgacatgttgcagctgatacagactttgattgaagatagaaggcaattggcactccaattgtcttcacaaattaaggcacgtcttacagagagatttgcagccaaagagcaacataagcggtccaaggtagaattgaacaccagaactagaaggctggagaaggagaagagtgatgtgcaaagtaccttggaaatggagcttgatagaaggtcaaatgattggtcagtcaaactggcagaattccaatcagaagaacagcgattacgggaaagagtaagagagcttgcagagcagaatgtatcttttcaaagagaagttactttacttgaatcgaacagaattgatgtttctaataagataacaagtttagaactgcaaaacaaacagctcaatgacgagctacagaaagtaaagaaagagcatgatactcttttgaagtcatcggttgagttgaatgataatttaacgaaaactgcagaggaaaggaaccaaatcctggaatgcttaaaagagaagggaggtgacaataaagcattacacaaagtgattgcaaggttgcagaggatatctaatgaacaggagaaaacaataactggcctgagacagggattcaatgctgaactggaaaacaaatcccttggtactagtgaaagcatcagcaggatgcaaatggaacttatcagacttactggagtggaacaaaagctgagaagagaaattcagtcctgtaaccgtgaagttgagtctctaagggaagagaatatagctgttttaaatcgtctacaaagcagtgataacaaattaagtatttcttcagttcgtcttgaacaggagctcaacaccagagtggacaacttgcaactacagggcttatcgttgcttgatgatactagtcagctttgtgccaagttgttggactcaatgaaatctaagaggagtgagagtttcggaagtgttgatgcattagcatccattgaatacactttgagttaccagagcatacaagaaagaatcaagaatttaaaacaatgtcttcgggcaatcagatctatgttgactgaaaagcataatgaagaagaaaagattggagagagaactgaaagctgtatcttgaaacaggaccacttatccaaggtatgaagttcctagggcctttttacatttggaagtatcctatttatttttcagtcttatgggccggtggttgttggcttaagactttgttctgtagagcacaaaaaaacacttttttcaaacatatacagtgaaatttggtacagagacaatgttctcaaaatatatctggtagactctactagtacagagacaagtctcagaagctaaatctaaacctccgctttcctttttgcccttttctatgcaggatgacattgaatttaagttaaaagaagagtctatgctctgtagagtactaaaggagaagttattgtcaagagaacgagacattgaacaattgcagtcagatctagcatcttcagtt

SEQ ID NO: 64404 - DNA, 3592 bp, Oryza sativa
  unsure (1)..(3592): unsure at all n locations
cactacggattagagtgttgacattaatttgtagcgttccagtactatgaacatcacacaattagcgtgcgtagtgtacgtacgcacatggctgtaaaatgataagtactataacacatgttggcaatagcagtctgatcgagagttgaattctttcccgatccaaggcaagtttgagcgtccaaacgccgtttttttttttacggagtatacgtacttgtaaacgattagctacctaggattaaggccgagttagtgcgcgtcacatgaataatgtacgtacctgataattaaaaactagtactaaaaggcaatcatgctatgcatgttgataccggatgcatgcacggaggagaggaaatggaggccaggccaaccagtcagtgcaaggtatagccacaggagcggagaataattaggaaggaattagcagcagcaaattaaaacaagtttaacagtataatcaactgtaactaaaattgattagctaatttaatagcttaatcatacaatgctatagttgagtaattttatagtatatcattattttctgtcttacctcacatacacaatttttgaaagccgcgttatagttgaattataaatctacagttcgttttcttttctctttcctctccgatctcctctatcaaagcacaaatttagtatatcaatttttaagtctgtttgtaacagttattgtgctcattttaaacaagatgacactgacgacgtctaggacagatgatcacaaggatgcacctaagctaggtgttgatgcatgcgttgtactcctttcgtaaaaaaaaaacaatctagaattaggataaaacataatctagtataatgaattgggatgagtctgttcagatttgttgtactagattctatctatactaattttaggttagtttttttttatgaagagagtagtatattgttttcagcaattctatcaccgtgacataaatcaacaaagctttcattattaagaaaaagtggtaggtatagctagcctatataaaccgtgtagtactcctagctagttaggcgtggcatctagctagctttccttcccacgaccagctacagacgcagtagatcgatcgatcaaccactctccaactctccattcgttctgttacatactcatcctacatcgacaacgtctccagtgcctgcgcgacattgatattcaggtcagcttctgcatgcagctagcacacacgcacaattcctgctacttcatgcatcgtttgtatttcgtgtacactaggttgtatcttgaatttgggagagcttaattagctgattaattgatgccatgatggagagatcatatatataatctggtgtatgattcgtcggaacagtacgtctcgaatggattaaagaaacagatgaacgactagcttcagcgctggctaattctgtgatcttgcttcctctgcctgcttgaatttgtctggaactgaatattgcatggcgtcacgatcgattttgtcatttcgtttcatgttttccttagaggaagccgcgtgcatttcgtgtgtttgtcttcttcttccttgcttgcttcgctccgttggttcttggttgtagtactccactgtgtatagatctacaggaatttaacctttgctctctcgatcgagtagcttgatgcaaatgtgttttggtttgatgtttacctgccacactacggatgcagttaggtttctgctaactgctcttacagatttcggtgttatatataattagtactacattaaaaggagaatcattaattctcctcctttcatcaaacccccctcccttgaaatttttaaaaaaaaacannatattcggaaaggnnataattggatccatgctactataaaaatatgtttgtttttttttttgcgggggaagggagatctattactcagataaagcatccacatcaacaagatgtgtaattaaattacagctctcatccggccaaaacttggacaaagtttcagcacgggccttattagctagaaaataactaatggaattctgagaacgctgaattttcttgaggacaatctcccggtctccagacatcagaatcccgatgtctttaacaacgtgagcaagcgctgacatttccttccgcgcatcttgaatcatattaacagccgtcaggcaatcagtctctacaattatcgacagtaaggtccattgaagcgccatattgagcccctctttgcaggccagaagttcagactccagggggctagtacaacgctcaataaaaccacaggcagagaaaataacctggccgctggtattcctgagcaccacacccacacttcctgtgcttgttacagagtcaaaggaaccatcaacatttagcttcatccatcgctcctgcggtttctcccacctgggtagagcctctgaacaatcctgatgaattttcaggccctgtcttggtctgcattgaaccacatgtttccctgtaacgacgtttgcttgcggatattgtttgatctctaagagcgaggtgatatagctctgtagaaacctttgcgatacatccactggaggcggcactttgtcgtgaacaatctcattatgcacaaaccaaatgtgccataacaacataaacagcataggtctttcctcttttggtgttagctcaacttgttcaaacagccaggaggatcctgtagaatttccgacaatgccgactgacaagttgcctgaatacagcaaggcagaccatagtcgctttgcatgtgggcaccttcccagtgcatggccaacatcttctcttacagtaccacaaatgcaacatatttctgactgttctagtttccttctctttttattctccatagtggctaggctgtttgtagcagctttccacatgaagattttaaccttttgtggcacttcacacttccagattaaatcccacatcttcctggacttgtcatctgacgagctggagctttcatccatattggccagagacattgccagtttataagcactcctgacatagaaacgtcccatcttgtccagatgccaagccaaaaaatcctcatcctgcctcattgaagtccgaatcctcagtatttcttcagcatcacagggaaggaaaacccgattaactttctgaacgtcccacacaccgtcaggtcccaatagctcggacacccatttcatcctgcaattacctttccttgctattggccgtcgagaatggtcccttggaatccagggatcacgccatatgcgaactgactgaccatttccaactctccatatacaacctgtagcgcccgttccgtcgtggcgcctagcgggaaaattatctcttaaaaaccctatttgcgaaatttgtttccttgcttgttgtctagtgtccgtgctatctcaagatctcaatccccgatctatcgtcgagatcaattctgaatccaaacccttccaaaatcattttcctccgcaaaagtctattttgcctcccccgaggtcgatgggccaaatctcgctcggcccatctccccctctcccccggccctctcctctctctcccgggcgatctctctctctctct

SEQ ID NO: 64405 - DNA, 17546 bp, Oryza sativa
tcttcggtgcacactcaaaacagtaagtgatgaaagggatgtcttgtggcaggaaacgaagcagctgcgaaaaactatcagcgccttgcaaaatgatgttgcttcattaaagcagaagatgaaatctcttgatgaagacatactgcttaaggagggtgaaatactgcttaaagagggtgagatttcgatactacgtgacagtatcggcaggccatctgacatcatctgcagccctcggccatcgaagctgttcgaatcggagtaaatttgcatagaagtagctgtagaatcttgcatttttcaaacagctttactttccccccattttacacaggagatcatttacttgtgaatatggaataccgaatagggcgtttgctgctttctagatttcttgtataccaatgcaatatgtgttgcattatctagtaagagacacgagtactcgacggatgacatgctcagaggcacctccgatcatagctatgtcaaatctagtcctctattatgttaattgccacctttcttttttgggaatacaaacacctcgacaatgtttatgttactggtgctgcacatacaaattttgattgatcggcagatcaggtcacctgggtactttgcacgtcattttcttgagtatccagtgcaatggttcatcatatcctcgcacattttgtaagtacccagtttaatagtgcaccatatcctcgtcatccttacgaaactagtagcaggtcagtgctaacgctacggtgatatttagtaagcatgcataaaaaatttatatatgtcaacatccatgctaatttaattattattataactatcacaaacttgggcagcttttagttgtgtagttcaattctcaatcaagtgggagcaatttctttagccataaacaaacatcacttaatgtttttctattgcttcatcaataatcgtcatttgtatcagagtatatgatgaaaaaaaattgtatttaagatatttgaataaacaaattaaatcctctaatggaataacatttggctgagaagaagaaaaatatttacaggttacaccgcagcagaagaaatcattaaagttgctagaattatgtcacaatagaccaatacataactgttgtgaaatacaacacattatttgttgcaaaaatatgtattacaaaccttatatgtaatgcaaagcgggaaactatcgtaggatcaaaaatgaacatctgagatgtatccagttcatcctgagtaaaacttttaatcctaataaaacctttgctcatggttaaaactgggagcaaaagtttactcagggtgacgtgaaccaaacattcaatttttaattctacggtagttttcaggtttacattatatatagggtttgcactacaaagtttttcttatttgttaggcagcttcaattgatgccaacattggtgaccttagctgagggcattgatatttattttccaacctgtagcattccatctattttgctctgaaatctaacatgaaaagcatgtgctgcccaaaaacctaataaatggctcataggggtttcaaaaaatgcgaaatgcaaataaagcaatatttttttactaatcaagatgtaacagtggttagctgcctgctgcaaagaataaacatattcctttacactcatctattcaaatattgcaggaacatcaaaaagctactacatatttatttgtacaaaatgattattgtgcagtaagaagaatgaatgaacagtggatatagaattatatagaataggcagattgtgaataaaatttgcagaggacattggtctgctccatttatgcggtaagaaaccaaaacgtcagtttgtctaaaaggataaaccacaaattggtgagcattatatggtttctgacacttgtattgacgataaaattaccttgtaggcttgtactgggcattgatggtgctgctttactcgtgatattatccacagcggacaaagtgatagaagcaaccttgtagctgctagccaaaagtgtgaacatatgagcccaagcagcctattatatattgattaacatgaatactgctcaacattagattatgaggcgcgtttgcgcacacccaaggaatctgacttctcaaattatcaaacaaaaagagcatacagggacaattacggattaaaatattacattcaattatggtttcaaattatatgatatagtgacatcaactcatctaaaaactatctaccccaatttttaggatcagacttcacctcactaaataactttgtgccatacatatgcataaaacgataagagaatatctataagattggctggttgcaataagacaactcttgatcagccgacctctttgttgaatgactgagcaacagagagcagcctcttctttgtttagtcatgaatgcacattttgatcagttagtgtgaggttcaggcaagtcgtactgaaaatcaggcgttactataatgaacattttataagtttggacgatatcccttcgtattaatatttagtttgaactaagatgataatttatgtaaattctgctatacaattcaattctacagatgtagttcttgtttttaacacaatgtagcatgttaggattgtactatatattcttcgctttccagcctagatatctgcagaaccctgaacatctagagtggagagcttaaatagtgatgaagttttggcaaagcagcagagccatttcctgcttggacctggattcagcatgcaggatctccagtaccatcttatcggggttgatccaatacctttcctgcacgttcatctacatgaaatccagcagaggaaccaaagtttcagtgttcagagaaacagtaagtcagaaagcaacgatagatccgctacaaacctattaacctttctgaaataactgaaaaaaaggatatttccctgcatatatgagcctgtgctcttgtagagattatggtgcttggcagcagagctcctttgggaaggacatgcataatgtatcaggattacccggtcgctagccttccaaggttatccaccgcccacttcgccacagcctttctcgaccgtgagtgatcaagagggaggagataaacaggcgcagcgtcacaattaatgggcgaagagaagctgtggacggcccagccaggagggcagcagctaaacggtagggcccctctcatgccgtggccatcgctgcagagctctcatgccatggcaaagaggcaaggatcgccaaccgctagaacgggatgtggccctggcgctggcggcagagggacccggggccggggacgcatcctcggcgacagagcagccggatcctctcggtagcggtctacggacgcttcctcagcagtagaagacctcgcaggcgtgcgagaacgtcgaccgcgcacgagtgaagagatcaggtgatcgacgaggccgttggcaccaggtgcggaagccgactgctcgcgcttcaggattccgaaattcgaggaaggggatcgacagattgagatggtggcaggatttcgggagtgaggcgcgcgcgttgatgggaaagaaatcacgcgattacggcagcctcggctgtacactactgaggtggacgcgatgatcgttagatcgggcactgaggaatactgtcagctggatttgatgaatgagtaatgtaggtgtaagagtgagttgataaattatagggtagatgaattataggtgtaagagtgagttcatttatctagatttttctgtaatgtgactatctatatcagctagacagtatttagacaaaattcaatcaaatttagtacgggatgtgacccatcaatctggacaggttcactggtttgttttttatgggatggagggagtatacatttgttttactgtttttatttttttgttttttatgagatttctacgtaatatcactacagcaacaaaattagaaatcaatccaatacaaatatactcaccaatcaaaaccaagaggatgcgttgttcatttgtcagaaccaataaaaataaacatacgaggtgttttggagatcgatcaacaaaatggtagtgcgatatttttcagggaaaaaaaacacatggtggcattggaccatacatgcacgtatatcacaaaccatttctacagtctttctctctcttaatataaaaccagcagaagctggcttaggcttcaaaaaaaaaatcacaaaccaatgttgttttgaaggctacagttaaggcctacaacaattgcatatatggcttgaaacacaggcttgtaaactgtggaaatctcccagaatcatcaagcctgtaggatacctggctgcaaataataataacaatcacatgaacgcatgtggcagctattttaaaatacataaggctgtttagtaacagcaatgctcaactctaaatcatgtgatgggccttaaattaggatctccatccaatctatagatctgccttcctgagatcttcctcatcatgcttgtagagtaactaaagaaaccagtcactggggagctatacggacaggtctgtgaggctttggcgctaaaatgtgtgcaagcgacaaaatgtcaaatttcttcacaacgcagaggattaaaatgaatgattggaccaatgatccgaggccaatccactttattgatcccacaagatcagtaaatgattctcaatcttacactataatttgtggtaacaacggggtgactttaaaatgatatcatattgattgcacaagtattccaagcaaatatcttaagataccaactgttcttcacatgtaaatgcagtgtgaagaacagagtttttcctctggtccttaggagagaggagttattttaagtgctaattgggagatagaggtattctaactcttgattaacactttgggtgcatgtacttgcaaatatctcatggaccagaaaaaaagagagcatattctaccatagaacctacatgagaattctatgcagagcaataattctagacaatggagaagaagaaatacagggaaaagaacataccatttggattcccttgctcgtagaaatttctaaaaagagccactgcctcctccgccatgatcccaccagtacatttgtaaccttttggcccgggaatttcctccctagcaagagacaaacagtttgaagttggagtgccataaacaactaacagagttcagaattaatgatgtaaagaactcaataaacaactaacagagttcaggattaatgatgtaaagaactcaataactatgttgtacgtgcaagaaaatgaaaatattaagcatgtgcaagtttgcaaaaatcatgatattgaattgaaatgttagggtaatgggcaactaatgaagcactaaaagcaacatgttatcatgagtaaacagctttctgctgcttgttgcattgctccctcaccctgacagttcagcagaagaactctgatgcaatgacatgattgatccacatcctccaaatttatcgttagcacaaccaaagtacacctcccttattcctgtcaaaagaatgaacatgttaaaaagcataaatccatatgctcttacatatttttaacacaataaagataaaacatctcagaccaagtatcgacaacgccattgcgcacattatgcaaggctcacatgtgacataaaggtcgcatcttgcaaacttctccgcgacctgtggctgatcaagtcccatgccctgccactccctaagcaggatatcaattgcttccatctcagcatgccttgtagccttagaatcggtacaggcacaatcaaattacagctttaatctaagagcaaaaaaaaatcttttacatgtaaatgcagttggtatcaattacaggttttcttttacacctgtacaaaatttttactcctgctctatttaatgaaattggcatgtttaatgctggttcgttcaaaagaaataataataataataataataataataataataataataataataataataataataataataataataataataataataataataataataataataataataataataataataataataataataataataataataataataataataataataataataataataatctaagagcaaaaatattcctaaccgaagatgtaagagcatgcatacattccgggtggcatttgtcttgttgctaccggatgaaatcaccttcccatcctccacaatcacacatctaccaagacagaataacaaaaaaaagtagagccagcagcagttaggagttactagcagttagcacagcaagaaccaaggatgaactcctatgtatgaaacgaagcaggggtataccctacagggacctcaaggttgtccaacgcaaacttggcctgcaaaaacgatccagaattcagcgccagaaacaccgtagcagcgtaaaacgtgttcttcccagcaaatcaagctggagatttcagccatacctgctcgagcgcgagctccataaactccgccgccgccgccgccatcgcccggtctggtaagggaacttccggcgtgcgtggtgagtgcactggggtgcagcgagcggcggcgggttcaggcgagcggcggcgcgatcgggttcaggtcgaggtgggttaggtttcttttccttctccttttcaggccgtgggccgagagacttgtggcccatttatttacctcgcaagtttagtttcgcttcatcctgtccagtctctgacggtagccggaggaggcagcccgccgccgtgtcctcttctcctcgcggctgcggaggagatgagcggcggcgcgaggagggtgctcgaggcgtggaggctcggggtggtgaggtacggcgacgccctcgggctccaggagaggctcgtcaccgaccggagggccggccggggtccccgacctcgtgctgtcgctgcagcacccgccgacctacaccctcggcaagcggcgcaccgaccacaacctgctcctgccggaggccgacctcagggcgctcggcgccgacatccaccgcacggagcgcggcggcgacgtcaccttccacgggccgcggcaggccgtgctctacccgatcctctcgctccgggccatcggcctcggcgcgcggaggtacgtggaggggctcgagtccgccatgatcgaggtggcggcgctgtacggcgtccaggcgtgcccgggtgccgccggcgagaccggcgtgtgggtcggggacaggaagattggcgccatcggggtcaggatctcgtcagggtttacttgccatggtctggccttcaacatcgatcctgatttgggtttcttcgagcacattgtgccctgcggtatcgccgacaaggaggtcacctctctgcggcgagaggcggcggtggagctccctcccgacgaggtgatccatgatcagctcgtgcagagcttagcaagaacattctgcttcagcgatgtggaattcaaggatgaatccgagtgcgccgacatggtttgcttagctgcagataagcaatcctgattgttttactatgtatactgaacttagagttcttcagaacgtcttgccgtcaagtctggaaatgacattaggaaattttcgtctggttttgttcattgcgaatgaaggtgacctccattttggagcataaatgaagaataaatgatgctgtaagctttgtctctcatttgataccttgcccctcttttggtctgttttcgtgagatcgaaggcatttggacaaagccttatttgctttggaatacttgaaggtcaaacaaagaaaagaaccatgagcgtaagtcatgtgtacgtttacacccatttcatctataaacacagacttattggcgttcgtcaacttatctgtttccgttcaaattactcgtcgttctagcatttaaaatttgtgtcgaatacttgtcattctcacattccaaagcacttttagagatgtctttccattcttactctcataaatataaccttactagtactagtactctcataagaaattcaatgtttgctttcggaaagatgattaggatgtaattaatgaaagtagcaatgtaatttgacacgtcttctagtttaatgtgagatttgctagaaggacaagtaaattgaaacggagggagtacaatatattgtcttggaaattggagaaatgtagttttctctggcatgttgaaggcagcttgtattttgttaatgaatggagcatacatggtctcaagctaaattgggacctacacttaaaaatccaagttactccgaaaaaggcattgaatttgtcttcaaagaagctattaatattatattcttcataccataaatatcttggcaagcttatttggggccattctgcagatatctatgatggtttgagagatctgtccaatgttgtttccttcttcatcatcctagaggacatctcagtcattgcttctgaaggtacatttatgatattgtctctgtgtaaataatgagagaatttgcaggaatggactctggaatgtaaattagcactggtatttcaattcaactaagaaattcatggtgacatgcaaggaaaacctctcatactctttgagggtgtagaggaaaaaacatgtgtatcatattagctctttgaaataaaataaactgtcttccattaattcatttacaaaaaatggaagaatctgatagaaccaaatcttcctgcatctactgtctcttcaggaatcgtaccagctgaaaatgcatcctgacattcggtgctgcaagattggagctcagtgcaggacggcttttgttctacaacaccaaccccccaagaataggcttccgaatgccgtggaagaggctgattcttgttctctgaaggtgtgctacgccgtgctgcgcttgaagaaggtgagctggcattggtcattggttcttgagccccagatgattcaaagcagatggagactgccttcccagatgcagtctgcagctggaactctgaggggctaagaggaagaaaagcactattacatgtatgctcattgtagtaggtgactgagtacaatggtggatcactataatctttctgctgaatctgcttcgttgctgggcaattcatgttatctttataggtgcatctgtagtagtatctgcaatgagacaggcgagacaacagtttgagtgaaatgaacaagaaaagggttcagttttctacgactatttgttgcaacacatctctttgtggtcgatttgggtgggtagaatgagaagagcatctaagtatcatcacagaaaggtgtctaactgataaatttcttattgtttgcaggagaggacaaggttgacaagaatgaacagatgcccactctttccagaagatatacagatgcagataccagaaatgaggaaatatactgcaaatatatcatctttcatccgaacctggggaaattacagttgtttatcttcttctcgccgtacttcctccactggtggccgtcgttgtgcggcgcaaaggtatccaccttcctcatgcgcttctctttcctgcaagtttttttcagaaacatatcaacttctactccaattgaatcccccctgcactatcatcaccactctcttataaagatcaaaaaccaaaagaccagtaatagtttttagctaccttgagccatggcctagatggtgtgattgatgcggactcggcacaggagacattgtttccagagagaaagaaagagagagacacacccggagagagaaatgctagggtgagcctgaaactgaaggccaagggagccttaattcagaagcgtaccaaactagggcacccctttttagcttaaaacatcaaagagctccataattgaggcccttatcaccatataaaaaccaccaccgctctctaagctgaagaccaaaaacgatgcaaagattatcttctcctctccccgtatcgctgtcacgtgctcccgcgcaccgacggggcgacttgagaaatttctttgcagcttcttcaaaggccccggacacacataggagctacaagtggcctcaaaatgatgtgtcaccccgtttttttaaggactaagcactgtcatcgatctagcaacttggggcgattaaatggttaattaattgctttgattggaactcgggcaaattgattatataatcggccggaccagttcacaaatcttggccagaatggaagcctgccccggtgcgttggtgattgcttagataattgattaattataaactagttggacttgacctgattctttcctttgcctcacaaagccagaggcaggaatcgtctcgttgcttggggagggagattagctgatacctaacgcatatcgatggtttttttaaagacctgcacatgctgcaggacaagttgaggcagcaaggaatctcccgcttttcgcctaatttaggacccggaaaatgatctcaccagtgatgtactgtgctttgcctccaataggggtcttagttaaaaggggcgcgtggcaactgggcggatgcattgcccggccactggggatatttttgtagagattggcagtacagacgttatgtgcatcacgatgatagcggccagttgatgaatgcatcacgatgatagcagccagttgatgcatcaagtggcactgcaagcctgaagcagtaaatgtgcttttttttttggtagtaaaattgcaagtgaaaatgctgatggcaatgcaccatgaatatactatagccaggatagattgatagtagatcataaatttgatagataaatagatagatagatagatagatagatagatagatagatagatagatggatggatggatggatcataaatactagtacgtggtcaatgaattcagagagaaggaaacacgtactcacataaggatgagatagtttattgtgctgttgctgaataagacctgcttagctgagctctgacttttacccatctccaaaaattcagaactatacatctccagttctccacctttttttatatatggagtggttactccccacgtcctcctcttggaacttaactatttacaaacactatgaggaccgagagaaaaaccagtggcattttctaattgactccttctagaaacaggacaggtaacgacttgctattggtccatagcaagataggagaagggggatgcatgctattgacatccagatcttggcttattcattgacctgcatatagtatgctactagtaaattgcccgctaatttagttggttacagactaaaatatgttgtcacaatcctgatgaacagaaataaataagggtaaaagtgtggtcacaatgaactacacgattaacaagtaggagccaagtgatagaaaattgtatggttgtggctccgcgatgccatcggcaaaataaacaagagaaatgcagaagaaggcacagctgccgtgccgctggggcgtccgtgttcatatactttcaaatctcatgagatttcatagataatgatcttaaatatatccagttcaaaatatagttgggaaatgatcagttctatactatttcttttcgatgaagtactctttagggattaagaaaaggaatcattacgagtagctctcaggcaatgcattatttggcatgtgcatgagaggcactagaacctaacattgaatatttggatttttcttgaacaatcttccatccgattataatagtactagttaattagagtccttggagaaaatattgcaccgtcagccgccgcactagggccaaatgcaaaaaaactattgagtagtccatgaaatgtaggtagacaaatagcgccaagctacacattttatagctttttttctttcttatgactcgcattaagcttgtgaagaatggtttatgtgcgggtcatgaccaaatttcaataaatctgttggccaatgcaagtctttagttatgtggaggcacctttttattcattggtctttattaaaactgaccgcacttgcagtcaaaacaaggctgcattatctgcactataaaaccaagattaggtagtggaaaccggcaaggctggtcatcaccaattagaaatcaacgttaaatatacatggtcattgtcttacgttagaaatacagccgttcagtaagacaaaaccacccttagcaaacaaacacaaaatcaccctattaaacaaacacaaatttagaaagaagaacacggttaattaatgcatgtgcggcttgatctacaccaagagacgatcgggtacttgccattgcacatgaccgacgacattgccgggaccttgtgagtgcgtgcgatggtgtgagtggtgtttaaatgcgcttcaaatataaacacagcattcgttcataatccaacaatctaaaatttatcaatagttaaagtttaaacacaccgttgagttgagttgataatttctaaagagtaaaatacacaaagagtccttagatttaatacctgtatatatgtgtcatatagatttataaatttaaaaattatatgtttatacttctaaacttggtaccaacattagtccaaaatccaacgtggtgtgccacacggacgctgacatggcaccttccccaatcctacacccatagacaaagtggggctgtcctgcaaaagtttccccttttgttttctttttcacgcttgtttttttccctcttcttcctctaatatggtgccatcatcctcatgcctcgctggtctaggccaccttgagttcgatgacacaagctcaaggaaggatcagtagggcgagaaggtgcccggtggtaggctttgcttagatggatatggataaagttgacccagtggtgggtgcgaccaagctcgaggtgacaggagtggctgagtcagaactggtgaatgatcttgcttgggcagggtggccagaagtggtaacacggcataaggacaccacgtggctaaaccaaaggctaggtgagaaggattggctctagcgagtttcgggagtcaattggccgagaaggttttagaaaaatgatgtactagacacggggattccaataataccttcaatttgttgggaggtggagtgaacacgacggatttaaggacttaagcattggtagtagaactagggtttccaccctggctcatcctccgacagcaattgaggcggcaaagggtagggtggctcctgagaggttgaagaggaggtggaggtggtgctcgaagaggaggtggaggtggtgctcctatgtattggtgataactagagaggagtcacaaagagagatgaaagtggaggagcagagcggcggtagcagtggtagagctcaagcaaaggagctcgactagtgatagctagagccgaggcttagcctatgctggattgcttgcacttagggagggtgagctcacccgtagctgcagccattgagcttgacatggacgtcgttgtgtgctcaagctaccacattaagcctaaacctaaggaagcggagaaaagaagagagagagaaagagaatgaaaaagaaatttcattagtggggttcacttgtcacaatttagggatgccatgccagcatttatgtggcatgccatgtcaatttttggaccagctttaagctgtgtttagttcctgaaaaaagttggaagtttggaaaaaaaagttgaaagttttggatgtgatgtggtgtgatggaaagttggaagttgggggtgaactaaacacggccttaatacatttagtaaggtctggtttagttcccaactttttcttcaaacttctaacttttccatcagatcaaaacttttctatacacacaaacttccaacttttccatcacatcgtttcaatttcaatcaaacttccaattttggcgtgaactaaacacaccctaaaatttcaatcaaacttttaattttggcgtgaactaaacacaccctaaatgtgtatcttttaagtttatggccatacacgaaatgcgtatcttttaagttagaaatctaaatgtgtatcttttaagtttatggccatacaagttttaggaccgctactcatttaaagcagtggtatgagcttgatttcatatagtaggaaaatagaaaatcatatatgtcgcaaatgaaaaatggaaaatcatattggacaagtttgaacggttctagaagctatcctggtaagataatctgggaaatatggcctcgaggaacaccgaatacagctgtgctgtttcctgttggcgcccacagatcggtggcacaaacgcagccggaaagtgcttgttgctagctcgcgtgtcaacaactcgcaagcttttgtagctagcgggttagttgtgcgcagttatgtgtgccgtcacctcatctaaagtttactgcagttcgtctcaagcccttccagatttatcattatgaaactaaggtaacttcgtcgaaatgcttagctcgcctctgcatatgcttgaatgtaaaaaccttttggagagcagttagcaagatcaagcgatgcatcttatccttccctctatgtttgttatactgttctttagaactcagtcagttggactaatctttcttaattctggcaatatttttatgtgacaactccagttcaattcaaatgctctaactagctcttccatcccaaagtggaaacagtaaacccttttaaaaagaccacgcagtggcgtgtggagcccaaaccggtgccagagtttcatacatatggtctggccttgtttacgagagtttttaacagctacagctaatcttttgcttaattgctcgcaaaaaatgtgcagatctgacctcccgttcgtttctgctttgaattgagagtaaaagcgggcacgtaaaatgagaaagctattaatgtatgattttaattactacaaacttaaaaatgggtatatttgacattttaaagcaatttttatatataattgttttttttgcacgaaacgcgccgttaagttgtttgaaaagcatgctaacgaaaactaaggtaaaatcttaatcttaatcttaatgagaaaagaacactttgataggtgtagtgtaggatacttcctgtgtatcatattataagtcatttgactttttttaagtcaaactttgttaagtttgaccaagtttatagaaaaaaaatagcatataaaatatcaaattagttttattaaatctaatattgaatatattgtgataacatgtttgttttttttttgaaaatactactatatttttctataaagttgaccaaacttaaagaaatttaactaaaaaaagtcaaacgaataatatgaaacggagggagtaaaaaataaacttagtagccaaaaagccgtggaacccctcgaaactttttgcattgatagacggattgtacaaaataggtaacttcattttaggtctcttaattttgtcgtcgagtctaaaatttgtccctaaaccaaaaaatcagatataacgggtttctcaatttacaaaacaggatcacccgagatcctaagcagtattatacccggttttagctgacgtggcaagttggatcagcgtgggacccacaagtcagtcacttgcactttctttctcctatctctcaccccttctcccctctcttctcctttcttcccaatcccctctagggtgacggctaacggtgcgacgagcggtagggagaagggcagtcgccggtggggagaaggggcagcgcacaacggacgatgggaaaggagctggcaatggtgaggtcacaggcgctctcgtcagggttcaagtttgagccgagcgaccagatgctcatggagctcttcctcttgccgtacctacgcgacggcaagctcctggtcccagcctcgtctttgtgaaggacgaccgcctgaggggcctaccgccactgccgtggatgctcctcgaccaccatggccaggcgacgaggccaaggccaacttcatcgggccgatggatggcgaaggggcccgataggtgtgcatgcgctccgtcgccgatggcggcaagtgggtgaagcataagtcaagcgggatgaccaccttcccaaacagccactacaagtcgccgtcgacgccgcacgtggtgcctctccagctagtgtacactgcgaccttcagcctcgccctgcacgactcgaacatcgagggtttcgcggtgagccgatcgtggtcggccttggagaggtgaaatgaggtggcgagaatgcccatcaccagcaccgatgctgacggggtcgtcccctactactccgatgatggcagtagcaatggcgcatcggcggtctagtattcagccttagagaggtgaaacaaggtggcaagagtgcctgtcactggcgatgctgtcacggtcgtcccctactgcttctccgacgacgacaacagcagtggcacgtcagcgatctggtacttagccttggagaggtgaaacgcagcagcaagagcgcccaccactggcaccgatgccgccgtggtcgtcccttgttgctcctccgacaacggtagcaacagtggcacgtcagcgatttggagaagggaagggagcgagaagtgaggggagaaggggagagagagtgaggagaaagaaaagtgccagtgattgacatctggggcccatatgggtcgtacgctgactcaacttgccacgtcaaactgaaaccggttataatattgtctagggtctcaggcgatccggttttataaattgaggaacccattatatctgccatttcggttagggccaattttagactcggcgacaaattaagagacctaggttgaacttattcctccaaaatatgcccgtctagcgttagagcccatcgctcaaacgacttcgtagcccaaaactactagttgggccacgacaatggttcagccctgcggtggcccgtccttgctcgacccaacatttcgacggcgtgcggagcgcgcctctccaagtcgaagggccaagaatctcccagcaatgcacgccgccgccgcgggaagcagcctgcgggcgggcggcgctgcaccgtgtgcgcgtccgccgcgcggtggaacgagccgtggaatcccgtgctgcccgtccgtgggccggcacacatctgcgtgtcgcgtgacacaaccgatccaccaccaggaggaggccagcccgccggcagaaacacgcaacagagttcgcgcatagattttcatcaaaagttgacaaagatctgcataacgataaatctttgaattatgacataaaagatgactatttttttttcttattacatctttttatattgaatcaaaatcgaagctaatatacgtgtgtcccaaaaagtgcaggatctctactggactacttctatgctgttcaccgcggctccaaagagtccagtactctacggggagcagatacagcatatcatggaggaatgtactacgctttcattcgagtacatctcagtcaccggaatactcatccttgagcacgagaatacaatcttcactttaaacaactatcgatcggttggggggatcctctagagtcgacc

SEQ ID NO: 64406 - DNA, 2793 bp, Oryza sativa
atatatacacggaggcgtgcgtgggtgggtttagttcctagcggtctagccaccccacccctcctcctccgcgatcggttttgaaaattgcggggatttcaaccgattttggtggaaatttccccgtgtttcgattcgattctactacgggttcggctccaccgccatactgtgtgttgtgttgtggtgtggtttcgctcgcagcgtgtgggtgggtggggttgggttgtttcggctttttggggcggcgcgcgtcgacgtgttgcgctcgtgtttgctttgggtatggtgtggtttgtggcggattggtacgctgcgggtgattatgctgattaggagggtgattggcctaggttgtgtttgttttgttctttacttccagcaaaaagatgacatgctgactatgatagtaggatctcacaaggcatctatttggttagttgtgtaggtttttgtgaaaagggagacggcgacaattaatcttttgtcaatgaaaggaataattgggcttctttgctaaggaagtaatcctttgttagggaaggattgaacttcattattaaggaaaaaaatcctttgttacaagttcagatacatgcagttgccataaaaaacgattcatcgggaataggacacatacgattatttgaaattacgcgataaatttaatgttcacgaatatttatatttatctttacctacttaaaatattgataatagtacttctttcctttggttgtgttagttgtcatttgttctccaatgatctggtttagtttcctatttagatatattcattgtttgactctacgaaaagtttttcctctttccttgagctgatttaggagggtgcctttggttggttttttgaccctgcttttggctttaaaagggctcaaaagccatagctgcatctacccaaaagctgcttttgctctagtacaaattgaaagcacctccaccccttactttcagctgcttttgggtcaaatatttatccgcctgccactggttacgtggagaaaataacgtttagcctcgttctattccgcatcgcgtccgctctgtcgcccccttcggcatcgcgtccgctgccactcgctacccgtcgtcgaggtcctccagacctgcccgagccagctaccggaccttcgttgccccaactccggcgagtccaggaccattgcggcgcgagattcttcacctcccctccccgtggcggcgtggctcccccatccccttggtcccatggccggtgacggggcgggagggcgtgggaccaggagcgcgatctccaccgcccatctctgcgcccctcctccattgctggctgcaagcgggagctcccgagcgcctgagcggaggaatagggtccccgacagaggaacagccgagaccaagcaggattcgtgtcccgcggtcaagggcgcgggtgggattcttcctcgacggccgcgggcgcggacgcagctcttgccccggtggctgatagccaaggccgcgtgtgggattcgtccccgggtggccatggcaacctcgcgtccatggtgcttgcctcctgttccctcgtcccgtgctgccttcatggccggccacgcgagcctaggatgtcctgcaactggctggcgagcccaagccggcgtgccccgatagtgagtccccatgcgaaccgtgtgaggaagaagatgaatgcagtgaggctgacaggcagggtccagccgtaagtgagagaagtattttccaaaagccacagttgatcaaccaaacgggcttttgtcttcctcgtagctgcttttccaaagctacttttgcaaaagccaaagcccacgtctgcttttccataagctactgcccaaccaaacacacccttactccttccgcgcacggaatatggaggagtaggcgtgcgcggaaggagcaagggtgtgtttgctacaattcttgggttttttggtctttttttaatctttcatcccccacgtgatcaacacaaacgaaacacgcgattatagtgagattaattaagtattagcctaaaaaacttgaaaattgaattagtatgattttttaaagcaactttcatatagaaaacttttgtaaaaaaatacaccgtttaagagtttgaaaagcgtacgtgcggaaaacgagggaagtgagttgggaaagaggggaaaagaacacaaccctagtgtgcctcctattctccatcctccttcctctatacccctccttgtccgcccccttatccccacatgtacaaataattgaagtatgcacgattatttaaaaaatatacggtcagttttgacgttcacaacatgctgtctttatcgttatatagtttaaaatttaataacatttatgtcttttttgatttgtatatgttatctttcgttatccattagttaaagttttgtttcctattcgactttattcatcgttgttgtttcatatttccttaaaacgatttcatcctcttgcatgcctgatttttagtacccaattattttacttcttagttatcgcctttttctcgttcattatactcgagcatagtcaacagcaatcttacatgccccatcttctccacctcccctccccgaactcctccttgtccgctcccttttcttcctctcctagatgaggagcatcaatgttatatatgttgtacttgttagcacaccttttaccgtcatgatatgggctattttagtcggacaaatcgttgaaatttaaaacccatattgacagtatacttaaaaaagtataaatgattaaaatataattttaaac

SEQ ID NO: 64407 - DNA, 16654 bp, Oryza sativa
agttttagggtttcggcctagttcccaagtcgcgcctgtgatgtttggtccaagtcctggcttccgtttcccttttgtaatgcagttgtgagctcgggatctgtccgtagcccaacatgactgtacttctactctataataaagagacctctgttgctatgatattctgtctccctgtgataccagcactgtttcctgggactggtatcgattaacaggctaaattggagcgtcacgggccagttccggtcgggactagttcggggcgtgacaagagatggtatcagagcacaggcttggccctagggcgaaacccgacgcttaggacaaccctaaggatactaagttcaaaactacttgcgaaaagctaaggtttcttttattttctttattttctacagtttgtttccaaaatggttactgatcttttcttcctctttcaaaattgtagatggcagtgaatgccagcttcagttcccacggttttggtgagggtcaccacgtcgctcagcttcgtgacctcgcccatttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggatctctcctggactgcgcttcgtcgcctggcccatgactacagccaccgtctcggaggctccgccttccggcagcttccacgccttccttctggccactcagacgctaggtacccttgtccgtacagcgagcctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctacccgcactcccagtggcccgcgctcccccagctcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccaccgtgttccgtttccactacccagctcccctaccgccagcggcccgtgctgctgccggccctcgacaggttccgccggtcccttcgcgccagccgatcgacgtttcttcgactcaggagccgactacaagaggcagccaggccgacgaggagtagaggaggcagtcttcagcagccgtccgtgtgataggcccttttgttccgccgccaactcttttggagtcatggcgaggtagtgcgtgcatgtgttagttgtgggtgttgtttggtagtctggttctcctaggtggtgtgcgcacagtcaagctcggcgtagctctgtgacttgtccacacccattgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccactttggttttgaagatggtagagttgagccagaagaaaatcatgagtcggctaatgagcagtctcaccgcagcaaccgttcgcatcgtacagcttcccgtaatgcagaaatggaacagtcccaccgctctcaccacactgtcagtcacaattctggagaagaacgcctcccttccccacctcatgtggaaaacaacatgcaacacttaatggcagttcagacacaaatcttgcaaggtttagccgcagccgtagccggttttcagcataatgcgcatggaaatggccaccctcacatgagcaacaatagatccaagctgacaaactttctgaggtctcgtccgccagagttctctcagaccgtcgagcccgtcgaggctgacgattggctgaaagatgtggatagaaaactcaacttagtgcagtgtactccggttgagaagacgctctacgcctctcaccagctaagaggacctgccgcagattggtgggagaattactgcaatgcacaccctgaacccactaacattgcttgggatgagtttgctacggccttccgtgcagctcatgtgccggaaagcactattgacatgaagaaagaagaattcaacagacttaagcaaggcaacagcagtgtcaatgagtacctaagtatgttcaacaagttggctcggtacgcccctgaggaagtggacacagacaagaagaagatcaggaagttcttgaagggaatcgcagttggaatgagactccagttgcttgctcatgacttccccacttttcaacatatgatcaacaaagcacttctacttgaggatgccagaaaagaggctaccgaagaatacaagaaacgcaagtctaaccatcagggaaattctttccgaggcgcacctcgccctcgctacggtcaacccatgcaatatcaccagtcggtaactcaggctaaccgccagccaggctacgcccctcgtcctcagatgaaccatccggcacctcagccacagcagcgtgcccctagtggcaatactgcgccaaacagtgttacctctttcaagtcaccacagggaccgtcagcagttcagtgtttccggtgcaaccagatgggacactatgccagacagtgtcctcagaatcctaccaacaacaactcagggcatgctaatggcagcactgccagaactcctactccagcggcagctcagtctcgtcctagctctcaggcaagtggacaaggttctcgtgcgtccaacaactttggtcgaggacgtgtgaatcacattcaagctgaaaccgctcaggatgctctagacgttgtaatgggtatgttctctgtcaactccgtacccgcaatagttctatttgattcaggagcttcccattctttcatatcacaagcttttgtgaaaagaaatggttggaaaacccaaaatttgcgtgtaccaatgatagtacattcccctggaaggaatataagggcaactcaaatatgtccggaagttaaccttagaattgaggaagttgacttcctagccaaacagatagtcctagactcgcaaaacttggacatcattctagggatggattggttggctaagcacaaaggatagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtatttccggaagaattaacgagaatgccaccagaccgagagatcgagttcgccatagaactggcaccaggcacagctccaattgcaaaaagaccctaccgaatggcagctaatgagttagcagaagttaaaagcaaattgaagaactggaaagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgacttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatcttcatggaatacctggaccagtttgtcgtggtgttcatcgatgacatcctgatatactccaagaacaaggaagaacatgctgaacacctgaggctgataatggaaaagctcagagatcatcaactattcgctaaattctcgaaatgcgaattctggttggaccgagtagcatttcttggacacgtgatttcctccaacggtgtcgaagtagatcccagcaaggttgaagctgtacttgcttggaacccgcccaagaacgtgtcagagatccgcagtttccttggcttagcgggatattatcgaagattcattgaaggattctctaagctagccagacctatgaccgagctgttaaagaaggagaagaaatttcaatggtctgcagcctgtgaagacagctttcaagaaatgaagaaaaggttgaccactgcaccagttctcaccttgccagatatccgaaaagatttcgagatcttctgtaacgcatcaagacaaggcttaggatgtgtcctaatgcaagaacgaaaggttgtggcctatgcatccaggcagctcaggcctcatgaagtcaattatcccacccatgatctcgagttggcagccgtggttcatgcacttaagatctggaggcactatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaaatacggcctgaccaagatcatctgtacagagaattggataagttaaggctgaccgtggtacagtcaggagtccctgccagcttgacagtacagcctaccctagaatcgcaaatccgggaggctcagaaagatgacgaagggataaaagagttaataaaaagaatacaggagaagaaagacgctaatttctccatagacgatcaaggcacagtttggtgcggtccacgcatctgtgtaccggccaagaaggagttaagagatctcatcctaaaagaagctcatgagtccgcctactccattcatccaggaagtacgaagatgtaccaagatatcaaggcatacttctggtgggctggaatgaagcgagatgtcgcagaatacatagccttgtgtgacatttgccaaagagtcaaggcagagcatcagaggccagctggtctgctgcaacccctaccgatccccgggtggaaatgggaagagatcggaatggatttcatcaccggtttgccaagaacccctagcgggtacgactccatctgggtaatcgtggatcgactcacgaaatcagctcatttcgtgccagtgaaaaccacctatgatggaaggaaactagcagagctctacataacccatgtcgtatgtaggtttggttgtcccaagaaaatagtgtcggatcgaggcactcagttcacctcaaggttctggaagcagttgcatgaagctctcggaactgatctaaattttagtacagcctaccatccgcagaccgatggtcagacagaaagggtaaaccaaatcctagaagacatgctgcgagcgtgtgccttggatttcgaaggcacttgggatcgttgtttgccgtatgctgagttctcatacaacaacagttatcaggccagcattcagatgtcgccgaatgaggcaatgtttggaagaaagtgccgcactcccttgtgctggaatgaggtgggcgaagcgctggtattcggtcctgacatactcaagtcagcagaagaacaagttaagctaatccgagaacgattaaagacagcgcagaaccgttagaagaattacgctgacaatcggaggcgtgaccttgagttcgaaaaaggagatcatgtatacctgcgggtatcacccctccgtggtatgaagaggtttgggatgtccggcaagttagcaccccgctacatcggcccctacctcataaccgccagacgtggcgaagtggcatatcagcttgagctacctgaaggtctcgcagacgtgcataacgtgtttcacgtatcccagttaaagaaatgtcttcgagttccagaagagcaagtccccctgggtaatatcgaactggaaaagaatctgacctacaaggaaagaccgatcaaggttctggaagaggcagaacgtcagactcgaaggaagaccatcaagttctacaaagtccagtggagcaatcattctgaagatgaggcaacctgggagcgagaagatcttctccgcgccgagttcccggagctgctcccttaggtgctgaatctcggggtcgagattcttgttaggggggttggtctgtagcgcccgttccgtcgtggcgcctagcgggaaaattatctcttaaaaaccctatttgcgaaatttgtttccttgcttgttgtctagtgtccgtgccatctcaagatctcaatccccgatctatcgtcgagttcaattctgaatccaaacccttccaaaatcattttcctccgcaaaagtctattttgcctcccccgaggtcgatgggccgaatctcgctcggcccatctccccctctcccccggccctctcctctctctcccgggcgctctctctctctctctctctctctctctctcgctccctcccctctccggcgcgctctcccccccccgctcagccccgctcagcctcgcccgcacgctgctcgcgcgtacgagagccgccccgagcgcctctctccccgctcccccctccgccccgcccgcgcgccgcgcgcgcgtgcgcgggagtcgcccgcgccgagcgcccctcccctcgcgcgagctcccctctcgcaaagacgcttcccgcgcgccgtgtttgcgtgcgcgcgcccgcgcggacgccgcccgttgtttcccgcgcgcgcgcgccgagtggccgaccgcccggtcgccgccgtcgtcagcgtctgccgcgcctgtcgccagtgtcgccgctccgctccaaaccgcccgccgtcatcgccgtcatcaccgcccggcccccgccactccgcgcgcaagccgccaagggaaggaggccgcgcccctcttctctctgccgcgtcgcccccgctccccttcccctttttcccgaatcggcaaaggggcaagccccctttctctccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctcttgtcacagcgcccctcctcttctcggtgatgtctctctccgttcttcctcctcgctccatctcctccccctagctttcggtagtagctagagtagcctccccgtagttagccggcgccgccccgaccattgccgtcgctcgccgtgtgttcgccgccgtcgccgctcgagctccgtagcacccgctcgttgctggcctcgctcggcgtagttccgcccaatccgacgctagcgtcgagttcccgaagccgcatagatgctctcaccgccgggaatcgacctctcgtgacctcgtcgccgtttccctcttctcccgccgccggttgccgccgccgcaatccgccgccatcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgcggccggatcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcacggtgagccgagccgctgacaagcgggtcccacccgggaccgcgcgtggtgagcccggtccaccggactctctctcctccctcccccgcgcgcgcgcttgggccgtcttgggccggccggcccgttaagctcggccgagctgctccatttaccttgggccgcgccctagccgcccgaggaaaagtctgatttccatccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgtccccttataaccacccagttgcgcctcgatacttgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccgaacataagacaagtacgaccacatgggtggaatgggacgcccttggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccatggacatgggcggatgtgaggtgattcctagcgtagttttgtctgtctactgcttgtgaaattgctgttttgaaaaggggttcgatgtttgaaaaatctgcagctgatgggatcagctaggcccgggtggccgtttgaaaagttgttggcccgggtggccgtttaaaaagctgttggccgggtgccaaccgtgttgcaatcctaaagattgatacattgcacatactccgaccggacgagacgcactgtctcatccgtgtcgtttgagaagcacttagttgttttcagaaaagagttcaaataaaatcaattgcaaaaacaacagcctttccttgaagcctgcattaaacccttatttcccctggcttgctgagtactcccgtactcacccttgctctatataaatatcccccccagttgctgaagaagatgaagcggatcctgctgatgaggagttcttctaggagcaagccggctacgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgctgtgatattctgtctccctgtgataccagcactgtttcctgggactggtatcgattaacaggctaaattggagcgtcacgggccagttccggtcgggactagttcggggcgtgacacaacccttcttaatcaattccaaaccgaattagattgctctccagccaggtgaagcattcccactaaagcaagtatcaacaagagttccatttggaaagtactttgctttcagcactctcgcacacaaactatccgggttcacaataaggcgccaggcttgtctagctagcagtgcttgattgaacaatttaaaatccttgaatcccaagcctccatactgtttggccttcgtcaaatacttccatgccctccaatgtgttttcctttttccctgttccgcaccccaccagaaattccgagccaacttgtttaaatcttcacaagtcgagtccggtaacttgaagatactcataacatacaccgggatagcttgtatgactgcttttagcatgatttctttgcctccactagagagatagttttctccccacataattattctcttccaaatcttctcctgaagactttggaacttgcctttgttcattctcccctccggggttggaaaacccaaatatttatcttcaaaaccattgccgacgatttggagtgtacttctgatttcagcatggacactagcgggagtaatatcatcaatcagcatggagcactttgctagattaataaactggccagttcctacagcatagtcgtcaaggacttctcggatcacatttgcctggccattatcagccttgaaaaagagtagagtatcatccgcaaacagaaggtgggagattccaggcgcccgccgacaaacttgcactggggtgattgccccttgaagtaccttttcatccagcaggagtgatagcccatcagcaacaaaaagaaacaagaacggagaaagcggatcaccctggcgaaggccgcgagaaggagcaaatgtactcagtaaggttccattgagtttgactgaatatctcaccgaggtcaagcacgtcattatccaactgacccaccgatgagcgaaacctaacttatacattgattgctccaaaaacgactagtcaacccgatcatacgctttagagagatcaagcttgtaggcacaagcagcttttccagggctcttgttcctttggatggaatgaaagcattcaaaagctaacagggcattgtctgtaatcatccttcctggcacgaaagcactttgattctgagaaatcaaatcatccaggataggcctcagcctatttactaagcatttggagacaatcttgtaaatcacgttacataggtttataggcctgaactctttcaactccattggttgattaaccttcggaataagcacaattgcagtctcattgataccatctggcatgatcccagtgtggaagaattccttgacaaccctaaccacatcactcttgatcaggccccaatttcgttggtagaagcgagccggaaaaccatctggcccatgcgccttaagtggaccaatctgaaacaaagcatctgcgatttcttcatcagagaaattcctgcatagggaatcattcatttcggcagttactttctgctggaacagccttgtgactctagaatgatcaacagtagggtctgctgtgaacatatcattgaaataatccgtggcaagattctcaaggtcttttgtcgcactgtaaacagtgccatccgggcctcttaacttggagattttatttttcttcgctctccatcttgctctgttatgaaaaaagcgagtattccgatcaccctctttcagccagctaattcgcgagcgttgtaaccaaagcatctcctctctatacagcaattcattcatatggtctgacgcaatgcgaatttctctgcggtctgcatccctttctactaattcagcaagcttctttctggccttctctagacatctaccaacatttatgaattttgttctactccaagtttgcaaggccgacattaccttcctcaaagcacaattgatatcacccaaatgttgtttctccccaacttctagccatgaatcaccaatcacttctgttgatgcaggttcacgttcccaacatatttcataatgcagacacttcttgcgattcgcatgagaagtatccctggtaaacctgacaagaatgggacaatgatccgagcatggagaggtcatatggacaacctgtgaattgctaaaaatatctcgccaactgttatctgctagtacccgatccaaacgcactttcacattgtttctaccctcccttctgttgtcataggtataaggaacccctgaaaagcctagatcgaataattcacaagtgcttaggatatccctaaaagcgtgcatttgggattcacttctgcgtttctcagaaaagtgctcaaactgccataatgtttcattgaagtcacctataaccaaccagggaagagaggaagtttgctttaaatctttgatcgcagaccacatatactgcctattttcaactctcggttcaccataaacaaaggtagcatgccacaaaggatcatccggagacaaacgcacgtatgcatcaatatatctgtcatttagagatttaatatccatataaacagactcgtgccaaaacaaagcaagaccaccactcatacccacactattaacccccacaaaaccttttaggcctagtctatttcggagccaacttaatctttccactttctgtctagtctcactaaggaaaacgatatgggaacctgcctccttcaccaaggcacagagatcacgaactgtcgtagcgttcccgataccacgacagttccaagctagacaactcattgctcctgacgggatcctaaagcagatcccgtcagtttaccagcggctccctggctggttgcctccaaattgtccacctcctgctctccatccgccctcctagacctctttagtgccctggttagcttccttgagtccatctgccctgtagtatcatcagccactgcttgttggtactctaacaaagcttgcttgactattcccggcttcacgccaccagtttgttcctgtactcttttccgattcccagcactaaactcatccgatgagacttccccaaaagaagcttgctggtgcagattagcaatagccaggatcatctcagagtttggagttgcttcctttgccgacccctgcacaatacggttttcttctccttccatttgcatgtgttgtgcctgctgagctaattgttcatctatcttgccgtctccctccatctcctcagcctcaaagttgtcacgagcatccaccctaggcggaactgcttcattccactgctcaccttgtttctgccgagaagttgatgaacttgcactgccagcacctctgaagacaaggttccgagcaacacctgaggaggagaacgctttcactttgctaactttccgctcgaaaggtttcatcggagagcaacgcaattctgctgaaaacctgaaaggctggtcttcattagcaactcttctcccatagtccttatcagaatgccccaaataaccacatatgaaacagaagtgtgggactagttcataacggagatcaaacttcctaatctcctctttgccttgcaccaggatcatgattgcaatcttctcttttagcggacgtttaacagggagatccacccggatatgaaagaaatcgtgcatgtttctgccatcatcaccaacatccacttcacaaactttacctagtctactaccatacaattctcctctctgtttcgtcattagagccaatggaaggtcataaatcctgacccagataggaactgattctaggggcactttcgatgggcaagtaataccatcaaattcagccataggagagcatcaccatgatggatccatggtcctccctgaagaacaaacttataatcaccctcagagctgaaagttatgatgaacatattctctcgcagggatttgtagctcatatctgcacgcagctgccaagcacgacacatatcatcgaagaggctgatgggtgggcaatcttatcgaataaaatcttgcttggatagtccattggcctggaatttgcaccttcttcttcttaagggttacttcaataattttcttttttttcttaataattttccctttttgaaaggccgcagggccttgggaagagctagtgcccatatcctcagtcatcaccactttatcatccttcttctggctcccggacatcgccttcagattggcatccggcactgtgtccatcacccccttctcctgaatcgctagcttgatcatcccgccatccgtcagcttcgggtgggcaatcatctcaccgatgatccctttatcacccccactggcgttggcagccatgaaacaccttgcgatcaagtgtcgacggaactctagattggaacctgaggaatatgaggaccaaggaacggaactatgttggataatcctccagagaccccccccccctcctctttatagtagatatcgaccaagatcggatctgacttcatctttgttctcatagtctggataggattatacttcgtccccaatccatccgaatacggattgcatccagattatctcgtatacctaaagcagacatctcctttaccaattgtgtgttaccttgactccaccaggaaaccttcatctgccgatggtaatctaccatcattgcctgaacgatatcgatccttccaagaccaacacagaacgcaggaggaaatcctgccctcagcaacaacagatcggagacgaactccatccagacccatctcactagatgggagacagccgccgccccccagttgcccgggagtcacccctgcccaaaccctaaaaacatcttactgttgatagtaagcctaaacttaacactataaaaatatgttgattcagataaataccactacaactcatttattcgtagtcatgccataaaaaatttatggaactaaaattatgccaccgccgtcacgtttttcatcaacctccttcctttttccatcttttttcttatctgcacgtgatgcccacccgtcagattcatcttctttcttcatttcccacctgatcttagatcctgacactgctacagcagcaggcaaaaacaaaaggaaggaaaaaaacgaaactcttgctaccaataatatacggcaaaacggtttcgtttttttatcccatggaatggaatggcatgggtaatttgctcgtataattaattcaaagttgtcttgcgacagtaaccttctttcccatgctttgtttccttccattttgttaaaaaaaacaatttttgaaatttttttttgcctggccggttgaaggaattagccggtcaaagcttacggttacaacaacgctgcctattaacattaattgttcttataaatctgcaaatttgacaaatgctgtgtttagttcccttcaaacttacgaaaattccgtcacatcaaatgtttggacacatgcatggagcattaaatatggacgaaaaaaaccaattacatagtttgcatgtaaattgcgagacgaatcttttgagcctaattacgctatgatttgacaatgtgatgctaccagaaacatttgctaatgacagattaattaggcttaataaattcgtctcacagtttacaggcaaaatctgtaatttgttttgttattagtctacgtttaatattttaaatgtgcgtccgtatacgtaaaaaaaaatttggagtaacaacactgccaaagtactcttaagaaagttcctgttaaacatttttttgctgtatacatattgaattcttcggcagcctttattagaggctacgcacgtactcatgaaagaagtacaaattaaagaaactactactacagtttagtttttagttcgatatatgcgccatcagtgggcaaaagttaaggattgtctttgttattcaagcagtcaagctccatcttctagttttgcttaaggagatcttgtgcccggcagcattgacttgctcattactactgaactagctatgctcgtgcttcacaactggtgttgacgaaaaacagttgaaacaataatgtgtagttgccatggtcacatgccaaaaagtagtaggattttttttccatgaataaaagtatccaactgcatgcattcctcaagtacagtttactgttagctaatgcgtgtgtgactctgtcatctaaacgcttgaattcgttggtcgattattatcttagcagggggccgggcccgagcctgtaagaactcgatcaatcgaatcatatcctcacagataatctgaaggcatcagaaagcaaatcaagggattatcaagtagggctccagaagaaattgagtttaatccagcattaaaaaagagatgggtttcttggcattgctt

SEQ ID NO: 64408 - DNA, 12513 bp, Oryza sativa
cagttagatagcatagagacatggactagttgtaaaaaaggaggaaaaaaacattttgagccaagtccatgcatctctcttggtcttggagcacatgaacagctgattatttttttatctgtgtgttagcatagattgtgttcgaatgaaaaaaacaaaaaagacaggtaaagcgagatgagccactaattattttaaacctagaaataaattaatatattttttctataacttttttttaaaaacataccgtttagagcacccgtaatggtaaagtaatgtgccatatataaaacatttacatctcagcaatagactacattaatagtaaaccactttaatggtatatctacatgggtatctatagctctctaatctattgcctcgtttttctctatagactatctccaggttagtagatagctttgctctctctcttcatttaatctcttccaaatagaaaaatatgctgacatagatcttttgtagagagtctatagataatcattgcgggtgcccttatcagtttggaaattgtgtgcgtgtaaaacgagagaaaattcatctctttcttgctcagtacaacgcagcctcaagtaggaaggaaaaaaaccatcacgatttacgaaatacagtattgaagacctgctgtgaattgtgaatttgtgattgggctcgaacgcgggccggagaggggagagctcctcgccgctgacatgtgggccatagtaaaaagtgggacccacatgtcaggtctgcttccgcccgctgagcttcacgccgtcctcgctcgccgcgctaaaaatttcgctccgcccgccccccaactctcctctcccgccgccgccgccgctgccgcgcaactcgccggagagagaagggagcggcccatttctcaggcgaacatgtacgacgatggtcctcgcaagggaaaacccggcggcctctccatggacgccgccaccgccgcggggctcgcggcggtctggccggagtacttcccggaggagagcgagttcgccgcggacggccgcagcgcgcgcctcgccgccgacctggtcgacctcttctcctcccccgacgcgagcgacctcctctcgcgagtaagcggtggctcccctcccccatttcattcctctgcggcgttgcccttcgagctctcctcacggcggaccggcggtgcccatgctagggttccgcgcttgtggtatggtccgattgttgagatcggttcatgcgtgatcggtgttacaacttagaatatatcagtggtggcatttctcgataatgtctacgattttagcggatggacgctccaatcgttaattgaaatgttctggaaatcgcaactaaagtgagtactgtgagcaattcataaatgtttttctaaggaatcttcgcaagtgtttactttgtcttaaacaagagcaagtgtttaagcttgtaaaggttcctgttatagtgttattacctatttaatttagctcgttcagggagcttgcaactcgatgttaatgggcgtttagtttctactctcttaatgccttaattgcgaatgcatgaatttcatatgaattaggaaacaattcaatcattgcaagaatcttaaaatgcgaatttgtaatttactctctttggttaatgtggttactagtagttaccacttacaacttcatggcttcatgcacaggtcgaagatgatggtgatatcctctcccttccagttgatttccagcagctatcgaatttgacctggattactgaagctctccaggaaaatccaaaagaagccttgctttccatgggagctgcagttcatctggttgatgtttctattcatgttttcctagaattaatgagcctgttacttttgtagtgctttcatgtttggtccactatacctgatatgtcagttcttgatattttcttcagattgtgtgtgctagcagggacttgcagttgggcgacatcaacaaaatcaatatcaggctttacaaccacaccaagactattgccttgaagaatttaaaagcggcgtatattagtaaatgtcattctgccttttatcatcgcgtgctaaagtttgtgcacatataaatcaaagtactaatttgtagattcacttggcagagaaacttgtgacagtgcgtggaacagtcttaaaagtaagtacggtgaagcctctagtgctgcagctgaatttccaatgcatgaaatgcgctacaaaattccctcgtgtgttctgtgatgggaagttttcacctccagtatcgtgcagtattcagggatgcaagagcagaacattcataccaatgagatctactgcaaagttgatggattttcagaaaataaggcaagtgataaataaactactacattatcctttatttatggtactaaagcttttctcatattgtttccaaatcaggatacaagagcttgctagtggtgaaagccatgaagaaggcagagtgccacgaactatagagtgtgagcttacagaggatcttgtagattgttgcatccctggagagactgtaacagttactggaatcgtcaaagtactgaacaactacatggatgttggaggaggtacaatttttgagaaattaatatttctttgcattacttctttttctaaaccttgtggatttactggctcacacacaggcttcaaattttgcgttttcattggcaatcattggcaaaaaatgtttatctataaatgcctcagatttgttcacaacacctatagaggcacatatgctgtcagcatcttgttttatttgatcattaatctgattggatgttaatgttctgattagagagccttggccatctaccatgtgacattacgattttttttttctagatggagcagttgaaaagaaaatagcatttgagcaaagcaagaaaatagctttctatttttttgtttcttccagaccatatatcctaaatctgatatatagaaatcagaatcaccagatcaactcatggactactgagcataaacagttcattagaagcattattatagtccatgttaactatagggaaacctatctaatgctgtatttggcagcatgagggtatctattttacctctcccccactttacattcttagaacttgcaagatcatttggtctttgttagatatatgcatgctttctatgagctccttgaatttaagaatcaagaaattatttataggataatggagaacaaattagttatgatgtacagccttactattgtttgacccttacccgctgatgccatatatgcagataaactcttatttgatctgagcttccccccttctaatttcttaattttacacaatatttcatttgtatcttcagggaaatccaaaagcaggaaccaaggtttatactacctgtacctggaagcaatttcagtaagaaactcaaaggtccatgctgcttcaggaaattcagatgctgctagtggatctttcggttttcaagcttttactgaaaaggatcttgaattcatctccaaatttaaggaagaacacggtgctgatgtttttcgtcaaattcttcactccttttgcccctctatctatggacatgaacttgtaaaaggtattggtattatacttatcttccatctactatttaatgtggttaaagatttaaatttaattcactctgagctgacccaataacggaatgaaatattttggtgaaacctaccgctccccttaatttctgtttacacgaaatgagataacaattcctttttttctttttattcaattagttctggaccgctgcagcattttctgcccaaatgatcttctataggaactctcttgtgctgcatgaaaaaaatgagaatgtatctcccaagctcctaaactgtgatttttgcaaaaactttctatatataaattgcttagaatacttttcaaaaacaacttttgcactttgtaataattaattcattcgtttgtacccttgaatattatcataaaatcagataatctatcatctattcatctattcagaacaatcaaactgggggtggtgaaattgactaagctactggtagttcccgttctctgagatatgtgtgttctccttttcaactagagcatacagcacccattctactacactactgtttacaaacatgccagcccttcttggtccttttcctgctttgcattttattgctagatacaactaaatgaatatttccaatttttcagctggtatcacccttgcgcttttcggtggtgtgcagaagcactccattgatcaaaacaaggtcccagtgagaggagacattcatgctgttgttgttggtaatccttcacttatagagggtctaagcttcttggtaagaattttcttagcatttctcacagtgcaattaaaactcttgctcaatgcaattctaggtgatcctggactaggcaagagtcaactgctacaggctgcagcagctgtttctccacggggtatatatgtttgtgggaatacaacaacaaatgctggtctaactgttgctgtggttaaagattctatgtcaaatgattatgcatttgaggctggtaagcatatgagattgtcctttgtcccttccctagactgttgtttaagttctgttacctaactggctgtctgtcctggtgggtttttgtcttaaaacctgtgagtggaacaaaataagtactcccgttgttccaaaatataaggatttctagaactcaaaacattgtactccctccgtcccataatataagggatggtatgtccagattcatcgtattaggatgtgtcacatccacccaaaatcctttatattacgggacggagggagtaccagatataagcatttctgggcactgattccaacgcacagaaatccatatattttcagccaatcagttgtttcatgttcgagaggggaatctaagcaattcaaaatttgacaactgagatgactaaaagggaatcttttcccttaacttcattatttgctaaaaaaaacctagaaatgcttatattctggaacggagggagtaggatgcaagtgggtctggtagtattttttttcttgactaatttaatggcacatacataaagtggcctatcaaataattttgaccctttggtttacaggtgccatggtccttgctgaccgtggaatatgctgtatcgatgagttcgataaaatgtcagcagagcatcaggttttaaccttgtataagcttcactctgaaatgttaattagaaagccctaacctgccacatcatgtttctaatgaatttgagttcataggctttactggaagccatggagcagcaatgtgtatctgtggcaaaggctggccttgtggcaagtttatcagcccgtacttctgtgctagcggctgctaatcctgttggtggtcattacgagtgggtccttgtgtactgcctgtcattcttgatccatcatttccgttcatattttccttttcaattgatattgattatagtttgattgtggaccatccagtccattcacacatagccagagataattaagcaccaatgcattcagcaaggtgaccgggaggaatagagatgggtccataaagttagcaagaaatagcagcatacggattgagtccagttattttgatagtcagcacaagatcttgatagagtttgtttcgtatgacttcatattcatataaagggttacatcgtgcatccctgtgatgtaagctagtacatcgggtgttaaacacttcagaaaagagagtgaagggctgaaggcgacggtttggatggaggccgcttgcttgggttgataggaactaaactactttcaacgtgagccatgggtcatggcagatttcttgtactgctagtatgttcaattgctgtagtatagttgggaagtgttggctactggtgtttttgctgcaagtgaataagacaaacacatagtataaaaaaccggaccgggggtcgacccgctctggccgtcggttcaccggtcgaaccgccggtttatttatttattaatattatatttgatttgcattaatttaatatagaaccatcacaaattggtggaaatttgcataaataaaccagtatatctattattacatagtcacaacataaaaaaataaatgtggtgtggtaacataataaattcatcatgtcatattgccataggaaaaataaaaactggttcgatacttaaaaacccgccaccggttcaaggaaaaaccgcccggttcaccggttttttaccggttcgattgcatgggtggtcttttagcagaaccgaaccaccaaggtggccggtttcggttttttctggttcaaccgccggtccgatccagttttttgtactatggacaaacctgcaagtaataccattctccattcatctcaaattatttagagtacattttgcaaagctaacatttatgtgaaactatcatagccctacgtatttaagtttgagtttttcttttttggcataactacatatttaggagcaaaaatattcacaaacctatgaaacattgtatcataaccttgcttacaactcgggttcactcttcagtgacgaaagctaaatatgtcctgttacctagggtggatgggggcacatcatattagccacctggaatagcttgttggttggggtgcgtatcagcactaagggcattatttgaggaggtaaaggagtcgatgggagggaaatgatgcgtggatgctcatgatcttgaatctttaattgtcagcggcgcagagctgcagcagaagtcacagtttcttgcgaaagcagttttgtatgattgttctggattctagaatgctaaggctctaatttgatggagttgtagttctttgagaattttttgcttctaaatatgttggttggtgacgtgacattcaaacttgtttgttgtgatggtttttgtgcaaaatttgtaattatgcagaaaatataaattatttatggtgtcatgtcttcattttattgatgcacccatactatttgtttgttcgatatgatattttgtgtgttttcaattgagatgcttccctgctagatattaaatttgcgtgttactgccaacttaacagttaagtacctttttgtagccgagcaaaaacagtgaatgagaatttaaagatgagtgccgccctcctctctcggtttgacttggttttcattttacttgacaagccagatgaattgctggataagagagtatcagatcacataattgcagtaagtgaatgttaaccatgtttcctgttctcatctgttaagtatatatgactgatatgggatatgctcacatgatgcaatatatctgtatttagcaagaaaggatatgtatttagggaaacatgcatagttaaataactaaacaattttactatttccgataagcagctccactccaatgatggaggccctttcacagccaacaagaggataagaacaggtattttcttggtttattcaaaactgatttatagtgccttcttttcggttgccaatcattgttggttttcataactaaaaacttatccatcattgttgatttgggccttctttcagtgcctcaatttaatgccagtacagagtttggtgtcggtagaacttcattagcttcaaggctgagattgcaccctgagaaagacaaggatttctgtccattacctggaccattacttcgcaagtatatatcttatgcaagaagccatgttaacccccgaatctcgtaagttcctctttcactcataaaatgtcataaatgcaaactgttggctatccctatcctttttgcctgtagtgcttcccctaaccttactatttttcctctttaagcatgccgtcgccagcagctgacagtctgcaaaagttctatttggatttgagaaaacaaagtgattctgctgatggtacgcccatcacagcccggcaactggaaagccttgtaaggttggcagaagctcgtgcgcgggtggatctaagagaagaagtgactttagaagatgctaaggtgaaataacttaaatacttgagtgctgaaaaggttgctaagtctctaatctctgttgctgggtaaacctgacttcttatattattaaatcaaacttaaaaaacaacaagttgtgccatttcacccacacttgtgcaaattatgttcacattgcagatcttttttgtttgtttgtttgtttcctaattcttcctactatagttctaaatttgaaaatctcacatttgcaccacctgattagtaacttcttccagccaaaggcagatagaaatccagtgataacacaattgaacaactcagcagcattaaagctgaatgatatttttaaattgttcattttttttacatgacaggaggtcatagacataatgacggaatccttatatgacaagtgtgttgatgagcacggtgttgtggactttgctcgaagtggtgggatgagcaatcaaaagcaatcaaagaaatttctccgcgccttaaacgagcagtgtgatttgcagaaaaaggattgcttttcaatgaatgtaagtgtcatggcaattatgcttcaaatgtcttttttgctgaagatttcttgtttcagttgtcgaattatacaacatcacaccagtcaaatcaattaaaatggaaaaatggacacaattcttattctgctctaattgaagaatattttcctttgctactttttgagcatttttgttcttttggtgtgtggtttgtccagtgaaagaagatatgcagctttcttgatttgtttacagtatttagtcacaaacaaagcattgtaattagtaggtgcctttttttttttaatctttgatcgttccatcatgttctatccctttcctattgccaggagatgtacaacttagctgatcgtatcagcttgcaagttgcaaatttagatgctattgtggaaagtttgaacaatgctggctatatcactaaaaagggatcatcaatgtatcaggtatcgtcttgttttcaataagctctagcattactcttgctgtcagaacaatactagctggcctcctggcatcatgctgattatcgttttgacttgtagaatccgtggtaaccctcacggaaaacgtgacatatgctctttcctctttttttttttttttctgttaacaggtagtgacttcgtcataccaggggagccaagctacatggtcaagacgatgagttttgttgcatcctagatgatcagtaagtttgttggcgaggactgtgctggttctgttattagtcgatattatactacgggtgcaatcctatgcctccttgttaacgctgggattattcccagttactctgaatcaacatgattgactgatagcttccctttgcttgctgaaccagctgatccaggaggttagtgtctgattctattccgagagccatagaacggggtgatgctgcttcttaaggctgcaaggtgattaaagatgtctggctgcccactcactgtaatgtgcaaaacagcaattttgtatagaacttcatatttgctaatcatccatattgttataacctgtcgcccagatttgtcagttttaggtgatgctaatattttcgttctgatagtatatggtagtataattgggtaagcaatgtttgagctgcggtggcttacccgtcgcggcggaccggtctatgcctcgatcgccggtggcgggggattgggctgcgcgtggagggagcggtacgtggtaatggcccatatgtaagtggcacaactgtaaactgcacaaactcaggggatcaatttccgtaggtgggtggagcacccgcgcggcgcggcgatatgggcggcgcggtgcccgcaacggcggctgcgtgtgacctgtcgtagctgtgcgccgcagcaaaagccgatggcgatgatctctagcagccgcggcgacgacggctcggctcggatgacaccggcccacgggctgcgcttgaggggggaagagagaaaaaggtccattatccatcgcagcaggccataatatgaggcctcatctagttgggccgacgacggcaaggggatgcaaggcctacgacgcgcgcggcgccggcggtcagcacagccatgggccgccgtccaatcaagccctaaacctggaaattctgagagatatttaactatttaccactcttatgataattaagagtttatgactggatttacatgtcatacacgtgactcagtgagtggcaaataattaaacttgacatcttaaaagtggcaaatagttaaatgtcccaaattctaaagctcacaggtaggcaccagaaaggaaaaagaacggttggaaaaatagagtttcataaataaattgccaaccacaaagacaagtatattacggtcatgtttacgttataaactaatataatttgtaattattaatataaattaaaagtagtaagtaactaatttaaatatttcataatgatcttatagcatcaatggctgacaacacatataagggtcgttatggttaatttctttttattccaatgggttacgcttatttctttaaaaaatattaatgaaaaaagtactatttccgttccatttctgaaaacatgaaatcaaaacgttaagtacaaaacggaaacgatagccggtacagtcaagaagtcccgtaccgttttaaccctactcatcggacactgactgagattaagtccgacgaccaccacgtgcacagcgcctaataaaaccatttgatcgaggaaagcgtgtgatgacttggaacggactcaacggagagacgatggatgcaagtcaatttggggaaacggagttatataacgaatgccgtgcttaattagttcggcttaatttgcacgagaaagcggctaagctcaagtgtttcggttagctagctgtatcgcatgccctacgagaaatttaattgcttctcggacttttcaaggggagcaacaagacacggtcatttttttttagttcagttggcatatcacgtgcttcattgcccatttttggttgatggtttcccttctcgacgaagcagattataggtgtaatggttcataatctctggctgaaaaccgccaattatcggtcctatcggtccgatattagagagtggtcccaaattattattttttgtaggggatatcccaaattatttttgatcaaatttgatatagtgtgcgttcttttctacattttcatttatgaaccttgtagcattttcaacaaaattttgacgatttcatttatttgaaacagaaaatatttatgaattttcaactttcaaccgagattcaagtttgaaattctgagcaattcgtctgaattctgggggacgaaaatcaactaaattattggtgacttttggactatcggaagtggtcaaaacttgagccgaaaacgatactgtagtgtttacctgttcaatattttaccataactgagcttgcctagcttgtatggtaaaacctgcaaaggaaagttcatttttttttcagcgcagacaattgacagattaccctggccttgctgtgttgcacttataatgcagctacaggtaaggttcagaaaatccatgaaataaaacttgaccagaaatttcaattccacaacatcaaaaagcagagttctaacacagtttacacacaaatgcttaactgaattgacaagtagaaaaccaaacatagtacatgggaggtagtacacaaggaaggaatgaccaggcctaatacttgctgatccatccaacaacttatacaatccattatctaagaaaacaacttatacaatcaaacataaacaccaaaagacaccaagccaagaactagaagacaacattaacaaccttaacaagcaagtaagctacaggaggttcttacttaaaaaccttaacaacctcctgaacctgaaaggctaagacgacttaaccacacgaaatcaacgagaagtatggatggattagtgcttactctaatatggcagctaatccaaccaagacaggggcgagaggaagagatcaacaagagattttaactgattataagagctcttcgtaattattttaactttgctcctgaaaaattctgctgcgagcataaaaggagcccatagtagcagcagaaattggaggagcggatggcttcagcttctagttcagttgtcggtgtcgtcggagacaggaacgccgccgccgccgttcctgtcgttgcggccgcggccggcgatgacgccggagaacgcggcgacgatgtccttgatgatctgctccttgatctgccccctgcgcggaggcgggagcagcgccgcccgcgccgccctgccgccgccgccgccgccggcgcggtctcccgccgcgggaggcatggccggagccggagcctgagccgggtagctctcggtggccatcgtcgccggcgatctggtcggtggtcggagatcgggaggggggggggagg

SEQ ID NO: 64409 - DNA, 1848 bp, Oryza sativa
gtggggcccaaaagtgcccagtgggccccacttctgggccgatcgcgggctgcgactttagggagaacagccacgtgtggatgacaagtggggaggtttggatcgtccgggcccactgtcagtgacacagatgttcaaacttggtcggttcgtgggtcccacctcgccgcaatttttccacgtagtagtctgttccacgcaatcacggggctttggctttggcttgctctgccttggattgcagctagtggtttgtgatgggaacctctccatttagccgcgctaatcatgaccaaaaacgcaattagaaaagagagaagacagtgcacgcctagaagcattatagtgcctactccttctatcttaaaaaatactactaacaattactaatatattgttataaatctaaatagattttctattacttaaaactaatactagtactaagtcatacttcctcctccgtttcatattataagtctttctagtattgtctacattcatatatataataatctagacatatatgtttagatttattaacatctatataaatatggacaatgttagaaagttctttaacctgaaatggaggaagtatgttgatgtattttggaacgatgaaaatagtttattcggtcagtgagccggtggtggttcagtgatcagtatcaacaaggttgctgcgctttcgcttgctttatactaccacaaaatcaccaatgcttaggcgccgcgatgtggataagcataataagccataaggacacgccaggtcaacagcaagtggtgcactgggagagaagatgctttcacattagaaggtactactacttgtgcataatccgatttgtctgaactttcatgcagcttgttctgcttgtgtgtgtttccttgttagcgaagaaacttgagaagtttcaaaagaaaaagagaagaaacttgtgagaggtaatcctggccgttggagcatcatcatcatgcatgtttgcgatggaatgttcgcgttacctcatcaggagcacgtcagcgcgagcgttcgcaatcgcggtttttttatttttatttttttggtgcgaactcgcaatcacaggtgtgcgttggcagctcgggttaagtggggtttgttcgaacggagggaaggcgtgaaaattgcggtttgggctcggcttcccgaaatcagattcttgcagtctttgaaataagttcaccggaggtccctcaacttaacagcgagaattcttgagatcccttaaccacataaccagaaatgtgtacccctaaactcacacaaaccgttcaaaggaggtcccatgacagtatatgtgggtggttttgctgacgtggcatcctagtcagcattttttttaaaaaagtatgtgggcccacatgtcagttacacatattttcttttcttttcttttcttctcctcctcttctcttttctcccttctctttctcttcttcttcttcttcttcttcttcttcttcttcttcttcttcttcttcttcttcttcttcagtaagtgaggctggtgggcgacgggtggagcggcgatgggcgggcggagcggcgacgacaggtccgtgcggcagccgagtagcggcaggcgagcgcggcctgcaggcgagcggacgagcatggcggcaggcagagcggatggcgtcccatgccccatggcgtggcggcggagatatcggccgatccggagtccaggagcacggagagtgtgtaggactcgtcgacggcggggccgagcgagacgttgggaccgtcggagacggagagcgcgaggatgcagacgtggatgcggacggggatgcgggagagggtgcagttggtggggg

SEQ ID NO: 64410 - DNA, 3603 bp, Oryza sativa
tgggtagggattggtgtagcggaccctctggttagcaccctgttgattgcggaaattcgccaagcggcgcttgtgcgattccagctccttgtgcttagcttccaagcggatgctcttgtcgaccagtcgttgaaaatccggatagtccccagagactagacggacggacagctcggggtccattcctgccaagaacttctcttgcttctcctcatcttcccgcacatcctccggagcgtaccgggccagattgttgaactcgtgcaaatactccatcacggagcggttgccttgcttcaactctcggaattccctcttcttgagagccacgactccggcgggcacatgggttctccggaaagcggcggtgaagcgagcccaagtaatcggctgtccctcgggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatccacggggttgttggagctagaaaaggtaggtgggcggatgcggaggaattcggcgagtttggagtgttggggagggggtggtggagcattctgttgtggcggattttggaggtggtggaggaaagcagtcatcatgttggcttgctgggcgaggatctgggtgagaatggcgttggtgtctggtggtggtggtggaggtgggttgccttgggggttggggtagctgccctcgggttggttgccttcaccggtgttaacatttctcctggtcgtcaccatctgaaaaccccacacggaaccagcaaacagagagagctaacgattaaaactaaccacccacgactaccattattcttaaattattactgctattaaattggttcattaatgttcaagttgcttaggcaaacaaaataaggcaggctccgacatagttatgccacacaccggcataaccatgccccacacgactccaaaaagacaaacgagaaaaaaaaaaaaaaaaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaagtccacgccagggactgacgaataagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgacgcagctccaggatcttcatgttgttctccaccatgccgcgacgcaccatctgatggaagtcaatacgagctgcgtcgtatgcctccaccatgcgtgccagatgcacgacggtagcgtcatcctccgagctggcgtctcggaaggtggcgtggtcgctggctcctccgcgacgagggtggtagcggtagggcgaggctgcaactcgtccgggtagcgctggtgaagggtgccgatggcgaggagagcggcgttctggcaagcggcggggaaggaatctccgcccgcggtgactgccagcgaagtccgctcgggagagccggagaggatcactgcagtgacctcccaaccggcgtgaggctctgcatcctcaccctcctgctccggccctcccgaggacggcgtcgccggatccgccgccgcaggctatcgccgtgcccgccgtccgccgtcgagcgccgaactcctccctagggcgacgaatccagccctcccgaggacagcgctgccggatccgctgccctcgccgcccgccgacgccatcgccatgcacccattcccgctgtcagcgagaagagaggagagaacaaagagagagaagaggagaggagataaagagagagagagaaataaatggggtggttgttgatggtccttaaatcataatatttgaccgtcaatacctgcatataatgaaataaaacattgtatccaacttagtggtagggattattctaatcaattccactagtgttggtgaaatatgtgtatgcaggtattttaaggataaaacacacccatcatgcgaggaaacacacttccggtcaatcagacgcaagtacacggattgaagggcccacaagtcaggtgaaacccccttggaacgggtcataactgccataaccgtcactagggctcaccagtcagtgaccctgccaaaggagaagccaggagatggggcccagggttcggctgaaccaccacaagctcctctcatcctggccttccacgtgtacgctgctgatgcattcccaatgacggttaagggcgttttggtcgtttcccatacctgtaatcgtcatatggaggctataaatagagctcctctccctcccttcactcacacacaactttgagctgaattacaagaggctctattttatcttttgtacattagaattaggtagagagtgaggggaagctttggaggagtgcccgaaagtttgccgctcatccaacttctacctcgatgagtgtagcttcctaggaggaattctggagttgtaccggagctgtcggtacactctgctctgggtttggagaaacttcttctataaagtaagcattcgtgttcctttcttatgttatttaattactttgtctaagtaagatagattttcatctttacgggttcattgtttagtattcgtattaagtgctctagtactaggactccagatagagaaggaagtcatgtacaagtattagagtagtaattaataacttagacatggtgtctagattagagattacctttctttgttgtgtatcccacggatttgtcagaggtaggcggtaggtggtgacagccctgaatcccgtccgtgtaatcctccacgtacggatacatcacagagctatagctggaaccacgctggcagaccagcaggggtcggtgcccaaagcaacagatagaaaattaccttagcttagataattaatacacataggaagtcctctttatcctagtctacctatcattagttgtccttggatagtcttagccttaggtagattacacacgttccctgagttcgatatccttttaggatcacccgaaggtgaagtgctacaacggtattccgtgcgcttgcggatttatctgtggtcgtaagaaataccaacagtggttgaaaaattttgaaatgatgaggagggaaactgagagaggaggactaaaaaatacgggcatttttacatgcggaccacttaaccgtccgcatgcaaaaatatatttttgcatgcggctctttaagaggaccgcatgcgaaaataattattaaaaatattaatttgatactaaataaagttcgagtcgaattttaagttgctaaataaactcatgtgaaaaggttgtcaaaagcaaagttgtacaactcattgagacctaccatttttcttttggtcattttgccatccgagtttgatttaactatataaa

SEQ ID NO: 64411 - DNA, 4933 bp, Oryza sativa
aaaatattaatttgatactaaataaagttcgagtcgaattttaagttgctaaataaactcatgtgaaaaggttgtcaaaagcaaagttgtacaactcattgagacctaccatttttcttttggtcattttgccatccgagtttgatttaactatataaaatttgaattttcaaatataataaattcaaataattttccgggtagtaaatgatttgaaatgaaaaaaattgtcaacaaaaaagttgaatagctcatcaagatctacaacttttgttttggtcatttttctatatgactttgtttcgacagtttgaatttggatttcaaactatgacaactccaaacaacattttttaaatattaaatgatttcaaatagaaaattcatcaataactcatcgagatctataactttttttttcgtcatttcttcatccgacaaagtgatttgtaaaattgtttataaaatgtacatatctcttatatagttttataaactataagagagatgctaccatcactttgttggataaagaaatgatcaaaatagaagttatagattttcatgagttatacaactttgttattgataactttttcagctgaaatcatttagtatttgaaaatattgtttgaagttttgaaattcaattttttgattgataaaacaaagtcaccagaaaaaatggtcaaaataatagcaggaagaacacaatgatataatagagcatgattttagaaacatttaggaaaaagaatcatccaatttagagttcgtatgagtgagatatactagtttcaaattttttaaatttatttttgcatacggctccttaagactcccgtatggaaaaatcaatttttccatgcgggcgcttaagtgagccatatgcaaaaatgtttttgcatgcggacctcttaagaggcccgtatgggaaaatcgattttttcatatgggcatattaagaagccatatgcgaaaatgcctctcgatttttgtagacgccactagttatggtccgtttgcaaaaatgaatgggtatcatacagaaaaatcacttttgaagtaatgtgatgcaattattatcatcgtagatgacgtagttgatgccgtcgacggtgcattgccgttgtagaggacacgatcgatgtcgtcgaagaagcgtattgcaaatgtatctgttagaggatgcgaggtgttcatctatgtggataagtcggtggcggcaagttgatgaagaccactggtgttataggatcggtgaagacgatcgcgtagtcgtacaggctatagatgcagcggctggcccgatctggtgtcacagttgcagcgcacgtcgttggcgaccacgtgtgggagttcggtgaagacgttcgtcgcagctgtagattggctttggttgattatgcacgtatacattggacatgcacatgtcttgccgtagaggtggtgatgatcgctagatgacgtcgacgttgatcttgaagcagatcagtagatgtacatgcactttagtttttttttgaccggatacatgcacttaagttgattggatgaatagctccatgccaccggggccacgctgctgcttctagtgcttggccggttggtggcgtggtgtggtcggcttgttgcagattgatctccgcgacagtgttttggaaaacggccgtatatacttaaacggtagtaaaattgttccgttaacgtgggtatacatttattgttcgtcaacgtcaaatctccgtttttagtgattagttggtcgttttccgtttaatcacacgaataatcatccgtatgttctattagatgatgctttagagtagtttttaatttaatttagaattatttattacttaatttagaattgtttatgttttacttatataatgcaaccaattctaccaccaccatgtgatgtataaatacggttttagaagatttaatgtttcacttatctgtttaattagaaaaacaacatgaacatatttgacttacatagttgtacccatctaaatcttcaaataagtacataatattataaaatttgtacatatatttgcaaacgttaaactttcgcataatttattaattgtctgcatttcgattaatcggtgaacggtatcttcttcgtccgacaaccgtattccgtcttccacaacactgttccgtgatgagaagttgatcggcgagctcccgctgctctggctctgcgtgctcccgcgctgcagcagcttgcacccacgcgcgcggcgagcacgttgatggcctcgtctgtgcagattggtggacgccggtgtattgatctgctaggtgagattaattcctgcattgctttctttttctcctgtttgctcatactggcgtggcttccgctgcttctcttctctcgaggatcatagggcttttatgtagctaacgaaggaattgatctgatgctaattgttagctaatctacagatttttgttgtgggtgactaagcgccggtgccctaggaagattatggagatctcatctccccgagacaacgcgcgtgcggaaggtaggaatggatcaaatgacgttggtgataccatgtgaaaattctaattgttgtattatgatgtattacatcggaaactgcctatctatttggtgatttctaaaaaaaaacacttagattttttctacccttagatttatatccaacggactatacaaaagaaaataacaaaaacatatttacttacacaacatttttatcaaaattacagtgcacttacatgttatatcaactgaatttacaaagtataattttagttatataggactgtaattttatattttaaataaaataactaacacatgtttacttatcaaaattacagtgtacttacatgtcatatcaactgattttacaaacgtaattttagttatatagaactatagttttatattttatattttatattttattttagtttcaaatgtcttaatttttcaaccgttaaagaaatcaatttttatttagaaaagaaccgggcctaagcatccaatgcatggccttatccacgcatgcagcctccaccaccaattcttgcacaaatcttagcgcacatatcgtgcggccaaaaaaaaggtggaatagctagaaaaaaaatcacgcgacagatatctagcaaaaagttacatcgaccctcttatagggtatatacaggagtgcataggagatagagacttgtagtacaatataagtaagagtagatttacctctaggattctatctttagaactctattttatctctaggattgtatcttatctctatattcgtatttaattcttatctctaactaacatatgtgtacttttaacaagaataaggtaaaagcacttcataaaaaaagaagacaagtaaaagtctacctaaatttattcttaaaaaaacgaactttaaatttgaatactggtttggattttacgtagtccatagaaaattaagcaagctggaccggagagatagaaaataaaaagagcgaggcagttttaactcagacagtggtgaacaaagcagggagccacaacaatcagataattaggcccatgggtatcccctaccccaatcacataattacgcccaacgatcatatcaagtatccaagattagcccactagcccagtacgtgcagctgccggctgccggagcgtggcttccgattctttgcctgcaggcagcagcaagagtgagccctttttttttttttgtttaattggatctatatcaccctagacggtaaaactaactggagagcgctcttcaattagtcttaaccagagacacccacgtgctagtactttagaaattttggttgctataatatatccaatagtgcatatcttgtttttcttcttataaaattctctcttaaactagtaatccaatctacaatctgattacaccattacgttcgttgcaattaaatctttacaacaagatcttacatgattatattacgatgaaaaataggggtgcctacggctcgggcgcccgacgatttcgagaaaaatcgggcgctgacgtcagcgtccgatttacatgcaaaactactttaaactgatttttcttctaaattacttatccaaatcatgatccgattgcaccattaaattcattgcaattaaatcttcaaaacaagaccacacatgaatatattccgacgaaaaaaaatagcttattattaaaatatttttaaatattgtgcgatgttccactaggtatatcggaattgtttcactattcagttcactgcaacattatatctatacgtagtgaaacattatgagtacactaggtaaaatatttttcggtggaacaaaaaataaaccaaattcccttaatagggggtttccaaaatatgtgggtttttttgttgcaatggattatttcagttcactgcaacattagatctatacatagtgaaacattgtaagtacactaggtgaaacaacttttgtggaataaggggagggataagtgggtgggtctagatggggagaggggagcgcgcgcatgggggaggggggagcgaccgatttttcccacctccctccggtcgcccgattttaatcaattttcaaaaatatttatatttataaattacttttattatatacgtaagttacttttatcttatatataagttacttttagatttgactaaattacttctatacattcataatgctctaagttgattatttttattattgtttttagttaattctatattttgtggactttataaatcttattcagctcactccaatataattatttctactatagagagttacttctattgcataactaagttacttctgttgtatataattatttctactacagaaagttacttctattgcataactaagttacttctacaatttaaa

SEQ ID NO: 64412 - DNA, 17912 bp, Oryza sativa
  unsure (1)..(17912): unsure at all n locations
ctctgcccgcatcccgggttcggttcggccggcggcggccattggcaattccgccggcttccgtcttgccaacaggccgcgctggcttgctgccgccctcgcctgccacccgcccatcgcggctctgcccgccgcctgcgctcgcctgccgccgcccgccgccgctcgcctgccgcgcggacccaccgccgcgctcgcctgccgcccgtccatcgccgcttcgcccaccggccgccagcctcacccactgaagaagagaaagagaagagataaaatagaagaggaggagaagaaacgaaaagaaaaaaaagatgtgcaactgatatgtgggcctcacgtactttttttaatttttcttgctgactaggatgccacgttagcgaaaccaccctcatatactgccatggaaccttctttgaacggtttatgtaagtttaggggtacacatttctggttttgtggttaagtgaccttaaaaaatctcgctgttaagttgagggacctccggtgaacttattccacagtctttctcttgtttttgccggctgtttttccgaatattcagttcctcctttaaataagaccaaagtaccctatctcacccactcaagcatcattttttttaagcaccattctactttccatacttctaaaaataaaattacatagaactgtctcccatttgaaacgggataccttaataaccatatatatgaacatcttgtccacaccattacatcacctatttgatgttattcttatccttcctctccccccctctctctctcttgtcctcatggctcaacagccgagagcgccatgcaaccatcggttcgtgtgatcaatgatgattagctccgtgttgccatggaaggccgactccactcaaggtggagggattgcggggctgatttttgaggcttctctagttcgcagtagttttggttgccaactgtgattcacggcaagcttcttctattgagcatctttcccatccttgagaaggtaccatgaggtacaaggtaccaatctaatttaaccgttgatttaacaggggtatgattgggggctaaaaaaaattaggtctctcttccacgtcgtcgtcgcccatcgagggtcgtcgggcatcgaggccggcgccgtcgtcgtcgcccattgagcccgccgccgccgtcgggcatcgaccgccgccgtcgtcgcccatcgaggctgctgccgccgtcggccatcgacccccgccgccatcgcgcatccagccgccaccgtctcgcatcgagccctccgtcgtcgtcgcccatcgaggttgccgttgccgtcacgcgtcacgcatccagccgctgtcatcgcccatcgaggttgccgccaccgtcacgcgtcacgcatccaaccgccaccgtcatgcatctagccctccgcggccgccactgctgtcgccgtcgcgcatcgtggccgccgccgccgccgcgcatcgaggctgccaccaccgccgctgccgctgccgccgccgtcgcgcatcgaggccgccgccgtcggccatcgagcccgccgcgcatcgagcccaccgagccgccatcacgcctttcgccggtctcgccgcaaatctggccgccgctgccgctgccaccgccgtcggccatcgagcccaccgagccgccgtcacgcctttcgccggtctcgccgcaaatccacaatcttcccgatttttcccctcgtgaaacagtaaaggacagaaatacccttccaccaatggtactgcttgaaagagaaggtgcagtaccatgaggtacggatgatttctgactgttggataatgctagatcaacggtcaggatttggtactgcacaacctcaaggacagtaaaaaaactcctaatagtatcatgatgctcaagtgcatcatattggtgataccatgatacttaggtattaggcctaacgtctagcgatatcacactaatacctacttagtaccatggcctggtctggtaccccaaatactcggtacttggaccctgataccaaggcttggtaccttggtacgagacactcggtaggtactggatctggtatctctatgtatcaagttcgataccctaggtacttggtaccaaatcgtggagagggggcatgtgccgttgcttctcccttcctctcctcgatgcctccctctttctttgctattgctatggctgagtgagggagctaagagggagcgcctctacttcattgtgttttgtacgtgggagctcgagtcggagaggaaaggaaacagttcatcacttctttctatatagttggtacccactacaagtattaacactataaagaagcatccaggttaagccacatcatcgataaccaatagccatccgatcgaatacatctttgtttgtttagctggcatgcacagccatgcaggccttaagtaagcaaactgccatgggtaattaagcacatcaatagatgacacacttaagtgctcctggtcatgcatatgtcccttgatcatattaagccattactatgtcccttgactatctactactcaaatgccaactttacactttattattttagaatgtttacttttgatatttcaattatgtttgtaagcacatatttacaaagttgtttatcatcattataaaatctcgtagcaacgcgcggggtataaaactagttaaatatattcggacggtatcccgtgttgtaggttgtagctgtactctgttataaaaatcaaactgagattagaaaaaaatcataatgatttgtgttaacagtatccttgctgctcccttgacctcgaaaaaaaaaattctcacagtggaaaaatcgatcatcgtgaacccaccatctaataatcgttgcagcaaagaataacctaattaaaattccaataggacaacgctttatatcaatgtctagacaaactatctaggtctcactactagttctccctccattccaaattccaaattgatctatatatatttcataggtacactaagataaaaaaaagctaataactattttatactatatttactctagcaacaaactcaatacatgcgccatccccactatttcctagccaataacaaatcaagatattgcatgtgggttataaatacttgtgatgcatgcatcaatgtccatttacttcaacgcacaaataacgaatagacctaatgaataaacacaaatatatagatcatttaaaaataacatatatatatatatatatatatatatatatatatatatatatatatataaatttggaatgaagggagtatttattatcggtaattttctatccaattcatctcaaaataaataaatctaaataaatgtagtaatgctcacactgtattcacgtgcactgatgcacagtgcggttccacgtaatggacacgcactcgctgatcatgcgccaaaaaaaagcaaaggtggcttatacacgatgactcgctgtcgaatatatgtttccgcctttgcactgtacgttcaatcgatatagatgcttctgtggcacacaagtttcatataaccaaggttgcgcagttgcgctagcttttctctccgctggaaattaagacgcatttgcagaattgaatactgggaatttctttctttctttctttttttttaaagaaaatctcttttcacaaatcacaagatgagcagagaaaggttgaaaggagagtagctctcattgagcacaataatacagaccatgcagcatggaagtttatattgcatatacacagcttctcttcttagggtcattttagttcacgaaaagaaaatttttagatgtcacatcagatgtttggccggatggcggaaggagttttcggacacgaatgaaaaaaaacactaattttataactcgtctggaaaccatgagacgaatattttgagcttaattaatccatcatagcacatgtgtgggttactgtagcacttatggctaattatagactaattaggctcaaaagattcgtctcacgatttcctccctaattgtgcaattagtttttttaaatctatatttaatgctctgtacatgtgtccaaagattcgatgtgatgattttgggaaaaaaatttagagaactaaaccaggccttacttgtatttatacatctctaatacatttatatacacatatcgaacttggcagacggatccatttcccttgtcttcattcaagccaagaaatgaacagctgctctgtatagtagcagagagtagagacagacatgatggagaatcaaaatagcatatgcatctatttgcacagtaccagagcattagagaagaacacaaactaaggaagtatatgtagtgcaactgcaagaacacacatctagttattattgtagcttgcttctctcctgatgaagctgttgcgatgatctgcagcctgggccgagttggagtcgtcatcagcagcagcgttgttggccatgaggttgctgatgctcctcacgatcctgcgcttgacctgccccctcttcagcggtggcctcttctccttcgccatgttggcgccgccgccgctcaagtagttgccgtagtagctgtactccatcaccctgcaaggctgcgacttaacacacactgatctctctctagcttcttcttcttgcctctgtcactgtgtgtgagtgatttgttctgttggggatggggagatgtgaggtatttataggcaaatgaatagcagcctcatctctgcctgcagggtctcgtgccacctcgtgtgaacgcacgcgaacgtaagtgacaaattaaagggaacttatgcggttaacctcatgttaagggcgatgtggacgtcagacgtgagaatcagtgactggtatcgttgaagcagggcatggtttagacgcacgagggtcagaatgccagattaattggctagtcagcacaaggaacccatgaaagccactcttaccaattttaaggcagtttctaaaacaaaaattttcacactttcacattgaatatttaaatacatgtatgaagtattaaatgtgaataaaaaaaaccaattacacagattgtgtgtaaattgcgagatgaatcttttaagcctaattgcgccatgatttgacaatgtggtgttacagtaaacatctgctaatgacggattaattaggcttaataaattcatatcgcattttcctggcggaatctgtaatttattttgttattagactacgtttaatacttcaaatgtgtgttcgtatatccggtgtgacaatcaaacccaaaaattttcccaactaaacaaggcctaagtggaagagtctcacttcgctaactaaacaaggcctaagtggaagagtctcacttcgctgttctctactgatagtagaaaacaatgtcaaccattaatcttatttgatcgaagggtcatattcatttctattaccaccacacttaatagtagtagaaacgtcatgggctattattgtccaagaaaaaatattaacggtctgatgaatggatacaaaactttttttttcacgatggatagataaaatctgaaataccagcattacttctaatcactaagttagtaaagcactgatatgaccttataaattatagcaattttaggtccttaaggaagaaggtaccatgaggtaccactttttccactgtaaatttggtacctcttgttacttaggtactatgaggtaccagattttacactatttttttaattacctcatggtacctcctcaagaaccgtagaattgctctataaattaacaactcagatcaattctgctaatagtatgatattactagtagagagtgtcgtagcgttgctcttagtggaaggtttcgttcatgagcttaactacggtgctctctactaatagtaaaaagtgatatgaacggttgatctcatttgatcgaaaagtttagatctgtatgtactaccacccccagttaacgatagtagaaatgtggaggaacattattgtaaaaattttgtgtgaagggatataatcgtcatttagcagagactaaacctttttttctcttactcttttttggctttttcaatgaaatatgagtgatgccagtggaatggatgacaactataggattaaattactattttacccttaataatgaacggttcatattattatatattaccagtagagagcatcggagcatcgcacttcattttatgttttcaagagtgttacataaggcaacaagaaatttaattgtttgttaaaatagcccacacgatgtattgtttcattttttttgttgttgtttcagagacaacacatgcagagacagatcacattagaaatagtatatacaaaatgaaactcatttcatctccttctttattaattacttgtcacatcaccaaaaatattggcatgcaaccccatttaatgagaatggaacttctattgagagtggcccctatcgtttatcgactataagtcaaaatttagtttgaaagttgattttagggattttaatcttaatctattatttaacacctacttttaaactacataaatggaagtgtttttccataaattattatttcaaggacctataaatcttttattggtatggcttatcagctcagctatatagctcaactaatcagagatgctaactagtgttccaaaggaaacctaaattttgcccttgatggtttgtcattttcgttctgattatgatctatgggcatcatgcacctttcaaagtttcacgcaaatcaatggactttccagcttgagtagattttcagtttgggtcttgctcgattaatccttaaaaaaaattagatggaactaagaaggattaattttacctcttaatttcttttatttttttcttcaattctcttataaaatggattaacctaacaagaaaaaggagaactagttaccctcgttttcttactgaactgtcagatgaatgtgcagttgtgcttgtgcacagtcacctgatcagctatggctgtagataacttcaagcatttcgtgtagctttgcactggacctcagagaaaaagaagacgtgctagctatctttgcactcctatcacaactttacactaccactccatgttttttttttacactttaaatttgtatcaactcgatgcattgacaaaaaagaaaccttaccgctcaagttgtacactgtgtacacataagccgaatatttacgatatccaaatggatcaggatctgatgccaaagtggcgaaaaagggtaagatatatatacctgcgctttcacatttttctgacgcatctgaaagatatttaaaaagatctgtacacagtacgcggagaaagtgcaggtatatatctgacactttcgcattttcggcacagcacagcatgatgctataatcacgtatccgaggtagtatgtttacatagatatttccaattcgacagaaatttggatgcaaattaatcaagactctgcaaattagttgagcggagaaaatatagaaaaataaatgaaacaaccaaaatgatcattttagtgtataacttttatattgctactcttaattagctgctaaaaagccaaggttaaaaaataaaaacaatgaaaagaactagattaatttaaaattaattttaaaattcaaatattgaatgtacgtagctgattaacgaaaactgaagaagacgagatttttttgtaactaatttatttcaagagttcgtaactacctacaaactttgtcaagtagggtaaaaccattttagtcagttagctagaccttattggaaaaagtacacctaaggtccctcaacttgtcggcgagttacaaaatcgtccctaaaccgatatataacatatctcaacttacaaaaccgtttgctttaggtccttcggtgattttgatcccggttttgtctgatatggcggctgagtcagagtgggcctcacatgtcagtatgccacgtcatcacctcctctctctctctctctcacttttctcctctgttggctggccgacgtgtcggaggaggtcgttgggcgaagacgggcgacggctggggaagaccggaggcgcacggccggccgacggacgctcgtcgccgtcatcgccgtggccgctggacgccggcgccgacgtggaagcggtccccgagctcactggcttggaccccagcggtggtgaggtgagcgaggatgcgcggggtggtgggggcggcctcggatgcagaggcgacggaggcggcgggcggcggtcgacgtcgaccatctggaggcggaggcgcgccggtgcctctcttggatctcggccaccacgctggagcagatgaggctgggagcggaggaggcccgcgggcaccgggcggtgtgtcgtcggcgcgtcgccgccctcaccaacgacgtggagagcgcgattccagagagagagagagagagagatgtgggcggtggccaacgacgcggcgctccaagtagatcgtgaggtcgaagcagccggggctgccctggatcgaggcgctacagatccatcgtcggcggaacgaacgagcaacagtagagggagcagtcaatcagtcatcacttccctcccttgagtattaggagtggttctcagtttctcgctcgattcacttgcacactctttcactccactgctccagtccagtgtgttcacatgctctgccccaacgcaattcaagcaagcagatgagatcgatgatgcgtctcatgatttgctgcctcctggtctctgcgggggtcgggggaatcacaggcgagggcaactcggaagtggtgctcctcctgcagcgcgtgaagccggtgctgcggagggaaggcgggaacgcgcagctggccacctggaccgcctccaccccgctctgcctgtggcgtggcctccgccaaatcccaggaggccgttgtacatcccctatcgtcgtccctgctgctgcatcccagtcgcctcggcttgaggatgtccttccccttcatcatgttacagagccggtggccggcagagtagaagagcggcggtggcgaagacgggctgaggccgggggagaccggaggccggcgccgccgccctccccttctcccacgtcgccggtgacctcctccggaccctgcgagaacagaaaagtgagtgagagagagagagagggaggggaggaagggaaaggaggggaggggaaagagatgattatgtggcaccctgatatgtggggcccacgtgggtcctatgttgactcaactgccacgttggataaagcggggtcaaaaaccattgaaggacctaaaacgaacggttttataagttgagggacgttgtatatctgattttgtggttgggggatattttggtaacccgatgataagttgagggaccttgggtgtacttttttcgaccttatttagatatatggtccacattggcatggagtggtagactagtgttttggtctatctgaataaggtatatgctggtgcaaattattgttattctttgatgtagtattgggagaatactggtacacgggcgtctgattagacaagaaagaatcaggacactgctactcctatatctgcgaataaaatttaaaaatatatctttttttcgtattttccgtttatatatacaggcgaaaaagaattgtatgaatatacctcttccgcggaacgggccgcgggaccgccactcgccgcgcgctcccgtggcttggccgcgcgggaccgccgcttgccgtgcgctcccgcgttgccgttgcgcgcgaccgtttcggtcggcagcggcatgcatgcatcattgcgtcattgctcatgcatgcatcattgcgtcattggtcagctcggctggatgcatgcacggctccgcagggcaggtacgcgggaccgctcggtcccgcagtgcagccgcgcgggaccggcgctcccggagcgtccgcggacaacttttttcacggtcgcgcgtccccgccgtgcgggaccgtgacgtcgcgcgcgggagcgacggttccgcacggccgttccgcgggagcgagtggctccgcctcggtcccgcaccttcatagaggtatattttcgcaattctttcccatacatatatataaacgcaaaacgttgaaaaaaaggtatatattcaatttttattcctacatctgcatatatggtaggctatactacttagctttttctccctccctcctcctcaccttaaatattttttttctaactacttatccgatctacgattcgatcacaccattgtatttgacgtaattaaatctttgtaacaagatatcacatggttatattctaatgaaaaatgtatattttaaaccgttagaactcaataatttatctgcgatagcgacatgtttcaacgtgcgttccattgtgtttcataaatttcacataactacctccctctattctctctcctgcttctctctccattttatccatccatgcatgcatttaacgagctttaaaatgattttttttctaaactacttatccaacttataatttgagcgtatcattgtatttgttgtaattaaaatgaagatttgcatgattatattttgatgaaagaaaaacacatgtttcagaacattaaaactcattgttcgtttcatatgtgatagcaacatgtttcaatacatgttatcaccgtgtttcacaaaatttttaagtgtttcaattgctgatttgtctgtttcaccatatacaattttaatgttttactcgttggtcaattaaaatatttgaccctgatttttttttagaaatcggatgccaaattgtagattcttccgtagtattgcattgtgctttgtgtgttggaattttagttatagagatcattctattcaccgaagactctactcttatttaggtttagagattctagatttatagaaatagggtcagaatctaaaaaagcaggatatcgggctccgagcttgattagcttcatgatctagagaaaagaaaaatctaaattatttaagaaagttcactacgccagaaccctacatctgtgacggcataccagtgacgggcctatgaattggtaacagatgaccgtcacctttgacgggtcgctaggtttgctgtcatcgatggggcatccggccgtggcccgtcacaggtatcccctcacctgtgacgggccagaaggaaaagccgtcacaggtgaggaagtgacgggttttcctcccaactcgtcactggtatcccctcacctgtgacgggccgtggcattatgagccgtcacaggtggtggtccgccacctgtgacggatttgttttacggcccgtcacaggtaggtcaatacctttgacgggcaactggtcatacctttgacgggtttttttaatctaacctgtttgaggtgtgttgggtctataaatactccccaaaccgccaactactttctatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttctgatggatcgtagatggatgtactatgcgcatcgttcgtctaccgagtatagagagggggtcactgaatttgtcacatttgcggataatgacagaaaaagtaggatgagcatgcacatgttgtgtccatgtagggactataagaatgaacagatgatcgaagatagcgatgaagtgcatgcttatttaataatgaatggattcatgaagaaatatacctactggaccaagcatggagagcaagaggcgcctgatgtcgcagctgatgaagtgttggatcaggatgtagagaacaccgccgcagctcgagaaggcatgttcgtaccttctcctttaggtggagagaccatagatttggacactcaatgtctatctacaatgttgcatgacattaaagacgcagaggacaacgacagagattttgagaagattgtcagatgcccttgtatgatggatgtttagtaagttggtggaagattgtcagatgcccttgtatgatggatgcaagtcgaagcacagcaagttgtcatgcgtgttggaactcatgaagcttaaggctagtaatggctggtcgggcaagagttttacagaacttcttaagctgttaaaggacctgttgccagaggggaacaatttaccggatacgacatatgaagcaaagcaagtattatgtccgttgggtctggaggtcagaagaattcatgcatgtccgaacaactgcattttgtattacaaggaatacgctgacttggatatctgccctgtctgtggggcatcaagatacaaacgagcaaagagtgaaggtgaagaaagtaagtcaaagaggggaggcccagcaaaggtggtgtggtatctcccaattgcggagcgcatgaagagaatgtttgcgaataaggaacaagctaagctagtgcgctggcatgccgaagaatggaaagtcgatggtatgctgaggcacccagcagattcagtacagtggaggacaatcgataggatttaccagaaattctcaaatgacccaagaaacatgcgtttcgcaatgtgtaaggacgtcattaatccatttggtgatttgagcagtcgtcatagtacatggccagttctgcttgttaactataaccttcctccctggttgtgcttcaaaagaaagtatattatgcttgccatgctcattcaaggattgagacaacctggcaaggatatcgatgtgttccttgaaccgataatcgatgacttcgaaaggctatggaatgagggcacacggnnacatgggacgcataagcacaagagtatttcaacctccatgcgatgctgttttgtaccatcaacgattatccggcccttggcaacttttctggccaaactgtgaaagggaaatggacgtgttcggagtgtatggaggaaacaagaagcaaatggttgaagcatacacacaagacggtctagatgggtcacaggagatttctcccaaggtatcacccgtataggaatatgaaaaagaatttcaatggacacagatacagccggacccccggcagagctaacagggacagaggtgcacaacttagtgatgggaataaccaacgagtttggaaaaaagaggaaagttggaaagacaaaagagaagagcacgtcgaaggaaaaaacaaaagacaaaagagatgagcatgtggaaaaacaaaagacaaaagagatgagcatgtggaaaaagaagtcaatattttggagactaccatactggaaggatcttaaagttcgccactgcatagatttgatgcatgtcgagtagaatgtatgcgagagtttaatgggattactgcttaacccaggtactacaaaggatggtctcaacacctgacgagatcttgaagaaatgggtgttcgctcggaactacatcccataaccacaaaatccggcagggtttatcttcctccagcctgctacactctcttgaaagaagagaagattgatttgctaacatgtttgagtggtataaaggttccatctggttacttatcaagaatcagtaggctcgtttcactgcaagatcttaagttggtaggaatgaagtcgcatgattgccacgttcttataacacaactgttgcccgttgcactaaggaatattttgcctcctaaggtgcgacacacgatccagcggttgtgttccttcttccatgcaattggccagaagatcattgatcccgagggactagatgaactacaggcagaacttgtgagaaccctatgtcatcttgagatgtactttcctccaactttctttgacataatggagcatcttcccgtgcaccttgtgaggcaaacaaagtgctgtggtccagcattcatgacgcagatgtatccttgcgaaaggtacctagggatccttaagggttatgtatggaaccgttcacaccctgaggggagtatcatcgagagttacaccaccgaagaggtcatcgatttttgtgtggactacatgtcagaaacatcttcaattggattaccacgatctcatcacgaagggaggcttgatagtgttggtactattggaaaaaagactgttaggttggatcggaaggtgtacgataaagctcatttcacggtactgtagcatatgactgaggtggtgccgtacgttgacgaacaccttgcagttctccgacaggagaacccaggccgataagagagttgggtcagaaataagcacatgtcttctttcaacgagtggctgaaaaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcaaggctgctagtgacggtggtcatcgtgatcaatactatggtagagttgagcaaatattggagctagattacttgaagttcaaagtcccattgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccatgtaacaagaaactacatgttgttcgtgaagggaaaaggagaattgttggattggacaatattgcagacgaggatgattacaaccagcacatccatggcataggtcaagaaatacctctagaagaggaggaagaagaagatgacgttcaatatgcacgcgtcgaccatgaggaaggattatttttgtaatttatgtatgtagtttatgtctacatgtctgttatctgtatgactctatatgttcgcaatgatcaatagtatattgctgatgaaacagtcaaataaaataattaattgaagcacccactagaagtgaaataaaataattaaattagtataaccattggaaataaaataataaaattagtaaaataatgaagtgcaattactactgttagtgaaataaaataattaagtataaaaaaaatatagtgtatgtggaaatatgttaaggaaaataaaaaaactaagtgaaataaaataaaataaaattgctgtaggcaaactcacctatgacaggtggcccagagtgttgggcctatcacaagtggcctcacctgtgacggctcaacagttggcgcccgtcacaggtgaggccacctgtgacggccccatagttggcgcccgtcacaggtgagtttgactagggttgtcctagagttggacatcttctagatcgatccagatccagcacccactctcactcactcactctctcaaccgccgcctcgcctctctcgacctctccgccaccctctatgccctcctctccaccgccgcctcgacctctccaccgccgccctcgccgccgtcaaatccgccgccctctccaccctctccgtcgccctctacgccctcctctccaccgccgccctcgccgccgccctctccgctgccctctacgccctcttctccaccgccgcctcgacctctccacctccgccctctacgccctcgtgtgtacgccgctcgccctctccaccgaccgcgaccccgaccttcccgacgccggcctgcaccgccgaccatcaaggccgtcatcctcgccgcgtccccgacctcccaagacgacgtcgggatccacgacgccgacaactgcaccgtcgaccaccgcctccccgacctccccgacaccgggatccacgacaccggcctgcaccgccgaccatcaaggctgtcgtcctcgccgtgtccccgacctcccaagacgacgtcgggagccacgacgccagcaactgcactgccgaccaccgcctccccgacctccccgacgccgggatccatgacccggacgtcggccgccaagacaccgcctccccgacctcttctcctcgaccgccgaccaggtgcgttgcccccctcctcctgatgagatgatgaattgatgaattgctgtttggatggatgacttgcttgaattgaatggatgaattgctgtttagatgaagttagtagtactgtctcctttttttttgatgaaatatatgcatatttgagatgtgaaatatatgaggtgatgaatttggactgtttgtggatgaaatatatgcagtattagaggaattagtctttttgtattagatgatttcaggattaattttgctgcattggttgaattttgcatgattttaactagataaatggccagtgatgttttatgttaatacacccctgctactgttgttattgtgggctacttgttcatttttttaatctacaattgctactgttgctgctgtgttccttgttaaatggccagtgatgaattgctcaacaagaacagattatctacacttgttcattttttttatctatacttgttcttttttctggattgatatgaggagactatctagacatgttgttttagttaatttgcccctgttgttgttgcccctgtggactatctttgcccctgctgctgctgcccaatgtgttccttgttaaatggccagtgatgaattgctcaataagaatagattaactacacttgtttattttttttatctatacttcttttttctagattgataagaggagactatctagacatgttgttttagttaatttgcccctgttgttgctgcccctgtggactatctttgccctgctactggtcttactgtggctacttgttcaccctgctgttttatgtgaatttccccctgctgttgctgcccctgtggcatatatactcctgctgctgctgttttatgtcaataacattctatctgtacccttgctgctgctgttttttaaatttgcatgattgattcagtggttatatacctctacacttgttttttatggataagaacagagtatctacacttgttctttttttatgcataagaacagattttctgcacttgttcttttttctggattgataagaggagactatatacacttgttcttttttatgcataataatagatattgatgttatgatttcctctttttttcccttcatgcaaatgatggtaattgatgcataatttctaagcaaaactgaggccatatctttcatagtataccccgtattacattggatctaatgctatttagtataatggtaggaaatttataagctttttcacgaaaattagaccatgacaacgcccggcgcaaacccgccctccccaacacctgcgaggatccaggaagaagcaaacccagccacggagacagttgctgaaggtcatccctcgacaacagcggtcgaacaacccgaaattcatggtaatttataggataatttttcaccacatgaccacataaattttagctagcactccttagcatatgttgccttctgtttgtactaaagaattgccgcatgaacaacatacatcgatgtcgggtgggacaagtgcaagtaggtcgggtagaaatcctcggtcacaaaatatatggccgaccacaatgcaagttataagagaggttgacgctagtggtaggcccacggcgcccaggactgtcattggaagatggtctaactgctacgggctggcggcacgtgagaactttgggatcctccataaagatatcggcaaggtcacagaagccaagaaagagcgagcttggacggcattggagaaatggttcacatttccggctgaagcaaaggataggctcaagtggaaggcattctagaagatgggc

SEQ ID NO: 64413 - DNA, 1238 bp, Oryza sativa
ccctatctttttgttgcattgaggagctgatgagctgagctaatcagggcagaacaaaggcaggaggatatagttttccaaggtttgtgctcttcctttgttctgttttagccctatgcatgaagaggaaggtatatagtcaagattgcatgcacttctctgattcaaaggttgcttttcaagctagtaactcaagtagatgatcttctggtgtttctctcccaaatctaaacaatgtctgaatctcatcagatcctagggccggcctgcatcaaaaagaaggatgcatccgagcggcggcgcgctgtcggtgccaccggggtttcggttccacccgacggacgaggagctcctctactactacctgaggaagaaggtggcctacgaggccatagatctcgacgtcataagggagatcgacctcaacaagctcgagccctgggatctcaaaggtaaaattgaaattgagcaatcaatcagtcagctcatctagctagccggccggagctagcaagcatgcaacagtgagatttagctgaagtttaaacatggtgattaatatttcatgtggtatatatacagatcggtgcaggatagggacggggcctcagaacgagtggtacttcttcagccacaaggacaagaagtacccgacggggacgaggacgaaccgggcgacgacggcggggttctggaaggcgacggggagggacaaggccatcttcctcgccaacgcctgccgcatcggcatgaggaagaccctcgtcttctacgtcggcagggcgccccacggcaagaagaccgactggatcatgcacgagtaccgcctcgaccaagacaacgtcgatgtccaggtatatatatatatatatatatatatatatttgacatcagcaaaaaccatatgcaacattaagttcacgatatacatacttagcatccatgaaatgccaaagtcatgcatgatatcacgactcatgagtactggtactccctccgtccaaatatataagtatttctagctatgaacttgaacaactgcgtgtttagattcatagctaaaagttactatattttgggacgaattgcagttatgctagttttgctatttatcagtcatctagaactttgttattttgtcagttacctacatgaatttgtgtgtactatgtatatgcaattggggggtgatccaaagagaataaagtttcaggctgagaattagtaaaaagggatat

SEQ ID NO: 64414 - DNA, 15086 bp, Oryza sativa
ggttacagcaacattctaacttcaagtgctctaagcgatatgaacaaggtgagcacatagccattcactgcgaaaaaattgtattaattgtctctggctgatcttgttgagatttctgacaggttgttttcaccgtcttcacaccatctctcatgtttgctagcctggcgaggacggtcacgttttctgacgtcatttcttggtgagtttcagtttatagatatgcaacaatgcaagtgcagttactacaaaatctgcccaaattccatctccacattctaataactgccaaaatcaacacaatatgtatagctcagccagactttctgaattttttgaaccgtaagctctttctgaaatttataaggattcttgcagaagtgagaaactctctttctgaaatagaaaacaagctttacatatatagttttctcattcagagcactgtttaaatatctgggcagagcatatatacaatatccaaattttgtttgctgggtaactccacagcactaacaaaagaattctatcatgtaggtggtttatgccaattaacatagggatcacattcatggctggtggcactctaggctggatagcatgtagaatcttgaaaccaccacaacatttcagaggaatgatcattgccttctgctcagcaggttagtttcctaggtggattgcatgtttttaccctcatatttttgctgaataatcctaatgttagcagtgtcatcaactgacaaaaaatgcaggaaatcttggcaacttgctcctgattgttgtcccagcagtctgtgacgaagatggcaacccgttcggaaaagacagcagccgctgccgatctcttgggctctcctattcatcattgtccatggctgtaaggaacaaaaatatatcattcactgaatgatcagctgaacaaaagaactgacacacactgtatctgcactgcagcttggtggcttgtacatatggacgcatacgtacagtcttatgaagaagaagagagatcaaatgtatcaccagcctaacagcactcagtgccttgacgacagcgatgaagaacatcattctaagaaattcaaagcaaatggtgaagctgcttacgccgatgaggaggcaactcttccggtgtcagctaaactggctcaacacaacgaagagaaccaaatggtaagttgagtggtttgttcctcggaaaaattaatcttcagagaaaacttagtactattaacttgtctgaaattcaggaagctccattgctgtcttgcgagagcaaggttgctaagaaatgctcgtggacaacaacaaacctgaaggacaccatccaccacgttgtcgaggagctgatggcaccaccaactctatctgctgtgtgttcctgacaaaaccagccacaatatttcatctcatcaacccagtcttggactaaatttggttattcttgcttcagatacttggatttgtttttgggctagttccatggttgaaatctcttgtcatcggtgatggcgcccctctcagagtcatccaggactccatccaactgatggggtaagttagtatttacagtgttcttcttcatagagtatatttctgtctatttttcagtgttgcccttcttttgcttgtcttgcagaaatggcacgattccttgcgtcaccctcatccttggtggaaatctgataaaaggtaggatgtcaattactcatgattcatgaagctgtgtgttttctgaacctttatctgaatgtgtttatgcagggctaaggaagtcggagctcaagcgtacggtgatcatcgcgatcgtctgcatccgctacgtgatccttcctctagtggggattgcagtagttcatggtgcatactgggtcggattcttgccacacgacccgctgtaccgctacgtgctgatgatgcagttcgcgctgccacctgcaatgactattggtaatctttccctataacagatgtcattttcttcgtactctctgtatttaaatatatggtactgatgattttatttcgtcgatgcttatgattttatttggtctttaatgtacaatgttgacctctattttctattttctgttacaatataacattttttatagctaacaaaattataatattgtaaaagtacttagcatgaagaaaaaaacatacatatatgattttttatgtcttacactaaatattttgagagctattgttatcaaagttttaaaagtgtaataaccaaataaaatcaacagtatcatatatttaaatacaacgagcgtacttattttgcaaggcaataccatttcgttctaaagcattagtctctgcttccaatgagatctcctctgatcatgcctcttgcatgtgtgtgatctaatacaggaaccatggctcaactgtttgatgttgcccaagaagaatgctcagtgttatttctgtggacttaccttgttgcttccatttctctcaccacctggtccacgatattcatgtccatcctgtcttgaggtcaaagtcgacaagaacaaaatgcgtcgtgatcttggttaagtgcaatgatttaagcatttcagctaactcaaagggagtaggttgaagataataatacgcctctggaaaagagtcgatccaactgaggcttgttcgtgtcaccgtttgcaccacctgtataaaaggagttgagcagtataggcacaacggtttttttctatcccaatctattggttcatttaattggaatggtttttcatctcttaagggatattcataattcactgttttcacatgtcatctaatagtcatgaaaatattttaaatttttttaagtaagatcaatatatacatgtatatcagtttatatacatataagtttattaaaaagttgacctatacagattgaaaaaaaaaaggtgcacagctccagctcctaactctaatttacctggagccggaattgtgccaaacaatccagatcctccatttttggaagcggagttggcagagctgctccacaaaaatatactacgggggtggagctgggtttttttctactccacagctccacttcacctcaaaagacccactaccctttaattttttagtgtatttacgcaaaaatgccactgaattactcctacccacctctcctcccgttctctctcctttgccaaccaatcctctcgagtcacaaccagctgcggcgggaggcggtggcagcgtcggcggtggtaggcacacgacgacatcagggcggcgggcagcgagcgtggcgacgaggcgttggaggcgactagacggcgatgggcggagagccggagacgaggtgcgggaagcggccgacgtgcagcgacggcgagcgggaggtggccagtcggcggtggacggcgcgcgcaacgacgacgcgcaaccgacggcgggcggcgcgcctgggattgggcaggccagcggctagggtttccttttttttcaatttttttttcagacctagagctaaaagctagccaaacacttctcaacgactctccaactctaacaggagctagctcccactggagtaggagtttggagctaggagttggagtttggagccctaccaaatggggctaaagtgtgcatattcacaaacatatttttaatagatcgaatgcaaatctatgtgtttttgaagtgatatatcatgtattaattaatcttgtcgaatttacattgctatctattttttttcataactatgtggatggcttgaaaaaacactctaagggataaaatgaatttttcctatttaattatttcttcatatttgtctgttagtatatgcccgtctattgagaggtaataaaaccaccacatttactttggagttctataattcaccatattaattaaagaaaacaataaataatactattagattatggttggctagattatagctttaatttggagattgatcaacagtgttgtatacaactgtgcattttattgtggaaaacaaaaacaataactgcattaaaaatgtatttacgaaaagagaagcaatggttgtagataaaatacaaatcatattttgaacatacagctcgacacagtattgtaggagaaaatccactagcgtgtacgaaactaggaaatagatgcagtgaccgcaacttctttatggtaaatacacgtatatggtatattggtttcgataaaactaaaatagcatagatattcccgacattttcttttgagtaaattttatttcactttgagccatcttttaactgatctttctcttcagaccatcctttaacggatggttttgctttggactagttaatcttgcttgatactttagaattcggaccaccattaaggctgtgttcggcagcatagtttctcaattctctcccctcttatttttttcacgcgcacacttttcaaactattgaattgcatatttttaaaaaaaatttatatgaaggttactttaaaaaattatattaatctatttttcaaaaaaaaaaagctagaacttaattaattcatgtgctaaatgagttattctattttacgtgtgcggtagatttgttcttaactgtaagtaactaacactaacgtaacctaattattttactcacctacatccaacttacatatgtcaaagaaatgatctatatacaactgtaagagttcattgatgagtaggaaccggtataatcgaaattgttcatacttttcaaaagagagttagagtaatttaaagtgcaacaaaggtaaaggtaagattacccactttggttaaagagtaatacaaaataaaacttcggtaataaaagatagcccaaggtgaaatttacatttttttaagaaaagaacatgtaccctacgaacacatatatatgccctactattaagcacgtacgaaagactgagcctataataatatgcaatctctaaaattattattttaactaagggaccacctatatatttgttgacaaattttctaaatcgtagtgtaattacactataacttgtatgtaattacactgtaacttgcatgtaactacagtgtaacttgtatgtaagtttcacgtaattttgaatcgttagatctattacaagatttgttctggtgaggaagaaaaaaaatcacagcacacagatatgtgaaaggatttgttcccacgacctctattttactgaaataacatgttaccgagagattcttgaaagttacatacaagttacattatagttgcagtgtaattacactacgattgtactgtaattacatttgataaatttttggaggaaaacttgtcgacaaatatatagcaaatttgttaactaatacaggtttgaaccgagaaatatggttggtcataaataaaataatccggacgcagtcaccatacctaggtcgatatttaattatttattccaacgcagagaagaattttagaagaaagttttgtactcaaatgaacatcatgtttcagttcaaaaaaaaaatcatccagttcaaaaaaaaaatgaacatcatgttccagaagctgttgacaccatatgaattattgcagacgatccatgtatcacactccgttcatatattcctgggctgtattatttgcacctgttgaatgggcatgtcttgtgtgtgtttctataagcctctattccaccaaactaaggattacaatcttcttaattatagacattattgagattttgggactaaagtaccaaatcaacacaaatatagaaaaatactcccgtaataaaatgtattgactttggtcaaagtcaaactgttttaaatttcactgagtttatagaaaattagtttatcttgggtaattagttttaaatttcccgtaataaaatgtatttacattatcaaattagttttattaaattaataattaaatatatttttataataaatttatcttgggtctaaaatattactattttttttataaacttatcaaacttaaagctgtttaactttaaccaaagttaaaacatgttacaacatgaaacggagtggagagagtacctaccccaagaccctgataaattggttgctctcgtctcttcttgcttacagaagaatcctcgcttctgtttgttattccacgcttcgtttttttttttttgaattaatattccacgcttcgttgcgcagctctcagtcaaagcacgccaccgtattacgggagatggtcgccgccgccgaggccaaagccgccatcggggtggcaacgccgacgccgacggcggcgccatgcgggtcgacaacaacgccgcgcgatgccgacgtagacgacaagatgaccatcgtcggccacccggcggcgtcgctcccgctggagacgcggtggccgccgttcccgctccgtcggctcggcggcttctggatgcccgagtccctcctgccggccgtcgcggccctccacaccagcttcgcgccggcgccggatggcgtgctcctcgccagcttccccaagtccggcaccagctggctcaaggcgctcgccttcgccgccgcgaaccgcgcggcgcacccgccctccgacgccgaccacccgctccgccgtcgcaacccgcacgactgcgtcgagttcttcgagatgcgccccgacgagcacaccggcgccaccagcgacggcatcgccgtggacgcggcgtcgccacctccgccgccgcgcgtgctcgccacccacctaccctactccctgctgcccaagcgcatcaccgccggcgacggctgccggatcatctacatctgcagggaccccaaggacacgctggtctccttctggcacttctccaagaagatggcggcgaccatggcggtggacgccggcgcgttcacgttcgacgaggcgttcgagctcttctgcgacggcaactgcaccggcggcccgcaatggcgccacgtcctcgagtactgggaggcgagccggcggtgccccggcaaggtgctgttcctccggtacgaggacatgctgcggcggccggcgagcggcctgaggaagatggcggagttcatggggtgcccgttcgccgcggcggaggaggcggccggggtggccgacgccatcgtcgagctctgcagcctcgacgagctgaggagcctggaggtgaacaggaacggcaccgacgtgctcgggctgaagaacgagtcctacttcaggaaaggtgtcgccggcgactggcgcaaccacatgacgccggcgatggcggcgaggctggacaagatcgtcgacgacgccacgcgaggctctggattaagccttgccaatgcaaccccgtctccgcccatgcatgaaaatgaaattaagggaaatttaactatttaccactcttacatttaactatttatcacccatatttgaatgacatactactactctatcctaaaaaaaaactctagctacgaacttagacatgtatgtgtttagattcgtagttaggattaatttttttttaccgatggggtatgggcttaagtactgcagtttatttttttctatatatgttactgcgtgtttcttctgttctggatgtgcggtgtgaagaaggatagtgtgaattatttgtaatataaaatgtgcagttcaaaagatcaaatagagtcaaatttaattgttgttatcctgacttttctgggcgtttgaaaattgtttagcatagaagtcctcttatttgactccaattttccaactagaagacaaatcttcgtcatttcaaattagtcataaattatggtacaaatacgtacgccagatgatacatgaacggaaaacaagtcaaaattttggttggataataataaagcagtactacaataaacaagacaaaagcatttatccttttttttaaggcaaaagcacttatccatgcaaagagagtaaccaacacagaaacaggtgggccttgtgggccgagataaatttatgggcctgtttactgggccccaccaccttaaactccctcctttctcagctggctttgcataggctttggctgtgataataactacggtcatgacacaagtcttttcgtcggcaacgacctttgcatcgtcttcgccgacgatctaaaagacttgcgtcagatggttagaatttagaaaacctgatagaattagggtgggtttagttcacgttaaaattaaaaatttggttgaaactggaacgatataacgaaaaagttagaagtttatgtttgtaggaaagttttgatgtgatgtaaaagttaaaagtttaaagaaaaagtttgaatctaaacaagagctttgtgcattacttactccggtctaaaacttgaggtctcttcgcctatgatgctcaatttttcaatatttgttaatctctttgtaaggaaaacattgaaactggctaagatatttgttaatctctagagtacatgctctccttacacaggaacttatgtactccctcctaggggcggatttaggaataaaaaattggagggctcaattacatagtttctttaacctctagccatctaggaacctttagtttatcattcatggtgagaaaattgaagggagtgctccaggggtatccatgggtcttgtgggtgtattcatagtgagaaaattgaagggattcgagtcccccctacacccacgttggatccgcccctgctccctccatcccagaatataaacaattttaaagttagacacaattatgaagaaagtaggtataagtgaatggtggagggttgtgattgattgagtagtgaaggtatgtgagaaaagtgaatggtggagagttgtgattggttgggaagagaatgttggtggaaaagttgttatatattttaggacaaatcttaagagttaaaagttgttgtattttggaacagatagattgtaaaccaacattcacatataaatatcaaaggaatttttttcttcgcacgtgcatgttggatcttctgcttctgcccttaaagatggttactctagtagtagcaggtcgtacaaacaaacgataaagagaatccggttgaattcaacatagccatcgtacgatgtatctgcaaatgaaaagtaatttgtgaataaaacttttatatatgtgttaagtgaaaagatgaggccacaccctttttcgtttgggtagatgtacaagcagagcggtgaaaatagaggagcatctgccgcgcactggcgctgtgaaactgaacgatgttctttactctactttcctaacttatctctctcgttttctgcgcgtatattttcctattgttaaatagtgtaatttttttaaaaaataatatatataacagttgctttaaaaattatatgtattaatcattttttaaaatttttttatagctaatacattaattaattatgcgctaagccatcgtttcgttttatgtgtagtagggaagtgtttccaactcaagttggcgaacccatccgaaatagggggttgggtgcagaaaatgcccaatttaatgatagctcatttttggtggtatgagttgttaggtacgactcaaaatacgagccaaagtcagggttcatactctcaataccggatcgaaatatgctgagagaggtatcattggatttcgcagagtccgttgataaatcgatacaatatataaaatttgaataaattttatcaaaacttacaatttgatttgaatttttttgtacttagcccaaaaccgagagattcgtgtttctagagacgagtaaaaatatgggccagagggtgtcggtaaccagttttggatggtgcaaaaggtggtgaagttgctaggaatgaaagatggaggcaggataggacggggcaagccgagaaggagctaacctgatcgagtttactgaaaggaatgctagtgggaggtcgccattgttcacaactcaattgctaatgcagtcatgttctagctgagttaaaagcggatgagacgagaagcttcttgatctaattcaagaaatgctcatgggctagtctggagttagcaatggaattcccataggagcacggaagatgcatatgggtttgatcctaaccgcggttgcaaaattgcccatgcacgtgaacatgcacccatgaccaatgagcatggtttacacggttgatcgctaaatttccaacctcatcgatatcatggttttcgataaattttgattgaatttcgaccaaatctaccatttaaccttcgaaattccaatcgaaacttaattccgagccgtatcgaaacatcaaaatttcgtgaaatttgactggttttcatcggaattgtgaaccctgccaatgagactgaacccatgagcgactctcacgtctctctttgagaaatttaggattgtgccattctaaaaaaggatttatccaaataccatctctcaaacacgctttaataatatgctaaaacggtgtccgaacagccaaaatgaatattcttatattcctatccaaatatcgcaggttttaattcctcaaatcgaaaaaatagaaatagaatccgtttggtttcccaaaacaccagtgatcatatccagttcgtgactctagctgtgattgtgaaccgtagttacctttttcaccaccgcccaaataggagcatatcacggctcacggcggcatcgacgatcctcagccgtcggatgtgtttcggcttttgcacagatccccatatgccgcgggggccgaaaaaagtgtcgcgatagtcgcgccctccaactccaactccgccgctctctccgcttccgttcccctctcctccttcctccgttcccctcaccggccgggagcgccgccccgcgccgccgcgcctctgatcacgccgccgccgacgccgagaccccctctccgctcggtccacccgtcctcttcgggagggcggcgccgcgaacgaatctccagccccacctccggctccgggcattgttggaaaaacccaggtaaacccctgttcactcgtaagtaacgaagcgtaggcagggagagcaaagcgagcagccatggctggcggcgtccgggaggggagggagattgagatggcgccacgccgggcgacgattttgctggggcggatagggtgatcgtgttcgtaggcggcggcgcggccacgcgcgcgtctaggcggggaggctcggccatgagcggtgagcggccggcaggctgggtgccgggaatcgccgatcgcgggcggcgctgctccatttgctggctaggctgggccggtgggcagttgagagtcattcaatgcccactacttagtactctattttcgtcatgcaatcgccagcgtgctctatttggtttgtgtttgtttgttttaggactcaaatcgagcttgttttccttcccatgcacatgcagggtgaacgcttcgagggctggagcagctgctgttgcgtggcactgattttcgtcatcttgcgttgctgaggccgttttagttgcccaggcttcctaaaattcctgcctcctctgccactggctgaaggttgttagttgttaccaatctttttttatggacagctgtcattggacctgcaattttgtagtggatatatgctattccaatgcatgcatactttttgcaaagataagtggaatgtggggctttaacagggtacttgtatgtatgttaatgttttctagtcgtgtttattgttcaggatggaggagccaagtcttgaggtgaaaatgcctgaagctgatctgaaggccgtcaaattcagcctcatgaccagttcagacatggtaatctttcacactggctgtagatttaacttactgtcattagaaataaccatcgaatttgtgttatttcaggaaaagttaagtagtgcgagtattattgaaatgtgtgatgtgactaatgccaagttgggattaccaaatggtgcaccacagtgtgcaacctgtggatcgcaaagcgtacgtgactgtgatggtaagtaaatattaattatgcagcatcatataacacgtcttttttctccatttgctaactggtaggagtaattgttaggtcatttcggtgttattaagctggcagcaaccgtgcataatccatgttttattgaggaagttgtccagttgctgaatcagatatgtccaggctgtctcactctgaagcaaaatggggacacaaaggtttgtagtcaccagattgatgtagtttcatcctgaacaagcaatttattctttttttcacaaaacctataaatatcaaattcctaattctctagtgacaaagcatcttcagtcaatgagaggctctcaagagctcatccaagcaatttacttgatgcccagttatgggtttctttcgccagtgtccaacttcttacaagttttcacctaaggagtttagttactttttacttgtggtcaactgtatcacccccttcccccaccaaggcccaattgttccatgtttgggctggtttaataactacagtaatatgagaattgcatataaaacttggggtttaggacttatacaatggggacggaaatcctgagtattatatcaactgccttaacgtgagcacagagttactgttaacttattggcctagtttatttagctatcgtcataagcttttattgcagaaggcagtagaccttttttttttttgctttctttgtatattgatgatgaattagtgaaaaccttatcatttatttccttaacacattcttctttttttcttaattaaagaagactgatgggacaacaattcagacaacttgcaagtattgctcagtaagtgcatgtgcagatattttgtgcatatttctctctcatatattttgtgcatatttctctctcttgtattaaacattgtgtttttcctggacagaaggatggagcaaaactttaccctagtgtaatctttaagatgctaacaagtccaagagtaacactatccaggagtaaacttcaccgtaacactagtgtgatggacaaaatttcaattatcgcagaagttgctggtggggtgacacataattccaagaacaaagctccccatgaaacccttccccaagatttctgggatttcgtacctgatgataaccaaccacctcaatccaatgtggctaagaaaatattgtcaccataccaagtaatgtatcttttagctatccagttgaaaaaaattctcttttgtactgtcttgcaggatagacttcaatagtacttcagttctgtatctatctactttcaagaaaattattctcttttatttgctgaaatctgccaatttggttactgttaattttggctcaaatgcaagttatagcgctcttattggttgctttgattcaaaaatttaaaacacacagaaaacataacgatactgttctagtaagccataaatatgatatattatgatctcacctggtaaaaaattgttttgtatgactataaaactcttcccagattatctggtatggatcaccaacttgatgcataatgggtcaatatggacccatagccatatagcatgatgaataaagtttgaccactcttcgatgaaatcatgatatgccttctggtttgctcttgtaagtgaaaggcgaaagtatgctgtgtagaacatattacaatacaatccgtcatcaaacttataactctggggccatatcaatgtctaaaatgactattgcttgtgatcggtaggagtactttattaaggttctttcagaagtgggtatgcaattctagttggatactgaactggcatgacatattccatcgattcatcgcattccttcatataaataaacaagatgcttatcacaattaatgaattatccttatactcattatttccattttttcaggtctttcacatgctaaaaaaccttgaccctgaacttatcaatcaggttactccaaggcgggaactattgttcctgtcatgtttgccagtgactcctaactgtcatcgtgttgcagagatgcaatatggacattcagatggcccccggttagcttttgttagtgtcaactctcttttaatatattgtttgtttcatcgctttcaagacttgtcttctccttaaactactagtattaatatactctaaccatctgtatactggatagagttaaatcttccagtgagttatcaaatagtcatttaatcaacgagagagcttagagtagcttctcaacatctttattaaaaaggtttcttcattgtactgtctgatctaaccttacttttgtgccaagaggaggcagcactttattttgttcccatggtttagttgaactagcttgtgataggggtttgacagacatgcttgagcgcatattttcaatattttcgcatctcaattatgaactaatactttcttcattccatggtaggatgaccggacaaaagcatataagaggatggttgatgttagtaagagaattgatgattgtcgccagcatccacagttcagtgtttttgcaagttcagttgtcacaagccgcgttatggagtgcttgaaatcatccaaggcaacatagctaaaaccttactctaaagcagtacctatgtagcatcgtgcactttgtcttgatatgtttttccagttgtcatattggcattaatttgttatagtacttttggatgcacaatttttctgaactttctacatccactaaaatttacctataatttatcttggtgttctgataaatcatagtatcagaacttcaaatttggttggataaggcatggtttgtttaactatatcttgtctcttgtgtttaaacacatgcatatgtacatcacaagtgtggcatcttgacaaaccattgcagtggaaattacgttgtgccctgttgttttgttcatttatctccatcttatgtttcccttatttggttcacacatataaaataactatttgccactcccataaagatgtttgtaataacttgtcacttgaaagatgtcaactaattacttgtcacttggaagatgtcaactaattacttgacatctaatagttgagtcctcttaataaaaaacccattttagccatttttcacactctaccttctaatca

SEQ ID NO: 64415 - DNA, 2443 bp, Oryza sativa
ttctgccagctttttattggaccacgtggtgcagtaattttttcgatgtgggaggaacatacgtgctcttgatccgtctggatagatctgtacgtcttgatccgtctggatagatccgtacgtcacgctgctgaaaaagggaaaaaggaagaagcaatacgggttcacacacaggctggcatctagctgggccttagattgcttgggccttgctggctggtgaatggtggtcaacacgtaggagtaagggtgcaagcgggcaggcccacgaacccacttatagtataaataagcgggttatccggcgtattatggattacctgcttatttgtactataagtgggttcgtgggcatgcccgcttggtaggagtaggcagataaagaagaaaagagaagtagaaaaaataaaataaagaggtacaaatagttttctgaaattatgagtatgatatactacaggttaagctgtagattgaagcaagtacggtaactacacagacatcctgtatgtctataaaatacgcctaaaaacaaaaaatagaaaaattaaatgtcttcgatcgaacttcttaagcctcggaaatctttttcagaacttatattccactaatactacaaatttggaaggtttatttgcaaaatttttgtgtcttatgaattcgctgcagttttgagaaaacatatctttgtttctccctaatggcatataatcatttgccaaagttaaacacacatccataactcaacaaaattattcacaaatataaattactatgctactttgatccatctcaacattgcaaaaatatttaaaatacattataaggtcttgtggaaattaaactttttctatattatgtacgggctataaataaccggcacgcctaaaggtgcgctgattttctaagacattaagaattaggtcaatatttattgattatataccatcaacctttgctgtattgcatgatcagtgtgtggatgggctttgcgctttggctattgttatttatggttaagtgctaaaatatcctttgtttgaccaaataaccaagttgctaggtttatgcactctacatctactgtggatagaagtaagtgtctgaaaaagtttgatctttgtttttgtagctttatttgattagccagctttaccattttgttattatcaggatacgtttcataatgtcattctagtttctgttgcttcctatctttggttgtgataagcattcaggccccgtttggctaatgggaaagggaaatcatttcccacccactaaaagacatctttaaatcctaaccattcattctccctcttccatttaatcctaaccctttattcatttcccaatcccaatctcaccccagggttaagatatcttattttccctgcatcagatactcaaattaaagcattatttttagtgggtaaccatgtttttcagaaccactcgctctgatgacaatttgttactgctatccacgctcatttttcatatcaagttcagaaactgaaacttccgccccatatagcctgctgccttttccactctattgattatttaatgtattatacaaaacaacctaatcgttgagggatctaattagtctgatgtgttttgcaccctcttgaagtatggtgaatgactgctaatttttgtgacacaagaaatgggaaaatacatgctaagtggactagtttaggagtctgggcggctgggcctgatgaaagttctgtgcgtctcctttgcagaacttagaatctattccgcgagaacactatattttcaaacggagtattaattttggtacaagggctggctaacaatgcagggagagggagcacgtgcatcagtatacacagatgaatgtgcctctgattttagctttcttgctataagttgccctcctgttgtaaattgggcataagtaaattttttctattttgttttgcaaaactattatagtaagcttaagcaccccaatccctttcctgatgcagtgttgatggttttgcttgcaggggcgagggacattgtttggagaagaggtgcgccgcggcaatgaagctagcctattccgttctattcacctatcaatgacgagaagaaatgttggattttttcccccttccttaattgtggcatggatttactattgctggttttggggtcctctggtggtgtagagaattttctatgggggccctttttttggtgacatggacatagactggtggtgaaaaaaaagaaaggatggtggtggggatgttatacattttaagtactatatgttacttgtcatatatacatatctgggagatctgcaagctctcctctgatggttggcgttggcgagcttaacaaccagtgcacgatgagcgtcctcttttttaatagcgatcggatcgcgtacgtgctctcttagaagcatcaactt

SEQ ID NO: 64416 - DNA, 2368 bp, Oryza sativa
cgccggcggcggcggcggcaccgcctcgtcgttgcagaggcttccactgcagtatctggggtgcgaggcagccgacctgctcaggttctccaagtagagagattatccctccatgcatgcatggatcacttgaactaagctagcttaattagctgccaccgataaatgagcagttgatgatggtgatgatgatctgaatgatcagctcatgtttttttggttagactggttaatttgatcttccttttggtatggagcttaatgcttccaagtgtatatacactctatgctatgctatgctatgttttcccatgtgcatgcatgcaaatgtggctttgaaacctaattatacatgcatgagaatacttaattaatatttctgattttcccatgcatttttggatttaagtgttgcttcttaattaggatgcttcataattgctggctgatgaatgagaaccgatattaatttaccatgtgctttgcttgctagagttcattaatcaagaactgtcattatatattgcacatatatggattattgctcatgttgtgtttaaacctttatgcaatattatgttgggttaaacattgaggtaagctcttgataataattgatagaaccaaggaactgcatggattatattatttatcttgctctggattatgcttttatttttatggaggtaggtgtcactttccctctttgttcgtgcatgaatggtttggacgtttggtgtctattcctctactgaaatgaatgaatatgttccccttcagattaaggataaaccatgtcaaattcgtgttgaattattgtcacatctacttcttcattgttggttgttagacctgattgaagaagaaatcgttagaccttataagagaaaaaccaaaagacttaatttctttttttctcttagatgtgcactactcttccacaaggtatcttaaactcagaatcatatcactaatatgcatggtttaaatttcatattgactctatacatatcaaccatttcatcaatcaaggaggagctagtttagttatttaatgaaataagacgatatatagggagaggactacagtcgggtgtctgacgttttgtacgtcggacagtgttgcatgacattgattccaagtgtttcacatgtttcatcttttgatgggaaaatattcaacaaaatatggagaaaaaatgtttcatcgtatgaaaacaatgtttcaactgttgaaaaaacatgtttcgacataaaaaaaatatgtttcaacaattttaaattatgaaacacaatcaaaacaatactgaaacattttcttacaacacatgaaacatcaattttgaaacatccaaatgcttcgggaaaacaatgaaacacacaaaaaaaaaccactgcaacattttagtctaaactaatgaaacatccaaatattaagctaaaacataaaaagagaaaaaagcggtctagatctatttcttcctcttctccagtgataggtaggccaccatgttaatgttgggatacctatactccatgaagactctctattaccttctcctattgctgacgaagataaggcagagcttggcgccgcgccgctgtcaagcaagctaacactgagttgctcccctcattgatagtgtccactcccctggatctagtgccccttagctcaacgtatactggagacggtgccaatgagacaccgatgggtggtggacgtcaggacgcccccctactgcgtgccagcaatgtggcggagtgcgagatgagtcgctcttgcttgccgtcggtgcaggtctctccatagctagccgttccggtgaatatggggagagaagagaggaaaataaatggttgggaatgaggttaagattgactgttgagcagaaaaggatgaaaagagtggttaggtaggactcactaggtaagcgtcagatatttaatcacactccggacgtacgagttaaagcatttccgaagttatggtgtccaattttcttcttgagcaggttgaagcattttccaatatataggggacataattaaatatagcttcattccaatccaactggcctttaatttctctgtaaagctaatcttcatattgtgtagtccgttagggaaaaagcagattaatttccaatacattgcgtaggtgttcgcatgatatatagatattttgttgtttgttatgacttttttatacttcttgattattacccctccggttttaaatagattgcgccgttgattttctatcacatttaaccattcattttatttaaatgcaaatatgtgaaaatgcaagttatgctaaagaaacatttaatatatgataaaccaagtcataacaaaataaata

SEQ ID NO: 64417 - DNA, 2172 bp, Oryza sativa
ttacatgtttctaattttaaagaatgaatcaatgttaaatggattataatgtgtttagtatttaatttcaaaatatgaacttgtataaagaaattaaaaatgacagtggattatttagatgatgaatgataatggatttgaatttatgtttcacttgtaagttactttgatttaactaaaaaggcaatttattttaaaagaggtagaacgtattttatttataaaagatctgtcattatctttttagctgaactaatttttcgatgtgctataatttcttttatgaacatgtaattttaacgttgctactcctttcatcccataaaaaactaatctaatactggatgtgacatatctagtactataaatctggacatacctttgtctagattcattgtactataatgtgtcacatctagttttagattcgtttttttttggacggagagagtactagctagtgattgtggggctggctggcccaagcattggggcgcacaaataaatagcgccatggtgcgagagagagaacgacaagggtatatctatactttctatatagttggtacccactaaattattagaagctaaagcttaacatgcaagcatgccacatcatcacccactagcaattactattctagcctattttaatcccatgcaagcatgatacatcatctacaatattatattatagagatcaacaagtatatgtcaaatcatcttcctcacattattttctcaacatttcaactatcatcatttctacaatatttaacatatatttatccgtgaatcccgcagcaaagcgcggggtatcacctagttatacaaaaatcaaacccgatcgagtctcgctttctcctcgcgtccgatgtttctccgtctccagtcatatatatttgaagggaaggggccgaacaactcttccttggtttttgtctttagtttttttttctccgtagatattcggaatttatttgcgaagttagggatgccacgtgctcctggcctaacgggcagctttagaaaagtattctatatatttcatattacttaaaaaactgcccatgcctggcaacgatgagagctattttaatcctattattgttactagaaaaatgcccatgcgttgcaacggacgaagtctattttaatcttattattcttatatgatttagttaagatgaaattcactgtgagagttcgcttggatatatatatatttttagaaaatcataagctgcagttaggagtccaatcgtcttaagttagcatgcgagtttttttaaagagatttcttatatgatttcttctgtattaccaaaagtgaacaatcttaaaaaccgactcaaaaacggatatgtatttccaaaagcaaacgaacttaaaaaccaactcatacacggatgacgtaccaaaataccggcaaaaacatcttcaatgtttataatactagagataagtcgttgtttttttcataatcaagtttatagggtttaatatttcaaccaaaataaatatattatcatatatatatatatatatatatatatatatatatatatatatatatatatatatatatatatatatttaatgctaggtttaataaaattaattctataaactcgagtcataatacaatttgaataattagtagcattctttaacaagacggggtgtagcacatatggtagagcgctcgcttcgcatgcgaggtgcacggggttcgattcccggcacctccatttgtttctggtttctatataattttttgttttgcttctatacaatttatgatttaaggtcatgtactcaatcacaccccccccccccccccccaaaacaaaaaaaggatgttttatttggagaaccgaaaaagaaataggagctcccggcgaggatcgaactcgcgacctttcgcttacgaagcgaacgcactaccactatgctacggaagcggttgttgccggtttgccgctaactttttactacaacttaaattttgtattaagtatattacgggaactgcctgtgctgtgcttgtgctgttgtgcacgcggttgtgccctttgcctgcaaacattaactgttcttgtgcatggattgcttttatatgaatataattaattggacttatttgtaaaatactttctctgtttcacaatg

SEQ ID NO: 64418 - DNA, 838 bp, Oryza sativa
ttctgtattttcattgtgtttgtggctactgatctttcgccattaagaattaatttcgattttacgatgctttccaggtttgcattgcaagcaagtactgtaccccggttgagctgctttgaagttcagacatggcatcctcgcctcgcttgctcagctgtcaatttgcacttaaattattgcataatggttgcacaaagcacatgttatcagtctgtcggtgcatctgatctgaaagctatgtttagtcgcaagaggaaaaaatactaatctgacagcacaagatgaaccaagaagttggcggagtttaggcgttgattattgttcacaatctcatgtggagaatcatgtctgattgatgcaaacaatcaactaaagtgaaagattattcagacaagtgtactcacctatagacattatcgtggcaattccattcccaatattccaagcatttgagcacaatgccctcttcttccttgatcccagctgatgacaagaacaagattgctgcccttctctcctgtgatacttggttgaatttgttcttgttccgggtgagagatgggccatgtggcccatgtcattgctaaacatgaccggcaaactcatggaacccatattggtgcagttcatctttgctatattctttgatacgaaatctcgcactgtctcgtgcggttcatttcaaagaaaaaaattgttgtgggtgtccttttcatttccttttaagtatcaatattggcatttcttgtcacaaatgccattcttttgtcaatgttgacaagactgggaaatgcaatctttagcatgcttatacacaaacacagaggcaagagca

SEQ ID NO: 64419 - DNA, 26236 bp, Oryza sativa
aatgtaagtcattttagcatttcccacatttatatttttttatttttttattcaacatcaatatatgaataaaaaaatatgaatgtgggaaatgctaaaatgacttacattgtgaaacggggggagtacttgctatactttgatctagtagaagcacggacgacacgcattcattcaatagttggctcgcaaatttaatataatgttccacgcatggaccaatcgaattccgggcgaaaccggaagacgagatatgatatgtatatgacacaaatcatcaacatagataatatatcgttgaattgttcgtctcattgctattgataattgatacacacttgcatacacacaagagaaaactgaggaacagatcatcggtacgtagtatattcgcgatggacaaatcgatatatatatatataggatagagccgtaggaggcatatttagattgagaagaaagaataattagttgacggtgaccttgccgaccatcccagctccggcgtgcggctcgcagtagaagccgtatgtgccggggacggtgagcgtgacggagaaggtctcgccgggggcgttgaggtactcctcctgcgatatcttggacacgtcgacgccgctcggaaccgcgtcctcgtcgaacaccacgttgtgagggaagccggcgttgttcttgaacgtgatggtctcgccggacttgacggtgaagtcgttcggctcgaacaccagcacgccgccattggcgccgagaagcacctcctgcgccatggcgccgcccgcgagcatggcgctggcggccacggccactgcggccgcgccggctgccttgccgagcgaggcgcgcacgaccagcgaagatctcatcctcctccgcccgggagcggagggggccatggaagggatggtgacggcggcagaggaaagagcggccatggtagctagtgtattgtatttcttcttggtctgcgtctgcgtctgcgtctgcgtagtactcctatggttcagcagcagcggcgccggtgtagtggttgctataaaccaatccaatgatctgagctcgggttgggattgagaggttgggtggccagcgtcgtcgcgcgccatcttatcgacctcgtggccgcagcccattggctcacccggattaggtgggcccacccccacactgccctagcttagcttcccccatcgattcgtgatgcccacccagctcagcagctgctttctgggccggaatgaaaacgtgggccttttcttctcgctcaaatccacccatctttcctattagaagagtaaaaaaggaaaaagtacacctaaggtccctcaacttgttatcgggatacgaaaacgtcctcgaaccgcaaaaccagatatatgggtcccttaactatacaaaaccagtcactcgaggtccttcggtgattttgactatggttttagtctacgtggcggctgagtcagcgtgggacccacgtgggccccacatgtcaggatgccacgtcagtcggcctctcccccccctcttctcttcctcggttcctcctctctctctctgccaattgagcgcgagcggcgaggcttgcaggcgagcagatggttgaggactcggcgagctcgaaccggtgcacgacgtggaaggggtccgggtgaccgacgagggcacggccaacggctacgacaccgacagcccgccggcagagaggagatcggcgaccagcgccgccgccgctcgcttcctccacaagccggccaccaccgcgccgtggacggcagccatcgtcgacctcgccgcccttatggccctccacgccgacgcacaaagggctcgccacggaggatgagcggcgtggagctccaaacgcgtcgccagcggaaggcgagtgcggcggtgcgagtcccgtccttgacggggatgcgggcgacgaggaggtcgtcggggaacgtgctaacgcggtcctcgccgtcgtagccctcggcggcggaaattgtggcgccgttgccggaggcgggatggctgggaaccaccggaggcggccttggacgttgcgaggaccacgtcgagcccctcgtgcgccggcttgtagggacctatgtgtggcgaggtcgacgttggccgccgcccacggcgcggtggtggccggcgcgtggaggaagcggggcggagcccgagccatcaggctcgcagtcgcggaggatggccagcgcgccggtcgacgggctcgagcgccggtcgacgggctcgagcaccggtctctagtggtgaggccctccagggtgggcgccggtcggtgatgacaacttccagtgcggtgtccaacagcgaagagcccctctgcctccacgctcgcccacgccgtcgcctttagcttccgattctgggtcggtgccggcctcccctcccgcgtcgcagctgccgtcgatgctgccgcctctctgtcaccgcactcgcccgccgacgccgcctcgccttgccgccgccctccccttctcccgtgtctctgccgccgcgtcaccgccgccgcatcgccggccagcctgcccagtccagagagaggagtgagagggagaagaaggaaaggagaggaagggagaggccggctgacgtggcatcatgacatgtgggcccacatgggtcccacgctgactcagccgccacgtagactaaaaccggggttaaaaccaccaaatgacctcgggtgaccggttttgtatagttaagggaccccatatatctggttttgctgttcgagaatgtttttgtatcccgatgacaagttgagggacctttggtgtactttttccgagtaaaaataacttcaatttacatagtttggctcgtatccttaaacacaataccaaatataaagcatttctcattttttaaaccaatgcaaacgaggttatggtttggatgattggttttggctgagtggtgcttacatgggtagtttgactagtcctcgtcccacatggcactagaagcaagattaaaaaaaataaaaatatgtgagctacatatgttagccaaataagaagataaaaaacagtgggacccacttcctccacctcagcctctctcatctctatctcctcgactcttccgggtcggcgtgcatccctccctttctcccctctccttcccaattgagggcaacgagcaacgggggaggagctacgcggtggcggtcgacaggaaagggcggccaacaaagagttcgacgacggttagccatggacgcgatggcgatgactccccgcttctcaatggccgacgatagtggtggcgagcctaggtcttatcctcaagcgacggtggcgcctctctttcttcccctcttttgcaggcttgggtcaccagcgatgctcctcaatgactcaattatcttgttacgtgagcagcgcgacgacggcgacgactgctcgtgatcttgcgccaatgacgagcagactggtgtgcctcgacggcgagctccctgtctctaagttgcatcgttgcctcctctcatctgactctagcaacaactacaacattgccaccgtagatatcaccgcagacctcgcccgccttcgctcgcacaactcctgcctcgccaccggcccgcccgtctgcccctgcaacgtcccatgcctcattgtatgcactgacaacccgctgctcgttgtcgccgcgctctcttggctcgacgacgacgtatgcactctctcgacgctcttcctgttcctccccgcacatgcccacctccatgctcatgaagctatgctaggacaacgaggatgcacgcaccgatgacccgccggtttacaccttcgtcagggataggaaagaagatgttcaactgatatgtggatcccacatgttttttattttttttaatgttttcttctgttgtcacatcagtgcgaactaggtccaaaactgcttcgtgatcttgttttcattggggatacgttatatctgataatgtagtttaaggacgtgattcaaacttgacgtcaaaattaagaacctaaggtgaacttatttctagtagagtagagttctccagttccccgttgcacgcagcatctttggttggcaaccttattcatgcgagcgagctcttgagaatggatggatcgacatgataaagacaatggaggaaaagatagatgcactagtgatataacaacaaccacactagcaataagcacatcatggctagctaatgaactcttgcaacttctttatatgaaccagttacctgcagtactttccaaagaacatatgtagtagtatatatgaggctcccaagcttaagctaagcgaccatttatttacattagtcaggtagtgtgattcagagatttccacacaccaaccaacaaaagcagagagccggccatcacaaagagagccggccactgccacccccaccctagtcgcacaacagagctagtccatttctgaatatgaggtgcatgctgctgttctcgtgtctccaacgaaggtacattattctcattgctatttctagactccactctcaacagcctctgctttagattagttccacggggctgattagcatgtaccaacatctcttctgcacgtgggaaattgaaggagatcagctacatcgtcagagagaaaaaaataactcagccacaacagccctgcaaacaacattggctccagtagtctgtttcacaaatgttccacacgatcccatcctctaaactataccgcataagagacgaagacctactgttcgtggacaaaatcccatactttcacattataagacgttttgggttttgaataggttcatgcataggtcgatgtatgtgttacatatatatgttcaaattcatatgaatagtagtgaatctagaagagcgatggagaggccaaaacatcctataatgtggaacggagggagtactatatattttttcaatatatagaaaactcaagttcttacacttagcattaatgacatctcaagccaatattgacctttttcaaattagctaattgtacttgagatctaggggcgaatgcatgtcatacccttgctagcttggtaaatacaccactaatatttattaacgatgactaccactttacactagcaagaaagaaaaagtccaggacccttcatgaggtatatgtaggaagatataaatttctttttgccaggtggaagatataaatttcaatgtctcaagttctaattacgaatttaacaaagattgcttaccatgaaaggagaagccttggagcttgtccataacttccactgaatgatccacttgaataggggtatcctctttgcactgaatatgcattggttctccatcctgatcaagaccattttaatcaaaactatactactatgagtaaatagacttacaataaactgtagtagtaccataatctgggaggctgcatcgtcattttcctcgctgtggttattagatgaacttccagtgttacaacatgatccagcttcatcttcactcctgacactttccttcttgttattagatgaattgcgagtgttacagcatgatccagcttcatattcactctgcaaatgtgaggatacaggttgagagactgatgccctctcaacagagcatacaaggcggatccttcttgcagcagttccttgttgtggatcaacgagatcttgagctgtcaagtgcttcattgaaggtgcctgttcctgaccttgttctttcaaggcatctgaaaatgtcatgccactcctgcccggttctacgatagtatcgaaccaatgctggggataaggggtccacaatccagcccaacagaaggctccactcttttgtgactccatgtgaggattgaatgcggagtgtagttgatcttggttgcacaagggggagccctcggctactccactgtagaccatgctgctactctgggctcttgcttcaagattagcatcacttgtttctgtttgtggtgcattgattgaagaagaacagcaagtagcatctgtgttgtctgcacgctttgtttagaacaggaaatagaagggaagaaaatgttctcatgagattagtcaaaatgtgtaagagtaaattctagaatattctaacctgaattagaagcatctgatatgaatcattcttcctccaactatccatgagtaatgtgttattgtttggattgttggacgacgcggtaggattagactctacgtttccagtggggtgcttatccattttggtgtaatttggactaaacaacaaactttgcaggtcctgctcagacaaggtactgccaaaatgcgctgaaagatcttgctcacccagattgccgacaaaagggtgatcgctgtaagggcgaattggagaggtgatattagggaatccattgtatctttgctcaggctctaggtctggaagttgagataacacgtccagaaaagcatcgtcctaagttttacacacacacaaaagaaaaaaaagaaaagaaatttattatcatataaatgccatggggaccagtaatgcaggagaattaataagaaactcacatgggctacagtttgctctttgtcatggacagatgtactagcatcttgtatttcagtcagttggctgaaaccagatgatggtaaggtctgatgatccttcattattgaggcgagggccggttggacagcaggtgtgccattttggggattgccttgagaagacgtggacaattgttggtccaaattggaggccggggtatgggtatcatcttgttcgtgcttgttaaacaggcgatacagaacgaagctaccctgacaaattaaagcaaatagacacatttgatttgctcagctatttatatttagagtatggagtagacagtatatatttggtcgtgcttacgtttttgcctgattggaagtgaggctcagtggtgcggtactcgtgcatgatccaggcggtgcggaggccccgcggagctctgccgcggtggaagacgagggtcttcttgatgccgatgagggggccggcggggcgggagcggatgaggcggtccttgccggtggccttccagtagccggcggcggtggagcggttggagcggtggccgccgggatacttgcggtcgcggggggcgaagaagaaccactcggggtcgtcggacttgataacggacatggccgggagatcccagggctcgcaggtggagaggtccacgtccgggatgaggaggaggtcagggtggctccgcccagcgatctttcccttcagatagtgcctcaccagctcctcgtccgtcggccggaaacggaaccccaccggcagaaccgccgcggcggcgaccgccggcgtcatctccactttcccttgtttcatcgccacttttcccttctccgacctctctgtctttcactttttttttgagaaccactttatattctttcaaaacaaaaaaagtgtttcacttttatcttgccatacctaacaaccaatgttttaagggcagggttaatttattcatgccattacaagtatgttatttcagataaatatcattataatttgtttattcgtaattgtgtcactgaaatttttacaaaattagaaacatatcattgccgtcacattttcatcttcttcatttataactttaactacgaatatacattaactagttacgtgttttcttttataacttgtggtaactggatttttaacttctatgtttgtggaatgatctatttgtaaagtgagtataattcaattggttaggttcttgtggtggaaccagcccacccgagtctaagtcctagactaattgtttaggctaattattatttcagtagtagacgatgtacctgtcgatagcaagacgtcgtttgtgcgtttgtactatgtttctaaaagtattaatctattatgttgatttttttttacaatcaattaaattccatgcaaataataagtagatatattttttgagtttagaatccacttccgaaaatatgtggaagcctagaaggtgtgggttgcatgcatactttcaagcctctgagataatgggccgttttggtttgataaacaaacatgccctaccaatttattggcaaatgtaatagtttttgtgttagtttggatcgtggccaaatatttggtagtgcatctttcctatttattatattttataagtttcttcaatgtactatgagaatttggttttatattggtagcaatccaaatgtttgctaaataattttactctaccaataatttggtagtgcctaagtttacctagactttggcattaccaataaattggtaggttaaagaaccaaacaagcccaacataaattttatatacttcaaaattttgaaagaaaaaaatatgtggttcttttttaacctttttcgtaaccattaagataaatacaaatcacgagaagatattatgaatttagataattatatgttcagatttatagcttaaaatatactgtactacttatatttcaatacggaggtactacttctgtaagttagagcatcttcaacagcctcagagcatctttaacagcctctccattccactcttcaagccaaattttagccattttagcctaaaaaggtgctccaacagcctctccaactggatagctaagccatcctgctggccaaaacccctcctccactagccaaatttggccagccagaaatcactggccaaccgtgggccccacatagatccccccctccttcggctcggatggcgcaggcggccaagacctcgccgccgccgccaatgcaggcgccgtgcaccgccgcaagcaccaacttctgtaacaccctgaaaattcgaccaacaaaatcagaactctaaaattacggaccctcaaaaactttttaaatgaattgcatcatgacggttttattcgcctattttatttggatttgatttcggagtttgttgatcgcgaataaagaataattaattaggtataaaccctaaaaattaaactggcaaaataaataattaaaatataatttaaaacaaagattaggtgaggttggtaataaataaaaatattatcgcgaccatattagtatcaaataaattcaagtgcgatggaataagaattaactctaattaaattcaagaaagttatatataaaaataaaatatgggttaaattagggttaaatagagctagcactgttcattgcactctaggtgctcgacgaggttccctagccccgcccctccctgccgcgtgcgccgcgtcgcccgcccgtcgcgagccgctgccgcctgtcgcgcgtcgccgtcgccatcgccgcctaccgccgcgcgccgtcgccccgcgtctcgagccccgcgccaccgcgtcgccgtcccgtcgcctcgcgccgcgcgctcgccgcctcgcgccccgtgccgcgcgccgtcgccatcactgtcgccgtcaccgtagcgtcaccgtcgccgcttcgagtcccgtgccgccgctgccgtgccgcatcaccgctcccgctgccgcgccgcgcgcgtcgccgtcgtctcgagccccgctccgccgtcgccgtcgcgtcgcccgtcccgccgtcgcatcacccgtcccgtcgccgcgcgccgtcgccgtcgcccgtctcgagccccgcgccgccgcgtcgccgtcccatcgccgcgcgccgtcaccgtcgccgatgccccgcgccgtcgtcgtcgccacgtcgagccccacgccacccgtcgcgtcgcccgtcttgagccccgccccgccgcccgtcgcgtcgccgcccgtcgcgtcgccgccccgagccccacgctgccgttgcgtcgccgcccgtgcgccgccgtcgcgtcgccattaagccgccgcccctccccctctccttctctccctcttccctataaataccccaccccctctctatttccccccactccatttccctcctcctcccctcttccctctccaccgcgccgccgctctcgtgccactgcaccgccaccctcgtgccgccgcgccgcgccgtgtgccgctccgagcgtcgcctcgccttgcgccgccgtcgccgccgccgccgtcggtaagccgccgcccctcccctcgtccgccgccgtcgccgccccgggtagcatgagccgagagagagaggaagggagaagccgggagggagaagaaagagaaaagaaagaaaaggagggaggaaaaaggaaagaaagaaagaggagagaaaagaaagaagaggaaaagaaaagaaagaaaaggagggagaaaaggaaaagaaagaaaagaggagagaaaaagaaaaggaaaaataaatagaaattagagggagattaaggaagcttagaaaatttaaaataattagaatttaattataggttgattatagtcatagaattgtaaaatttaatataattatagattattttggtaatctctataagtaactcactcgcggtagataatcggatttagttactaagaattgtattcttcgttgaatgttaatagagacacttctaaatcacaaaatgacttaggattaaatgaccttaaaattggaatagcgtggtttttgcaaactttgtagtcaatatagaaagatcgattcgcgctcgacttttatttgagtttatttggattttatttgaattctaattgagttcaaatcatttcttcgcacgtaattttagagcccgagggagttgcggatccgagcgagggtcaagacccgcaggactacgagcgaggcaagtcatcactattccttgaacatgttgatcccaattgcgaaattgttttgtttacaaataaaattgcatgcaatgataaacatcctacttgtgattatgccatgccttgattattgtttaccccttattccttcgtaaccatgtttacgtatgagtccctagtcaactatgacaattgcttagaaatgctattctagaatcatgcatactcatatttatcaaaatgctttatacttgggaaattacctttgggaaggtaattgagatgcggcatgtggagacatgagcgccacattgccatgatattgatgacatgatttgtgaaaggagaaataaaactaaacaactgttttcgactggggcggacggaggatttgggtggtatctgaaaaaggctagtaccgtccccggtcaattaaggaccgagccatgaagttaagaatgaaacgacccccgtacaaccgcacttctcgtatgggtatagacctagcggagtagatagccgagcggaggcagtatccctgcatagatggttcacccctgagtgaggcaggtgcgctacggtgggacagccgttgaggtagggtcgagaggcgtgccctacatcagtgtcgccattggtaggactgccatgagtgtgtgagagagagaacttaacttgaactataatttaatatgtgtgtgagacttctctttcccgggagcgccagaactcctctcactgctagaaacatggacacctagagtgcatgaggatttaagttcatggagcgggtactgccaatgcgaggttatcaaaaagctttgtcgtgacgcgtctcatgtgttgggacgaggctcatgtgttgggtagtcgcggagtgcgggtaaagtgtacatccactgcagtgtgagtaaagcaaatctattcgaatagccgtgctcgcggttattgagcaccgggacgtgtattacacttggctagactctaaactcttaacttgtgtgggatgggatattgcatgatgacttttatgctggtggagccacttcctgagaggagggaaggtggacgtcctcagaaaatcatgacgactcaatggcgggaagccatccttgggatcacattggatgctggacagaaccgccgttgtttaatgtgaacactggtactaaaatttgatcagtctatgctaggttttaggcttgtgaaaagaattacaaaacttgctttacgcaaatgaaccatagccacaccttgaatactctctatcatgtgcattgttgctgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcaagtggcaatggcgtgccgctgccttatctacttctgcttttggaatgtattccggaccgctcggtccgatgatctaagactatgcctgcgggcttatgatgtaataattcgcactagactctcgtgtatgtgcatttggtatttcagctaagaactcatgtgtaccagactacttgatccagggaaatggtactgtttacacgattgattcctgttataaaaacgggagtccacaacttctgtgcgccgcttgcatctccaggatggtacggcgaagctcctcgaccgcgggcactgggccgctgccgccggcgaggagggggccgtggcggggttgttggggagccggcggcggagagcacgacgacgagcatcttgaacctacgccagagcgccaccatcgttgtcgaggtcgccagccgctgtcgtcgtcgtgtgcaccgtcgccagtcgtccccgaggttgccgttgctgtcatctggatccagcggcggccgacctccgttgcctccgtccccaccagtggcgacatggattcgggcggcgcggcgtggattcgtgcggcctccgccgccttgccgtcgccgccttgccattcgccgtcgccaccatccccatccactgtggtagccatcgtcgtttccatttgtcagtgttgaggaagaggaggggggagaaaatctagaggaagaggggaaaaaagattaaggagtgataatagaggctgacatataggtcccaatgttataggttcggaatagagattttagatggagaggctgttggagtccacaatgagtttgactgaccaaatcaattggctaactagctatatgggtatttgaagagtctattttaggtagtccgttggagatgctattagatagtgacaaatgttgatggtagtatcaatgaaggagaagcagacacgcatccatttctgactcagaggacgttcattttctgtgacacctgtcaggcaattaattacacaatcgtgcggtcggtacaggcctcacaagtctcgagccaaacacacacactatcaagtgctcggtatgtactggtaaagaagagcccacacgtgacatactacatgtaaataattttaccttttatcttcatttttcttctttcaaaattttgaattacatataattggtgtaagctccaaggcttgaaagtaggcatgcaatccaggcttccacagatttcggaagtgaattctaaacttgtttgtattttgagatgatacaaacttgtttgtatttctatttcctcttctcaatttctctaaacttgttctacgtatcttttcaatcttctcttttcaactcaaccatttttacttagtctattaataaaaaaattaaacatgtaaattgatgttgctagatttatcattaaccaaactatcataatatgcaactcttttatttaaaacatcttagttttatgaatattattgatcaaaatagcattttaaaaactatatcaaagtctaaaaatacttctattttaggatgaacggagtatttggacttatactatggcactacgtagcgaaagtgacggggggccgggggtgtgaattctggccgcacattgtacctacccaaaaagtacttgctgtattgaatcaacgacgatgtcgtcgttaatgcatcatcttaattgactgtagtagtactagtacgtaatgccattgcacgggaccatcttatctctttttttttctttaattatttgacacaatgcgattgaattggggtgcaggagtatatatataatagtagtggtaggtaacatgaacggtgtagattgagagaggagacgtactggtgctaataacaagaagtactcctacataaagagagagagagctagctaagggagtaccgaccgaaaaagcagaaacagcctgcctgaccccaaaaaaatggaggaaggcgtcgtcggtgggggcggcgctgccgttcttgttgccttgctcgtgaccgtggtgttggcggtgatgaggtcagctggaagcagaagcagcaagcgcggtcggctgcccccgagtcccatggcgctgcccatcatcggccacctccacctcatccggccgccaccccaccgcgccttcgaccgcatcctcgcccgccacgggcccctcgtctacctccgcctcgggccctccacgcactgcgtcgtgatcggctcggccgacgtggcgcgcgacttcctcaagttcgaggccagcatcccagagcggccgcccacggcggtgacgcgacagctggcgtacggcaaggccgggttcgcgttcgcgccctacggggcctactggcggttcgtgaagcggctgtgcatgtctgagctgctgggcccgcgcaccgtggagctgctccgccccgtccgtgccgcggagctggcggacgtgctgcgcgcggcgcagtcggcggcggagaggggcgagggcgtcgacatgagccacgagctggtccgcatggcgaacaacagcatcatgaggatggtggcgagcgctctgcctggcgagatggcggaggcggcgagggactgcgccaagcaggtggcggagctggtgggggcgttcaacgcggaggacttcgtggcggtgtgccggggctgggacctgcaggggatcgggcggaggaccaacgaggtgcacgccaggttcgacgcgctgctggagaccatcatcgaggccaaggaggaggcgcggaggcggagcctaaggctgggccggcgggagagtagcagcaaggacctgctggacatgctcatggacgcggcggaggacgacaccgcggaggtcaagctcaccagggacaacatcaaggccttcgtcctcgtcagtacactatatatcttcaaatactcctcctatatatatatatatatatatatatatatatatatatatatatatagatattcctccagctccagtgctccagtagaaaagaatgttaattatatatatatatatataatgcaggacatcttcaccgccgggtcggacacgacggccaccaccgtggagtggatgctggcggagctggttaaccacccggagtgcatggcgaagctgcggggcgagctggacgcggtggtgggcaggtcgcgtctggtgggagagcaggacgtggccaggctgccctacctgcaggcggtgctcaaggagacgttgcgcctccgcccccccgcggtgtttgcgcagcgcgtcactgtggagcccgtccaggtgcgcggctacaccatccccaccgacacccaggtcttcttcaacatcttctccattggccgcgacgccacctactgggaccaaccgctccacttccgccccgaccgcttccttcccgacggcgccggcgccaccgtcgaccccaagggccagcacccgcagctcatgcccttcgggagcggccgccgcgcctgccccggtatgggcctcgccatgcaggccgtcccggcgttcctggccgcgcttgtgcagtgctttgactgggcgccgccgccgtcgcagccgctgccgcttgacatggaggaggcggcggggctcgtgtccgcccgcaagcacccgctcctcctcctcccaacgccgcgcatccaaccgctcccttccttctactcctgagcatcctcgatcgtcgatacgtacacctgcgagcctgcgatcctgatccatccatttgtttttgttgacttgttactagcacctgctttgttttacgtacctcacatcaaataattcttattcaactcaaaattaagctacaagtaagctatctcattttgagtcaatgagtagaacaaaatatcatgggcaggggctcgaccttgtttggtcctactcatggccaccctgctcatatctacttggcttttagcaacccttatccttggagaagaaaattaaagagaggaggtgcaatgtaaaacaatttataaataaaactagaccaaagtgaaaaggtttggttcaaattgcatctaggtaaaaagatgtgacaatacacttggaccaaagtgaaaaggtttggtccaaattattacaattacaacatactaggtaaaaaaaacgtcctagctggttatttaactgcattgagagcatgtcagtcctaatgtttctatggaggaattggcatgtgcgaaatgaaatcatgcatggtaaagcagccccaccaatagaagtctcagggcccctttgaatcgcagggttgaaaaaatggagggataggaaaaacacaggattctgataggaattgaagtgtaaaacagaggattgcaaaacacaggaaaaacatagggaatggtcgtttgattggagcgcaggaaaaactaggaatctgatgagagagatagactcaaaggaaattttccaagaggttgaagctcttactaaatttcctccaaaatccacatgcaatgtatcattccataggaatttcgtaggatttggaaagcttcaatccattgaatcaaatggccaaataggaagatttcctataagatttgaatcctatgaaattcatataaaaatcctttgattcaaaggggccctcaaagaggttcattgtaagttatgttgatgcactgttccagatccgacaaaatcctggtgcagacctgtcaaaaggaaaatgtattgcaagtgctacaaagggtactgtagtcacttcggctttcaggattattcagccaagttgggaaagacatgtactgggatggatgaaacttaacatcgatggttcctttgattgcagcattggggggggggggggggtggtatcggtgcaatcctccgggatagcacggggaaaacaatttttgcgtcatgcaaaccacttgagcgctgtaatggggcgctagaatctgaacttcgtgcatgtgtgatggggctgactgcggcgattcaaaggacgcttcttccgattcttgttgaaacgggctgtatctcggtggttcaacacctgtactgcagagagaaggaccgtttagagttggcctgcatttaggggtgaaaacggagcggataatatccgatccgctccgccccgaatccgtccgaaatgaggatatggtatgggcttttagaaatccggcggatatggatgcggatgcggattatccgataggattttttcggataatccgaaattatcaacacatgtaaccactctatctattgcatataacataagttggttcatccaatggcctaattcatcaatgaacctagattttttagtctgaggctttcaccgtcttatgtcactcttgcgtagctgtatttttacattatggacattatgtattcatgttgtttagcacttaagcctataattattacgatgggtcgtttattgattattgtattatagttccttgcattgctaactcgatgttgtattgattgcatacacacatagcatccgataaatttattccgtttccgaaccgactccgcaccatttccgacatccgaaacaatccgctccgcatccgtacactatccacacccactccgaatccgtttaaaaaatatggtttaggatatgctatgaccgctatccgtccaaatccgctccgttttcactcctatctgcattgttcaggaggctaaggaccttcttctgagagatagggaggttgttatcaggaaagttagccgtagttagaatgccgttagtcatttcttagcaaacaaggctagggtggagttttgcactggtttttggttggaaggaaattgcaatcagatatcacagctagtctgtgagaacttctccaataagcaataaattttcttccccgcaaaagaaaaaagtgattctatgtcaaatttgtatatatgtaccaaaggaaaaaaataatcgacgcctgagagattcgaactctcgcggggaaaccccatgtacttagcaggcacacgccttaaccactcggccaaagcgtcggtgatgtgtaaggatacgatagaatacattttgaaataagattttactttcagtcgagtgcaagaagaggaaagcaagacgcgtcaaatctatcaatcagcttcagccaaagccgagagcccccccaaaagagagagaagcacgcatccgatcgccggcgacgaccgaatctgtgccgggcggcaggaaggagagcggcgatggcagcgatggcatccctgtaccggcgtgtccttccttcgccgccggctgtggagttcgcgtcggaggaggggaagcggctgttctcggaggccctggagagcgggaccttgcaaggcttcttcaacctcatctccgtgttccagacgcagtcggagccggccttctgcggcctcgcctccctctccgtcgtcctcaacgccctcgccatcgacccgggccgccaatggaagggcccctggaggtggttcgacgagtccatgcttgactgctgcgagcccctcgacaaggtgaaggcggagggcatcaccttcgccaaactcgcctgcctcgcgcactgcgccggtgccaatgtccgctccttccgcgccgaccagtccaccatccacgacttccgccaccatctcgtccgctctgcctcctcccaggactgccatctcatcgcatcctaccacaggaagcctttcaaacaggttgtttttgttaatccttctcttcttcatttcaaggtcttaataaccaaccaatttatcattgcattgcatttcagactggaaccggccatttctctccaatcggcggctaccatgccggccaagacatggcgcttatcctggatgtcgcccgcttcaaataccctcctcactgggttccactcccactgctttgggaagccatgaatacaactgatgacgcaactggtctactcagggggtctcttctctacccatcttcctcctctcctatctttcatactagaatgtactgcctcccttctcaaattgcacatgtctcacgccattactgtttttaactatacatcttttaaaaattataaccatatcatttttttcatgattaatctaccaatatcagcttcgcatataaagtcctattactgtttttagtaataatttaagattttgaggtcgtcatccttttaggaacagaggtagtagcttgagaattctcagcttctacctactactccctccgttccatattataagacgttttggcatctctcgtctagattcactaacattcatttgaatttagacacatatatgaagcacatatatagattcaggcatgaacctattcaaaaccctgtacgtcttataatgtgaaatagagtaagtagttcaatttctgaataatggagctactgattctctgatgagaatctgcactgttgggagctggagattctttgagctgccccaaacagggcctttggtttgttagcaacgattactcttgatgaagcaactggggcactgttatatcttattcaatcctttgtgcaattaaactcccatttctttaagaaagcctccttactgatggtacatttatgttttctttgctgcagtaattgttgtggttcgcaagtagttgtagggcctgttacttccttttttgggcagccatctaattgcagggagcattagttatgatctcttcagtttgattgcccagtttttctttctaattggcagagattgcttaaatctgatggggtgtcctttttttgggtggtttagcgcttaggtttagatgaatatacatgttacatcacttgcatttggtattgtggaaaatagcaacttgtagcattgaacttaaacatcacactaggtgtatcttccacgtgttgctgtggagatgacagtgcttttctaataaaactgcgtggaataatataattgctataggagggttaagtagaatatactttagaagctgtggcctgtgggaagaataacaaatttgctgttgttatatgacggaaaagtctatttggtttctcaacttgtcgtgtgatttgcctttgcgtctcgactctaatacctgatattacttgtccatcatatcaaaacgatgcaaatactgtccctatgcttgttttgcaagtgtttttttagtgaggtggcttcccacatcatcactttttttgccatgatatctgcctatcaattagacactcatgttagtcatgcctcttccgttataatagaaaaacaaatattaagaaaagagatgaaaatcatatgcatacatggataatccgaatggccccatcatgttccttattttttgctgacttattttccatgtacgcagtccagtaggatgccacatatgacaaaaccaccaatatacctaccagggacatcatttgcatggttttgatagttgagggatgagttttatctggtgctggatttgaggagtggaaattaaaccacattaagaattgagggtccaaatatgtaccttttccttatttattgggatacatggaattcttgtactgcacagtgactgcactgatatagacatgcacactaaagtactcacttcaatctgcacccatccactcgaagacgcagaccatattttcatccactgcccctttgcttcggccttctggaatctgatacaagtctctccaaaccgcacatcaattgcatccgtatacatcaggtcaccccctccggataactcccaaaccgtctccaaggcaccttcctgttactctgcttctggagattttggcttcacaggaatgaaatcatcttcaactacctgcctccctcagttcatcgtctacttcgtgcctgcatagaggatgcagggctctggactcagcggcttagacagatcaaccttcctattgccgccacctggaaatccctttttttcgggtgctctgcagttactgtatattgtgtttaaaactttgtacagtgttttcccttaaaaaaaaaaactataagcagctaaatgatacagctagcccacttgctgcttgaatgatgatgtggagaggtaggcttggcaaagttgccttgtaaacacaaattaattttcactgtaattatttgaaattataagtttagaacgtatgatgtaattatttgaaaccgttgcaagttgcaacacacaggtattaagctagtcaaaagaataatatacaattttaaaatagtcagcatataaaagtaagcatggtacaaaaatatgcaaatgctgttatttgatcttatcttataagtttacttaaaagagcaacttttagttcctgtgaaatgttcctaagaaaatcaaaagggcagatacatgtttctttgctgaactcatactgtgtaaaaaaacatcgacaatcacattgatatctgatattgtttatttattgctgatagcataagtgtattctgattaagatatttatattatttatagctgtagatatcatttagatccatcacagtaataatataaggactttaagttagtttttcttgccaaactaaaggatttatatgctgtgaaataaagtaaactacaaactacatattaaaacccatctaaaagaaaaacaacataatacctttaacatctcgtgggcagcaagcattgactcatttcatcagcaaatattttatacctgatctattgcatttccacttcagtagctcatctctcctttgttttgctattactttcagaatgtcctgaccaaatacatttcatgaacacaactaaaacaacatatctgtaaaaaaacagtacagaattgaaggaaataataggaaaatgagaattgaaaagtgcgaagaaaagcaatatgcaaggaaaaacaggattgttgtgattcactggactcaccagatgaaagagcatatgccattcattggtagacagagttagagggttggagaaacaatgttaggaagttttgcttgctccagtttcctcctccgtatctatccagttattcagactcaagtgcatgttggcattttgggagatccagacagcaataaaaacttgactttatggctttattgttattgggatcaggaacttccgaacttggcaatttagcttggtcacatgactcacatctaacaccatttcttccgcatccaacctccatactgtcaactccatacctgtttatgaggagacaacaactgtgaactgtctccgcggttcttcctttgtgcagcatatttttttgttcatttgtttcatccccatacatcaaatggttgtttacatcacagtgatccaatggttggtaaattatgattactagaaaagatgcccgtgcgttgcaacgggtggatgctatttcaatcttattattattatacggtttagctagggtgaaattcactgtgggagtccgatatttatctcaagttagtatgcaagtttttttttacaaaatttcttatacgactcttttcgtattttcgaaagcaaacgaacttaaaatccgactcaaacacggatatgtattccaaaagcaaacgaacttaaaaccgactcaaacacggatggcgtaccaaaataccggcaaaaacatcttcaatttttataatagtagagatgtggataccatgatatttacctttgctgcaaaacattataggggagaaattacatttgcgttatttcctatagatacaaaattgagtatcatttcagttttacactcaattgccaaactatctgtacttgtctttgcctttttattcatgccagtttaagatactgccatcttgatatttgaaggttcatgcttatctcaaggcacactgcagctccttcattgctctacacagtggtaaacatgccaatgcttggtatatcgaattcaagtgggtacattgatataatttcctttatatcattcctttagcttttgtgcagagttgcagagatgaaagctggaaaagcatggcgaagtattgcatggaagatgtacccgatcttcttaaggatgagagtgtagacaatgttccagcacttctgtcccgcttagtgaaatcccttcctgccaatgctggaaatttgatcaaatgggttattgaagttaggagacaagaggaaggaggatcaggattaagcaaagaggaggaagaaaggcttattttgaaggtcatcttcaaccttttcttttcaatctgggattctggatcagaattttctttttgtctcttttaacacaccttacactgtgtgcacttgcaggaaatgatactacagcaagtccgtgatactgagctttttagattagtccgtgaactgcaattcactaagcagccatgttgtagttgctcatattcaagtgatgatgattcctttacccggattgcagcctctgtgtgctgtcaaggggccgcattgctaacagggaatctttcatcaaaagatgggttctgctgcagagaaacttgcttcaaatgtgtacaagtggatggtgatgggcctaagactgtcgttacaggcacagcggtttcaggagtcaatgaacaaagtgttgatatgcttctaccgatatccacattggaaacaagcgtgtgcaattcaaattcaagcaacgaggttgtcaaatatccatctagaacagatattttaactgttctattgctggctttacatcctagcacatgggtgggcattaaagacgagaggctgaaagctgaattccagagtcttatttcaacagacattcttcatgatgatcttaaacgagaggtttgttgtattaatccaaacatcccttgctccctactccctagcaagatttgttttctagataaaataggatgtaaatcatgcctagttttgtgccaaacagatctactttaaaggaaccttgtcagacgaaattatcgtttccaccttccaccacaagataaaataagatgtaaatcacgtctagttttgtgccaaaagatcagttgtatagggcctactttaaaggaacttgactagacgaaattatcgtttccaccttccaccacaagacagaatagttaacccaatgtttaggggagacgagagtagtagtcactgatgagcataataaaagagaaaaggaggaaaaggaagcatatgctttacatacattaatgaagttaagtttatgagtattccttgaagaggtcatggggctctgcgatactaaagtttttacttctgagtacctttttgaatagaataacgttaacatataaatccaacatctagcaaaatgatctgggcgccgcattttattgcacatgtgtgaattgtaccttcacatgcaaaactgaaacaaacatttttctggagatgatattgaaacctttttcttttacttcagttaaggaagtatcgaatagaatgctgtttccaatcagatttgtccatgtttccctttttttctcccttgtggatgagcattcataccatgccggagttaaattcatatttccatgaaggaagataaattgttcatccacttctcttttcatcaaattatagatgtcaaaaacatttgttgcactagtttagaataacattttgtctgttgacacagatattgcatctaagacggcaactccattatgtgaggtcctgtaaagaggaggaatatggagatcctgtgccacaatcccattaacaatgatgcaaatcgcgcagttggttaccctggagatgcaaaaaaaaggggttagaggaggaactacatactccgtattacctttgtttcgagtgaggacttctcatttttgagacacctgacctgagacggatccgtgtagacatgttcatgttcatcacctgtggtcgtttctcttgttagtgacaactgacaactagcggggaggcacacgctaattgtgcggctggtgtccttgcaaaagtttctcataataacgcaatggcagatatattttcacactttattattaaataaaaatattgaaaagggcaattaaggagtaggataaactctaagagcaagtatgatacttcttccgttcctttatatttggcaccaagcatggtttatatttagacctggatcattcatcttctcttcaaaagttttctaaatgctcaaatagatgtcagattatcaaaatgtattacatattaagtactaaactttcatttatcataatctaatcaactcaaaattattagtggttaaagttgcaatagtatgagtcaacggtgacaaataaaaaggaggaaggctctaagcgctagtcccaagataggcttagattagataaagatgtggaggagaaaatagagaagttatcctgtacacaaacaaatttgaggaaatagagacaatgcgtgtattgctcattttgactagtgttaaacttgggatcagtgataagaaacataagttcacatatacaactaatttttttgagttttcgtcaaagcggtcacctagcagcacccatcaaatgcagcccagtctacctagtaccaatctgtatgactcatctttcttactttttcttcttcacaccacagtcgacagtatgacacgacaggacacacatatgcttttgtcttccttcttcccctccaactccaatgatccactccacccctcttccaaaaccctaacggcctaacccctcgatccaccacgcaacgcaggcaacttccctcgctcggtgagcaacggcctaacccctcgatccaccacgcaacgcaggcaacttccctcgctcggtgagcaatccttgttgtgttgtttatattatggattttctgtttgatgcataatttaaatgcgggggtcctaaccctaatattagggtttagggtttagggttcgataaactgtatgtgcagagcatgcttctgaacggcgtccgacagctaactgcatatgttgtccaccagcacgtcggatgttgcattggtttctggactccgagacctttgaaccagcattaatggtgacggtgtaatcggggtcggggaactgttccctggtgcattaatggtggggaactgtttcctggtgcattaatggtgacggtgtaatcggggtcgggaactgttccctggtgacaaatca

SEQ ID NO: 64420 - DNA, 659 bp, Oryza sativa
ctcgatctgcactgcaatatgcaaaattaactccaacgattagccgcagcagcagcatgacgatcgaattgatcatgcaataatgcagtttccttcatgtcgacgcagcggctgaccaacctcatcatcatcagatatatgtatgcactgctccaatcgatatataccaataatctcatctcgatctgcagccaacaatatatcacgacagcaatgtgagagaccgacgacgcttgctgctgaagcatcggcgtgtcgtgcatcggtatgctgcgccggcaggccggccggccacctgcgcaagctctcctcggcatccgtgccggcgccattaatgcctcccgcccatgcgcctcgtagtcaggcgcagctagggttttactagagggacctgtcagtgatgctgtcttgagaacaaagcaacatgccattgccatgctatagcttagctccatctatatatatcttcgtctggatcgatgcaactattagctatatgcaagaggatgctatatggctaattgtaaacgagagagagtgatcttcacttctcctgctttgtgttgatgagtgacgattggtgtgcgagattttatctgatgccgacagatcgagtagctggagatgagtaaccacttgtagacaagacaatgttccct

SEQ ID NO: 64421 - DNA, 7418 bp, Oryza sativa
cagttgggacggtccttacccaattttatgagagcaccaatacatgcctcagacagttggtgattagtcccaggaacaaaactaacaagaagatcaacaacttcactagtggcagcaatctctgcattgtactcctcatccagtagcctatttagagcacgaactgcaggttcaacaacaaaagtagagcctgacgtcattaatgatatcaggggttgaaggcattcagaggcaatgggtgatgcccttatagtagaattctcaaaaagaatatagcagagctgagcggcatcattcttaagctccaatgacgaactgaaggataaaattttgtagaggctttcaagtgtagtgccttctacatcaaacaaagctgaagcctttgagatattcccagaagaaagtttgattagagcaccaagtgctgcctgctgttctgtttcagttcctgactcaagcatatcaagtaatggcggaatagcttgccaagccacttcagtgtctcttatattctctgaatcaaagaggttctgtaacgtccttgctgcattaagcctagaatttcttgagcccagacgtaagacagctaccaattgatttgaagtgctaattgaggattcatggtaaagaagatcagggtttgtgtataggatccgcagtagattgattatagtagtttcagttgagtcttgaggacttaaagatagatactttgttaaagcatccaagactccagcctctgccatagctactttatttgtctcactgccttccgctagttgagtcagaaggtgcaaagcaaccagaggtgcgccttgtctgtctggcattggtttaagtagatccacaagcaacggaatggaccttcgagcagtagcactcgtacggacatcttcaagctcaaaaaggcttctcaatattattttacttgggttatctgccaacttgaattcttcagccatagcaacaaggtttggcatagtagattcgatctgtccaatcatagctatagtacccataactgcaccagaatttgcaatagcaagctgtatacttctgcttccagtggaaacaaggctagccagtgactgagcagcaaagtatttgtcaatgatcttgtctgattttagcaacgaagctaaagaaggtattgttcgcattattgctggagattgaacaagcattgaatcctgaaataaagtagccaaaagaagggcgcaagtccatacactctctgagtcttcatattggtcctgtaacatggaatcattgagggccaggaatttgccatatgagacaaaacagtataatttggtaacataaacataatataattaaggaataagtaaagctatcatatctctggtgtctagaacgactaaatatacaaggactatcatgtttctggacaaaatgctcagaatcagctgattatatgtagatagctaatcaggatcttttttttcagaaacagctaattaggatcttgaccgtacaagtaaatattgaattctatttggatatattttatcttttatacagcttaggcgcttcaaagtaacaaggtaaaatggtgaaatcagggggaaatggcatgatgtatccctaatctctcaactcaaataatatagcagttccaaacagtaagcaataagcatcttgaatttaagccaactgattgcagttaaatgatatatagaaatagtatagcgagtataggcacagagaaaattagaaaggaaaggcaaaacatatgcacctgttgattagtggtgtagctagcaagtttatcagatatagtctcaacaccaccgaggtccataacagtaagtttactactcaaatgagaagaacaaataagtgagagcaaccaaagcgcaactgtttcttccaagacctttcctgatccagacacacccagaacatccttatcatagttatacaaactgttttcggggtatggtttccaaacttcaatatctagggatgttggggcagaatcttgcttcatcatatcaatggatgcagatattagattcttcagatgccctgatgcttcaataacatcaattgagtgttccctgctgtgtctcattgcagatatgagggtgatggcactgccaattcttatttccatgtttgttgattcaataactctactagcaagggaagcaatgcatccttgacttctgttcaaatgctcaccaagtagagaaggttggtcctgacataaacttgcaagaatttgaatggccttatcttgaatcggtggaagcccaacactgatacagcgcactaaaggctctaagctttctggaacatcaagaaaggcagaccacaagggagaactaaagtgcgcgccctccttggtcctagccatccatgcaagtacattcaagggatccaaattagtagcattttctaaattgatgccagatagacacaccagcagtgcatgaattataaaatagcactgcgagtaatctggaataacttcattgagggggaactggttgagcaactgacagagcgaccgtgaagcactaatctttccttccaagctcccttccttaagtactctagtcaaagccaggacgatgttgccgtctagtgcttccttggcaatatgtgcatctgataggaaatttgccaatgcagcaattgttgtttcagcagcatcaatggatggtgactttgacatctctataagagtttgcacatagccttcagctatgcatgacatcttgttcttcaacatggcattagccgagtgggagagtgctcctaaagctcgagcagattgtgttgcaataacttggttcccacttgtcaaaagcttcatgcatggctgaataatttcatcagttcctaagatatcacaaatatcctgacgggtactgaaaatatcagccaccacagttgcagcttgttcctgagtttcctcatttgatgactcaagaatatcaataagagatctgagccctttattggctggagctccattctgcactagatctctctgggaagccatcacaagtacatgcccaagaactgtaatggcatgggcctttgtactaagagagtcactaagcagcagtgctcgtaactgattaattgtggaggaatcagcagaccgtataatcttcttgagtgctttagctgatgcctcttgtccatgagggctaccactctttagaagccaaagcaatgcaagaactgccccagcactctcgacacatgcactgatatcatcactgtgacaacacaagttccacaagatatgagcagcatcttcttttgctttttgagatcctgtctccagtagctggacaagtggaggaatacctccagcagcggttattgcccatttactgtcatctacttcatcactcaatatagccaacaatgaaacagcatactcctgatgctgctcactagaaagcccaagaaatgatatcagcaattgagttccttctctctttcctagagcatcccatattccaataccatcagagcacaagctcgttaaagcatgaacaagatttttctgcacatcagcagaagccatagtgatcagcccaacaaggaccttctttgcattcgagtgattaagcctaccagacagacatgcatttccatatagactggctaaagcctcaagaatacgatcaagcacaagattactatcataggacttcaggagcacaatcaaaatattttctatctcaatcggatcaaaagatttaccatcagtgccactaaataccatcaatgtatatgcaagtgcaccaagaatgtcagcgaggggaacaggtggactgggcacctggcagagctctccaagataaagcaacagagatactgttccaccacagatatttgataaagcatgaacagcatgactttgtagagaatgacaagtatccccacgcatgcactcttttgaaggagctacaactgctccaatgagaacaggaatgccaccagcatctaccacagccttctttgcaatactagacttggaagatagagcctccaaagcatcggccgcactttcacgaactgaaatgtcattgtctcgatttaggaggcgaagaagagccttaacagccccggcatcaataattttggggatgctatcaccaaaggcagataccaaccgtgctaaaagggaggcagcatttgactgtgaagtagtattcttagatgaaataagaccagttataatttctactccaccagcttcaagattggccctccaataaccatctttgtctccacagagattccttaaggcaccagtgacaaaaccctcaactactttatcttggtgtgacttaggtttgagcatgtcccagagggttggcacaacaccttctgtcacaaatattttcatacctatatgatcatctgaaagtccaccagaagacacttcaaaaatagcttcagcagccgccttctttgcttcagtagattcagacttcaaaagagagagcaagggtggtatgcaacctcctaacaggaccttgacacgcaggtcctcttccttgcagagtgcgctaagtagtgctgcagcatttacttttgctatagatgtcccacttctaaggatagatataaatagtggaatcgcctgagaatggctacctatcaaaacccttgcttcctttttttctttggccagttcaagcaatcttttagtcgtcacttctttctctggtagagatgtcatgctagtatggagttgctccaacaattgagcaactgtggacattgcactttcaggatcatctacttccgcaagatcacttctatccctatatagcagagaagaagtaaaaatgatgattgcgataccagtccatcaaagtacataaataaatgcatgaaataaagagatggagaatgcttaaaataaacacaaggaattacaatatggtaatgtagaaagtccaacctggtaatctaactttgcaaattacaagattttcttgataattccattgtattaatgagaaaaaaagaagaagaagaaacgagtcaatgttataccttgatctagaagatgacgtggatggtgaaggtgaagttggttctcggtactctcgtcgctctgatgagttggaattcgacatgattaaatagttgcaacttttaccacctcaattttttaatatgaccacctacagtataatagggaagttatttaacataactttgccatggtaccaaaagagagagaggaaagttaccacttaatatcatatgattaccatgacaaaagatactcctgttacttcaacaacaaaataaaagatacatataaccactgctagcaaaaagaatatttgcatattcatgttcatggacactagtgaatggagaaaacaaagacctcaaatacaagatataaccattccaccaactccaatacagtctgttgaatagcaatgcaagaataatcaacctctattacttcaaagagccaacttcattcatgctgcagtagcgaattgcccaacactaattagctgcttcgccatccatcagtttttccctcaaatacacaattgccgtgatctgtgccccaccccaacccccctgtgccagcccatcacatctctgcttctcttctccgacctgttccccctcttcttccccagccaatgccacctccatctccccctcccatcttctcctgctcctcctccctctctgtgcctccacattgcccgactgctgccatcactacacctctccttgaggatgccacctatgcacaagaagcggccactgaggagcttgctgcctttaacgcgctgctcgcgtggcccctgtcctttagcattgacagaacccgctggcctaacaggcacaagattgcctgcgcctccccatgccataatgccacctcttaaaccacccgttcccgccaattaatctgccatcatgcacgctactactaccttgacaagccaatgccgtacgagctggagcggcagcatctacctctttgcactcagagggagcagaacactgagccagaggccatccttggcgtgactctttttttgcggggatccttggcatgactcgtgagacaggtggatgatttcaggcttgactgcgtgagattgaagatgaccagccccttaccagctcctcctcttgagatgcctcagcacttgctacaaatgatctcaagaaaacactagtgtatcgtccaatttcgcaagaaaaaagaggaaaggtaactcccactaacttcctcacctaccgctctaaataagaaaattcccctcagctcctgagggagagagaaagcaacattttattggaactttccccagctttgcatgccatcttctcaccgatctcatttcttatacacttaagaaatatgcaagaaaaattgagccatattttgggcattgacaatttcgattcttagaaattggcaggtccgaggccgcacggggcgacaggcggaggacctgcgcaggcgaaggcgcgtgcggcatcaatggtgggtagcgtcgttagggggcccgggtttgctcggcgctggagcatgcatggggaagggcaatacaccggccgccgccggccgaagccgtcaggatcaaacgaaaccaccgccaaatctcgccgcctctacctcgccggcgggccaccgagcgcgagatctcggccgccacgctcgtcgacacccccatcgtaaccaccaccccgctcagctttagtcgatcgaattctagcgcagcgtcgcgtcgcgcctccaaccgccagaaccaaaccgatgcgagattggcagtataggaaggaaagcgggggcgggactcaccagatagccggagacggtggccggaggcggcggtcgctccggcgaagtgtgcgcgtcacagcgcaggagagagagagaggagagggtaggggggaagagtggagtggagtggagagagaaagggatggcgttattgcggatcagtcctgtcgttttcatgctattctggaaaaggacagccggcttgcgttgcgttgcgtggtgagaattaaaattttaaataaatgtgaatcatcgtttccggtttgaaaaaagatgcgattgcaacagtagaagggcccggtacagctcttacctaggagacattgatagtgacctaattctatcatcatcaataactagtatactagtaatatatatgtggtgtaactttatgcaactatcattgtggcgctttattgataacggctatttttaagttatggatgttgagtgagtacagtaacgtttttacgttagagtattataacgtatgagatatagatttattgactttcaagactaagagatagccatgtgtttttgttgttttatgcaatagttggttatggcaaccatagtagccaaataaatc

SEQ ID NO: 64422 - DNA, 7108 bp, Oryza sativa
tgtttatgcgtggaatgcatgaaaagttagggctcttctctcttcttttcccccatatccatcagtgatagccataaagtattccttgcttccatggaccatagctactttacaaagtacattagaaggttttctcagttctctaatgggtcacacatggttcacttttctaggtgctcttgataagacaaatttaacatccaattcttggttcatgtcgcgatgatgtgaaatcctacaacatgattgtacaggggttaggtgcgtcatcgtttcatgatgcagagtataaaaatctaggtcagttgcatgttgatgctaccttaaagcttagacatccttcagtgtggccctgtgtagtgtcgtggctttacactttattctccccgtcaacctccaactttactcactagtgaaaaccataactgaacatgaggactgatcccatgtttattgtaaattagatcaaagtgcacatagtgatacatattgtatgtccactcttaaatttacattagtcgtgttcgaagactctgcattagttgaactgttgacatttatattaagtaaacatagagttcaaccaaaaccattggtgactgaaacatagtccgatttcaaacaagtggaatcttgaaatagcaattcagcaactaccttaataaaaactgctcaaaagttatggggttgttcagattgatgctattttcaaccataccattttttggtaaagttaccaaaaaaaatgtctacgtttagtttgttgctaaatttggtaaatacataagaaaattttggcaatattgtcatcttgccattgccaaaatttggtaaggtttattttggttacaatctaaacaagccctatgattgatggtctaagagaaatcaatagcagcataaattcaagttgcaatttttatactgttccctgccgaacttgaagttgaatcctcaagaattttactctaaatttgtttagtactgataatgaacattcaatccaaattgaaaatatgcacatgtaaattagcaaacaacaagcgtagaatgtagaagcatataatccattaactttgtaagattacagctgtatattatcagtaaacagaaaattaaagaagcaccttacttcggttcactagtgcgctgaaataatttttcatccacattgttgaacttgaaatctccccatgattccaatgtagaaaagtccaacctgtgcaaaaggaaataaagtaatttagatcatttattcattttcatcattttagttacaggactcctatgcgctatgtcggattttcaagaagaatgtggtgttgggtgaatttgacaagaaaggggagtgcagttcatcacaggctaaacgaaatgaaaaagttacagatgtcggggatgctggacaatcctcgggagcaaatgagaatgataaagacaattcatggatgcaattcatagcagaggatctatggtgcaccaacaaactaaagtgaactagaaaactgagagaaaacagcttgttaacttcatctaaccagatatttcggtattagttatactgcgtgtatcttctgtatatgtttgataaggacacttctcactttgcataggaggaccactttaagtttggatgctggttcttaaattaggtttatacttttgttcctttagtactgtataatatatctaaaattgtgctactttgtacttcaatcttcaattaacatgtacctatcatctaatgaaatgatacaaaaggagaaatccaattttatatatccaccatgtattctatggatatatgtgcaatgtgaccaatatggattaagcaatcaccatatatcactaataaaagaaagttaaggatggttcagttttgaaaaatcaattgattttgatattccggctaacaaaattttacggtattattaatggcaaattccatcaatgtaataatgtttatgtttcaaggttcttaagttgcacaaattagtataagaatgtggcaaccatgctcacatctaacagctgctaggacctattcagcctaagcctgatacaatttccatgtagttttctagtttttttttttttgacgcgatacagttttctagttgcaggctgtaagtatctgtttgggcgatcttttattctcagagtttaatttagatcaccttttacccaaaaatcttttcactttggactaactaatattgcgactaccccaactctattctcgagccagagactgcaataagtatgggtaactaaacccagatatataagcctaacctttcggactccagcccagtactacagtgttttaatcatatatgtttgaagatgcccacttagcatttctgatgttttttttttcgcgaatgcagcatttctgatgttgcattcaaccaaagaaaatcagctgcttcaagtttttatcccaactaatttaaagttgcagtaatttcctcaaaattagtgtgtgctttcagggattagagtccaatcagtagagcatacatcaattccagtcacgaattaaagggtaatcatatcaagctttagaaaaagacccaaatctagcgtgagaaagtcacaaagcaaggcaaagcagatcaataccggagggaccagccgcacgaattccggcccaagggtgaggactcggactcgagcagcccaaggattgcagctcgtcgcggccacgcccaatgcctcctcctcctccaggcgccgcagcacgatcacacgcttctctcccgtagtctcatcccagaggcgaatacctgaggcaaccacgaatgttcatcagaagcggtgcatttggtggatgcgcagcggcggcggcaatgggggaagaagcccatgcctcccaggtgctcgacgaaatggcgaggtggggataggtttcgggcgcgtacctgtgcgagcgggctgcgccaccggcgccggccggacgatgagcgggatcgtcgccgacgcggctgctctcccttccctccgctcccatggcgagagatccgtgctttcgacttgtctccttccccttcatctgcgctctgtggcgacgagtcggtgggttggaatttggaaaccgactcgctgacccgcggtctcttcctcttcccctttgaataattttgaaaataatgggtcctctttcgaaattaaattttaaaccaccttcaaataatctgaaactgagtttaggtgttccaaaattcaaactccaaaacccaagcgggaaatcataaatttagcgctcgggatggttccaaatttccgatcgcgcgcactgaatttggaccccgcgtcaaccacattgcaagatacctcatcacctcaggagattcctacatgaatatgggcatttccgcggttccgccccccaaatcgcagcgggaaatcacaaattcagtgctcgcgatggccgatggttcgaatcaggtagccaatactgaaaatcggaccgtgaaaatccaaatagggagcaaatcagaaactgctcgtgctcttgaaatttcaaaatcgctcaaaacaaattgggcaatacaggtcaaccagtgtcaccaactagaacaatgcaggttgcaaaacgttcacatagcacggcaagagattgcaactgaatttagagggtaaatcactgcagatttcctattccattcgaacgaacgaaccagtagttcatacatccctaattaatgaaggaacaggagacgagatgaaacaacagctacaggagaagaggctaggctactacgacgaactgaagaacatggcactaatcgaatccctatccaatcgcgtggcctcgcatcgcctcgcctagccgccgaatccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagcctccggatcgccggcttcgtgatcccctggatgttgtcgcgcagcaccttcctgtgcctcttcgcgccgcccttcccgagccccttgccgcccttgcctctcccagacatcgccgccgccgccgctcgccgccggtcgcgaggaagaaactttgacttggtgaggagtggttggcggcggtggtgatgaggtggggaggaggaggcgtgtgggggcggggctttatagaggcgtgggtttaggggaagcgatggggggcacgatccgcgtgctgctggttttccgccgttggatgggagatggacggcggggagtgggggaggtgggggttgcgcggatcggtgacgtggcgtggtggtgagcgggaggtgtgtttcttttgtgaggatgtggcgggggtgcgggaattcgagcggggagtgggctcgtgttgggtggatggcaggtgggccccgggtttttgggtggcgggtctgcgcgcggtctagaaatttcggatgggttctatctatgacaagtgggcccatagttgggtgccatgaggttagtaaaatacgtttctgtagtttgaaggcgtaaaaggctttgagccaaaattatttgtgagatgaattaagctggccatgttaggtactcctatttaactatgtaagtcaaccaaattaaatttctgaagacttgcaaaagcttcacaatgcatttgtgactgtaaacaatcgtgttctcttctctgacaaaaggttacaggtaataagacacgtataaaattgtaaaaggacggcacgaaagaataatttgcatatgccaaatgagcgtagctctactcatcatgtttcttttcctgaaaccatcccacccgacatctacgctaggggcctgttcactttcatgcccgacatctacactatgtcaaaattttagtatgatttcttatatagttgtcaaaaattagctacaaaataaatgtagcaacttttttggcaactttaccaaaatttgataaggtttaaaatagcatcaaaatgaacaggccctaggtgtatcattgtcactcctacttataatcggtgttttaaataacgagataagatatttagtagttgaccttcccaaacaactatagcgggttaaatgaagttatagcggctaaattatacatgggagcaaatggttaggacccttctcaaacgactatagtcggagatagcggtaattatatttttgtatggtatttcatgtatggaaaatgcagggattaaatagcacaaattataaagtacgttgattttttaaaaaataaaaattataaatgcgaggctagtccagttggtacgtgctgatgcactaagatacagactttgcatatgtagtttaaatattctaacttgattaagatatggattttaacttggttttcgttagcatgactttcgaaatgctaacgttgtattccgtgtaaaaactttctacatataaattgctttaaaatatcaaatgaacatatttttaagttaaaaaaaataaaacttaactaaccctgtgctaatggttttctcgtttgtgtggcatcacttaatatctattttcatcagatttaaacagggttaaccaagcatgacgaaccgatgaggtcaacaaaatataatgtttaagagcctgggaagcatatctacgataacccataagaaaaaaaaaacgtgaccttattcctaggcaaaggatggttcacatcaggtggtctagtgcaaaccgcttccttttacaaggaatagaatgttggagaattaggctatgtttgaaatgatgtgataataacttgtgattaactgaattttaattattacaaaattaaaaaaaaatggattaatctgatattttagaataattttcatatagaaaatttttgcacgaaacacaccgtttagcagtttaaaatacgtgccatgaaaaactaaaacttttatctcgaacagggccttaatgcacatgcttcctatggagtactcccttcgtcccacacagggacggacttaggcctcaggccacgtggcccaggaaagaaacattatcaggcccaacaaattctcaaacttgggccaaaatgccatgtgctagcccgggtctcgtgagaaatctggatatgtccctggtccaaaaaaacgaatcttgataagtttctgtctagatttgttttactatgatatatcacactcagttataggtttgttttctgtgagacggagggagtaagttctaaatgtggtatcttttttttaaaaaaaaaacaaaaccatgtatgtatttaatagaaagctattataactccgatgtagacttcacagtgtttgatttgtttgtacccttaaataattatcatataatcattcatctatttgaaacggtaattatacccttgaacttgattaaaagttcatgtagcacccaaaactttaaaaacatccatccaacctcccaaattttattccattcatattcatataatccactatggtggttttgcaaagtgtttttttttctaaattacatatatattttttaggagtttaactacatgatatacacattggtatcccattttgcaaagtagtcctttttgtctaaattgcatatccatttttcctacctccatcccatattatagctacttatatcatttagattttgtcagatgatatagctacttttctatccaaaccaatcacaagcctccctcattttaatatcaccatgttacttaatttcttcaaaatagcattcataagtcactataaaaatgagacaaagggagtacatcagttctgttaacatgcatacaaacatgtgtataagtgaatcaaacatcgccctcacgccaatttcactacaaaattcctacgacactctttggcatgcaacgtgtagccttcaaagaaatatccatcggtatcactcgacatcgtccattgttttttctatccaaagagaatttattcgaagtgttggtaagatagctacctacttcattcaaccatcatggatccaacatacaaggtgaccaagataatatcacttttt

SEQ ID NO: 64423 - DNA, 26340 bp, Oryza sativa
  unsure (1)..(26340): unsure at all n locations
atattgcagtttgatgataagaatcaaacaactgaaaggaaccgtattcatatgttatgtttctgtgtactcaccggtagatgcttgagcaactcctgctgtacatatcatatacaaatgctctaccatcctcacaaccaattataacctctggatcggcataactgtggaaagtggaaacaaatgagcattgggggttaaagctaacaaaatctttatcataaaacgtttggacagcacacgaccctacgcaataatcctgtgcctctgagattacatgctttcatgagcaattcagtaatttcagtagtatatgtaacatctaacttttcatttgttcgaaacaaaaggcatgtcattttacaaacttaaagcatgttcctcacctcatacataagccacggttgaatgaggctccacgagattgaaaaatacttctcggctcactacgtctccatatgcaaagctgggagctagtcaaacctacaatcttcacagaggattggaattttataacatgtaaataataagtctatagatatggtgtggttcataacttaaatcaaagttgtttgaacctggtttactgcatctccatgatgaatagaaaagtttatacaatatacaactattagaatcaccaattcagccaatgttattaagctgaagatgataatatagaacatccaagactacttatgtgcaacctaatgcacataatggtaaaaatcccaacctacaaagatttccaggacaaagcacagctggtgtttctaatgagaccataaccatctccagttttatatgcacaccattttcccatatgttgaccactatcgtgggggggaaaaatgcacctacaagagtcagcaactaagcaatcattctcattatgcttgttgaatctcactaatatataatcgaattgcttcaaatgttatattaataatacttgtaaggatcaatagcataaatagtctattttgcagtttccattcacattcgaaaaagaaacatagcactaaggcaaaggagatcaaatgcttatatctgcacaaataagatgtttaaatatgtggctggagcttctgacatataggtgagctactacaaataggccttcttgtacatagttacagaacacttggaatttcatatggaacttttactgaagcaagaatcaattatagcccttcctgtcaaatgcataaggacaaagctagtagcagctagaaattaagaacagaagtactgaaagctaccaacatcgattaccttattttcatcaaaatcaaagttgaccagcattttagaacttggaacaatgtactcattcatgtatttgcaactttcagcagaccaaagtcggagagtctggcaaaaatcaaatgccaagatgatcagcatgattataagatctgtgacggtattaaacaaaattaaaaaaaaaagcagtaagcactaaaaatcttcaatcatgctttcaattatctaaaaacttcgcaatgtactcaggcagccatggtttccacaatcatgtcatgtcatgtttcatctggcattctgcactactatagcatcacctgaatagcgagagtggaaggccattgaccatacccctattttttaaaaaacaaatataaatataactttttttttgtatactacatcactacatttctttttgctaaaaggacctaccaaaaaggtctaaagcacaaaaattattattgtactagtacaaacattaattatttgtgcctgttacatcttacttttttatttcaaaaaacagccatttcacattgatgaaggataataagaacggcacatgatgcaaggctcaccttatctccaactccagttaagattgaaccactcttcatgcggcatatggtggccctgaaacaagaaatagaaaactgaaagaaaaaaatgtggatattgagccacaatcccaacagtgcagctccagaaaagaagatacttgatcaaatcgaacaatatgaaaaaactaaaaagaaaatgtttgagaacacgagaactcttttagttgatataactaattcactatgcacaagaaacagcctaaatacagaagctcagcatagtacagggctacaggcttactggttaggatgaccaatccactgataaacttcagcaggacctctagagaaagacgatgcatgttcatcaagtgcaagctccttgaagtaactctttattgaagtattagaccctgaacttcttgcttgtggattcctcttgtaatatagatccctcatcagatgagctgtgtcaataactctattcctataaaccaagcagagtagaataagtacgtacaaattttaataacaactgataaattgcttggtaactttggaattttcacaaggaagatctggcggcatagacgagaaacatgcatgaataaaattaccaaatgaaactaaaatgattagcaccataaatgtatttgtcagtatggaaaatggtagctggaaaccagaataacactgaatcactgaattaatagtcaagtcacgaactactggacagagtatgaataatatccaaactaaaatgattagcagcataattggcatagttgtcaggacagaaaatggtagctggaaaccagaaacagcgctaatttagcagtcaagtcacaaaccactggacagagtatgaatatccaaagaagaaacacacaacactgattagctccccagaggtacatggttaagatgcagataacaaacaaatgagaggttaaatgcatcttcaacaaatgttaccatgacgaaaactcatcaatttgactagtcattcagtgttctaagcaacagttactttgaagcatatatatataccatttaaggaaaaaaggaaaaccgcagacccggagtattgggacatgcttcatagttatccacttatcctgcaacctctaggcataaaatccaggcagcagagttcaatgcaatgcgacagcagagtagtaattgaggctatttcttctaatctcgtagtagtagatacctgccgtattgtactgtaaattagagcaaaaaataaacatccccagcgaaacccaaacacaaacacacagcgtgcgtggtagcagtaggagggggaacatgggagtgaggaggggagaggagacgattcgcgcggcggatgggacgaaccatgagttgcagacggtggagcagcgggcgaggtcgaagtggtcgtcgaggcgggagaagacggagcggagggtgtcgtcgttcagcgcctgcgccgtcgaccccgacccgccgccgccgccgccggggcccctgcggcgcttcaatcccgcgctcccgctccgtccccggctgctgctcgtctccatggccgaacccctctctctctctctctctctctctctctctcccgatctctctggaggcgccgccgtttgctcgttggtttcacggtggccggtggccggtggccggcggcgactattcggtccttccgccgattgtgtggtggataacggcgtgttgacccagcaaagtcccgagtcgatctggcccaatggcccattacactgacaactaactcggtacatttaggcccatcaaattttggatcgctccatggtagtaacccaactcggcccaacttaattttgaatatgtaccatgtcagctatcgaacataaccacccgaattttgtagggaaaagtgcactttacagattataattcgtagccctcaatcacaaaacctggtatagcgtgtcccctaacttttaaaataagtgacatatgaatctcttggcagttttagacgatggtttcattctaagtgacatccagatggtattttgactttgtcatcattaacgtggcatgtgcatagcatttataataattaataaaagaacagtgtgatccacatgtcaatggcatcaccccttattcctcatctgcctcctttgtctctctcgcgatcctcatctcttcttctttggcaacgtcggcatgggaaagggagcagcggtcacaagagagaggagaaggttgaggccattgcagtggcaagagaaagacagttgaaggtagagcagtggcgcatctgccacgacctatagcaatcactgcggtgtagcctctgtaacgtggccgcagggttctcctttccttcgccggtgcagcaaattaaacgacgagttggatgaggaggtgaagaacctccatgaattgatccgttgactcgctcattcctgccggttcccctcaacgctctcccatgttaatgcgccgagcaacgcactgactctggttttgggtacagctacaaatgtgtgaggatgatggggagttcctaaaggttgcatgccgcaagttggagtcgatggttatgcaactatttgccaattatggatggaggttcacaaatatatttcaataaatgtgttctccttattttggcttggtttcctctgtttttgtttggtgtgtcctatttagccgaactatgctcttttctggattgctacaatgtaataattggctgtagctctttttgagcaaaggctgggatgttaaattccattatctaaaaaaaatgttaatgcgccgagcaaaatgatatggggaagagaggatgtagaggaagaagggatgatatcaatgatatgtgggtcccattgatttttttttaatgatgctatgtagacaccacgtaggacgataccgtcttccaaaccgctgagaaacttgatttacactggttttaaaaattagaggatgttaaatacctgttttacggttaagagacctaatcacctaaagtggactttttctaattttgtaacgtcatgattggtgtcgatccaactcgggccaactgaatcttgatctgctgttcagtgagacatagtgatagtgagtagtgacggccaacacgtcagcggtggttgatgcgttacggcccgaccaannnnnnnnnnnnnnnnnnnngcagcggctgatagatcggtgaggccaacgccgctaccaagaaaagctggctcctgcactaacctaacaagttcaggtagagagaaaaacatttctctctatatttttgcagttaacttaaattggtgttgtaatgaatagtatgattatattgcttgtttatttatatggttgattcatgcgcggtttggaattttgtggtgctgactcttgcatgtaattcaaagaagagtagagtgcggtttggaatactgatcgccagtttgaccatgcagatgtcaccggtttggccaaaagaagatcagatggtctgaccgcccttcgccttgctgtcacctgccaccgccttcggtccaaccgctgtggtgccatcagtctgactaccggcatcctgccggtgtgagactgccaccataaaaacattaattgaagaccttttaaaagtagattgaactttattacttttatttgtgttaacaaaatataacaacattactcctcacgctacaaaatataacaacattactcctcacgctacaaaatataacaacattactcctcacactaaattcgactaaactcgaaattctaacttttctctaaacttaattttcacaaaatccataccggtaggcctcaaccctctcactatttatgtccgaggttggtagcctaaaatcacgaatctaacttgtacaagatgttttaatccactaggaaactttcccgtataaaaaacaaatttatttcatcattcgaattctaatctttccaaatttggactcctttcaaaattgacttttttttccatatgcgcacgatctcccatcaatatgtcgtatgaaatctccatcaataatttgcattgttctttatcctaagcataccgcatgatatctcgactgatcgggcgtcatcttatctcaacttgacttccaattcatcaccgacaacgctctcctaaggcatcaaggtacacctatatatatgaaccaaacaataaaccatatccgagcataagttctttcccaacttgctctacattagcacacaacagtactacacacgtatagaaatcatctagaagtcataaccacaagatagttatgagtatccaaatgaacaacccgaaactaaccccaattaggatccagccgatcagaccatccggttggcctgtcagacctcacgtactacgctggtctgaccggtctacccgtgtccggtctaactggctccacacagagagcaccactttgtcataattatcaaatatcaaaataaattacatgtcacgccaactgttcatcataaattaataatcaaaaacacactttgattttacaaagacgatgtgaagttctatatcaatacagcaggagaagaaattacaaggttataaccctaaaaggatataaccagaaaaaagataaatcgtatcaccacacgctagcagctaataacacatccccaataaaagcactgacatcaaatcggtcgccgttgtgcttcttatatcaatgattttattctcgatattatatcactaatatgtgagcttaattaattacagtggtgcaggtgcagatgagatattgtctaggtgccagcttgataatcctccccactccaactaggacggtaccactcccaaaccggcaaatattataaaatttataaccgaaaagagaagacagttgtagacggtagcgacggccaatggatactgcctcttgacggcattagtccggtgactgcgccacacaaacctccagaatatacgcatcgtcgttacaggttcaacccatgttccgacattgacaaccaaaacgatgaggcacacgtagataaccatgaacacgatggagactgccctcgaggttctcatcgtggcgcgaaaagccgcaaagaaggccaggatcaggctgacgagcgagacccagataaagtgcaacgccgccacgaagctcttccacgagccggcggagcgcgatgccttcccgtagacgagtaggatcacggcgaccaccgatgccgctacggcgacggtgtcgaggaccatgaaccatttgaatgagaacctgcccttgaggttcgccgtgccgtcgtctccgtagctgcctggcatgttgaatccggcggcaaaggcgacggtggcgatgagcacggccaccaccgcaaggctgtcagttgtcctctctatccctttacctatgtcgcggccgctccacggctttagatggtcattcctttgtggtcggccttgtgccccaaaagcaactaatatcaccacaaagcttacctgcattgcatgcacaccatgaatatataccattaagctgagggcccatgccatcatctctgatgtgtttgggtttcgtcaaaaaatagtggtcagttatgactccacctaatttctaacgagtggaggcctgtcagtacatgtggtggtcaacatctctgacaagcctcatatatgtaagtgttttttttctaatgaagatcaatcataccaaacttctaagtcaagatgtattgaaccatttaatgcttgcacatatttggttattgctcaccatgttgaacaaattggtcgatgtcgaagcgagatcaagcggcgagtgtccatcgtcgttcaagacatcgctttgcactttccccttatggagtaaggcattcacaatgtcaggcgagccggcaaccacggcgatgtggagcggcgtgttcccaaccccgtcctgcgcgtccagaaggccaccgacctgcttgtgtttcttgatagcgagggacacgatcgaggactgcttctccctgaccgcggtgtgcaggaaggtctctccatggccgtcacggagctcaacagcatcagggcagatcccaattagttgcttgacaacattggcatgtcccaacctagccgcgacatgaagagcggagaggccatccgagtccttcatgtacactgtgccagttggcacgatggctaggattgcatgtacgattttgcggttgccgtcggatgccgcgaaatggagtggggtgctgccattgcagtcgacctggctagccagttctggcttccattgcaataataagtgaaccatctctgccaaagacacaaatttatcaatcgagttgacaaacacattcttgttttgtgcttgagatctgccgaatcaacatgagccgatatcttacctaagcttcggaagacggcagcatgcagagcattctgggagctcggcccaacgggtgatgcgtcgctgcaggtagtaactattgctcttacggcaggcactgacctgctcatcactgccaagtacaacggtgacacaccggctttgtttagctcggtctgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaaccttaacaactacatgcatgcaagctatcaggtcgtcatcacatgatccgaacctttcatgctaactaacaccctctctcaatccggacctaaccaggttcagattgcttttgaaattctccaggagtcttactgacagaggtttagtgaatccatctacaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctgtgctagatctagacacagtggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagaattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagattctgaagtaaagctgcagtggccttctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatatagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcagtatataccttttctttgcgaactccactttgcaacctggtgcgcggtcctgccggtgcctctgaacctgtgtcagtcacatctgcatgctgtaatgtattagtctcatctgtgacagcctgtgcatgttcctgcgctggtgaggactgctcctgctcctgcaccacctgcgactcctgctcctgcaccgcctgcgacactgagtcttctgctgtctcctctgctagcgatgatgctaccccccgtggcacagaaccaggtgtgggacccggatgacggcctgatgacgtggccgcaggggagtggtggacgacacggtctggttctggaccaaaactggcatccagaggaggcgtcgccggcggatcttctgcatcagcgggatgtactgcaccatctctatgtggctcattagcacgattagataaagcagcagaaacatcagcagataatggattagtcactggatgcatgcattgttcattcccaacagaccgtatgggtcctagcagttcaggagtgagaatatcaatctcagaacgaagacgggcactagcattggcatgaagttcagtgaagggaaaaatattctcatcaaagacaacatcgcgagaaatatagatgtgtcctgtagagacctcaagacactttaaccctttatgcatagtgctaaacccaagaaaaacacaacgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatggatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccagtcagtttgcatggctagaatttttctatcaaattgacgttctaccatgacttgaaactcctgaaacttgtcaaacacttgagacttatgctgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagtttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtccagctctcccgtgacatgatctgtagcaccagtgtcgatgtaccaatttgtgtcaactccataggagttaaccgctgcagctgcaacatgcttggcgtcaggaacgtaatcctcgtcgtacctataccaacaatctgctgccgtgtgcccccgtttgaaacacacttggcagattggtcttttatcaacgcctcctggtgtgcggcctcgaccacggccacctcctccgttgccgcgaccatggccgccgccgccgccgccgcgcgaacctccttggccaccattgctgttgccacgccccccgtggctgaagcctccacggttggcaacattgacggtgacctcctgtgcgccgcggtagatggcttggcgagcttcaaagttcaacacttgagagtacagatcactcacagagattggttcaacccgagcgcagacagccgacaccacctcgctgtagccctcgccaaggccggtgatgatatactgaatcagctcctcttcatcgatcgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcgatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcaccggtgagatgcccctgaagccgcgctcctctaactgcggcgcttacttgcaccttccagagcgcatgatttgccttcccaagcttctctgagattgggtggccttggaacggatttgtggcagccgtactggacgacgaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtcatcacatgatccgaacctttcatgctaactaacacggtcgccttcgcacgtgccacgacaagagcctccacggtggcgccatgcccgtgcctcgctgccatgtgtagggccgtgtccccggccgcgttctggcatcccaggatattctcctcgcagtcctgggccagatttacaaggatcgtcacggtgccggcgtgccctgccctcgccgcgcagtgcagaggtgtgtccatcgccgagttccggcgagagaggagactattgtccctgatgaacctatggtagagctcctggatcagctcgccatgccctttctccgctgcgacatgaagaatggtgttcctctccgccgtcacctcgagtacgttgcactgtctgtgctgaatgatgcctgaaatgggtacgaggagaattaaatgctgcttgtatgatgatatactagtcaaatgtctgtgagttgcaacagaaatcaactttttgaacaaaagaagatcattattgtgtggcggactagagaaggagagcccatttctttttttctagttctcacagggtcatcccccctggttttctaattttttgcatgctaggatgaccgaggatagaggatcggtttggggttggatttttggatgatggcatcgtgggcggagatggtttcgcaagataaaataggtttattttattggtactaagacggttttgaaacatcagatacttagttttattggtatgtctgtgagttctaggcaaactgttgttttcctgacagggggtggtgggctcaagtaacagagatagagatatcataggcttgcatttctttatatattttttgaaatgtttcagtattgtagctaacatttaagggcaaatgtagatgaaggacgtgcatggatttgtatttaaaaatcaaacaatggacaattttgatttatgatagtagcactccatctctctgtgcaacaacctccttgattggggctttgcatctcgaggaaacatcacgtttgtcccaaacaactttggatatacttcctctgtttcaaatactcatcacttagaccctctttgtttaggcttaagcttcagtttatagccagaaaagctaaagcccaaacaaagggcaggctttttcatctggcttttaaaaaagcctaagccaccctataactaaaagccgaaagcccatagaaaggtgctttttctggcttttgtgggttggagaatatccagtgccattaaatttgataacaaattacccaccatgcaatccatttataattacggaacgaatcgttttgtttgaattctatcctcgagcgagagcgaaccaaggagccatctctccgccgccggcgacgggcatcggtggccctcttcctcccctaggcccctgctgctcttcttcccaactgtcatcagattcttccctgacactagcgccatcttcttggcagccttctgtgatcaaggtaattaagacaagcccatattctcgatggataaattagcaggtgacaatgatggaatatcagtatgatgtgttttattgcgtgatttgcctacatgatttatttagaccattaatgtagttgttacacagcacgaagttaaattgctgaatatctttttttttctgaatacattgctgtgcatctttactgcctaaacatttttcatgtaataaagtcatgtagcattacataaatcttactataaatcattaaaatgtgtttatggctgaatgtaaattgtctagatggatctagttcctcgatccaaggcaaattgggacacatttagcaacagggccttttgtgagatctgtgccgaggaatgtgaggctgggaatagacctacgggttgtttgtcaactactggctacaaaaatctacagctgaagttctttcagaggacagggaaaaagcatgaccaaaaacaattaaagaaccactgggaaacactaaagaaggaatacaacttgtggatcgaactgaaggaaaaatcaactggattaggctgggatccaattaaaggaacatttactgctgatgatgcttggtgggcggaccacatagtggtatatactatttaaacactttacatgttccagttcatatttacatttaaacttgtgctaactttgttcttttttccctttttagaagcaccctaatcatacgcattttcgtaatggaccaccggctaatctacaagaaatggacgtcgtatgataaagcttttgtcactggtaacagttcagctatacccggatcttactgaatttgccaagttatcggatgaaaaggcaaacgaagattattcttgcatgtatggctcttcacaatttcattcgagacagtgttttgcgtgatgaactttttgggagatgtgatctcgatgaagagttcgatccaaacactgaacaagctagttcatctcaagaaaatggtatcaatggattagcggtggatgatgaagacatgaatgctttccgtgataggattgctaattcactaacggcaacaagggcatagattgataggttaatttatatatatgtgcttgtattattttacttcctcatttgttgtcgtggcatatatgtgatcttattattttactaatataatggtcacggtaattgtaacaatataagatgatgtttgtgacgttactagcagatcatacgtacgccagaaaaatacatttgacaatgtccttagcttgtaaacaagccaccaaaatctcaggggtgttttggaccattcaatagttagcaaatcagccatcccacacaaaagctagattgccaaacaacacagtggagacttttaagccaaggaagaataagctgcctaactggaaaaacctggcataagctgcttatctataagcctaagcccaaacaaaaggcccataatcctatttactttttaattttcacagcttcctccccttttcaaaaagtttatatatacttgaaagtaatatatatgcgtcgtaccataaatacaaacgtgcaacttttataaattaatcatttaagtgttatcagtggtcaaggttgaaatgttgatggtcaataatgaaaagaaaacgaggatggagagagtatgataaaattatccaataatatcaaactttataataatttaaaccaagtcaaaatatattttatatatggtgtatgaattgaacttatactaatcttcatattacaaattgtttccacacgacattgattttgttgtacaagtcaaagtctctggattttttttatcaaaccaaaacttaccagggcaacacggtcatttggtgctctggtatggactatacgactctatgagcaaggatgtttacacaccttatacgaagtgttgatacgtgttacaatagtgtcatgtcaagaaaggaacaggtctgtacaagacaagagaggactaatacaattcaaagtcaccttgatgcatatcacatcacattcttggactattgggatgtttttgaatggatgattgagttaatagactcatggagcgatgaattacatactactccctccggttctttaataattgacgctttggataaggttgagatcaaacttttataactttgaccatcaataactttaaaaatatttagtttaaagaaactagaataacatatatagatttatctttcaaagcactacaataaaagtaaacatgtatttatttattgtatatattataatagaaaaataaggtcaaagatatatttgtagaccgtgtcattgtccaaaacgtcaattaaaatgaaaccggagggagtatatttttttccgagtgcataatgatataaaaaaacattaaaaaatgtaagacgttattaaaacattataaagttgatgattcctaccaagaatttgagatggcaagtgtttatttccataaacactttataatgtttatggaaattattggtaggaatcatcaactttgaatgattataatgtttataatcggttctccgtaccgattggagaaaattaagatggcaagtgtttcctttgaatgaacagacaactgcagtgataagctgtgtgtggttactgttaaattaatcaattaccagcgacttgacgatgtgctgctgcaccatcgccgggccgttgctgcagaagcaacgccatgacctcctccgctcgcccgctccgtgcagcgcgatacagcgacgggcacatctccatgcgaggcgcctcatcaccattcgacgccgccggctgatccattgatggagtatgcatgccgtacgtacgtgtcaaattaagcttattagagataaagaggatataaagtatatgctagtagtaactagctgtaagaattagctagctgcagctgcatgcgtgaatatatagtgtgcagctgatgaagctgggggaaagggatcgagatatttaccgcctaatacgtacagactgaatttgaggctgtgaatggcaatgcataccctcatcctggactccacaactgcaacctagctagcttcctggttgctgctgctgtcaatattgcaaattaagtctcttgttctctaccgtacccgggtcgttactcatgcgtagtatactatggctgtgtttagatcaaagtttggatccaaacttcagtccttttctatcacatcaacctgtcatacacacacaacttttcagtcacatcatattcaatttcaaccaaaatccaaactttacgctgaactaaacacttttctttttcatttcaaaactcagcagaaacgcatgcgcttataaaacgtgtgcacaggtacgtactccctataaacgcatatcctttttatataagtatatatccgaagattagaccaacatattgactcacaaagttatcactagtaccttgttatcgagggaaattaagtcactcactcccttcgattctataattcttaacattttgagcaataacactcgatctctaaaatatacatttgattatatttttgtaatatatgcaataaataatttttttttacttttattatactacaaaacaaattgtcgacgtctgatgtcacgactacagtatttggacagtatggagatcgttggtgttaggatatacgtgagactgaggtaaaagagacggagacagagatttttatacaggttcgggcccctcgtaaggtaataaccctacatcctattggccgaagccggtcgttgatcttattcaccataatcacactagtacaatatttggggtagcctatctaactgttgtcgacatggcggtctataggtctgactcgtagtcgacaacagggtagccttcctcctcgaatccgtatccggcgagatcagagacaacgctagatccctacggccggcctctgaaggtaccagatagggtcgatccaggcatatctctgatgtcggtatccggcggcttgtcttggcgtatgttggcttgtatgttgttccgtagattgtggtgggtctcttccttcatctctctcctcctagggggtcttgtatttatacacataggtgtccccttgtccaagtagaactagggaaatcaatatggatacaaatccgagtagtccttgtcgtttccatgtagaactctgattgtatttccttattcggaactccctccatatctgaaggttgtttccgtataagatatggtatgtggtgggtcctgccgagatttagtcgactactattaggtatgtggtatccataaccctgacacaaatatatagatgttgacttaaatattcttaaaattatttatagtgaaaattataaaggtttaatctcaaccttaacttaaaacatcaagaattatgaaattggatagactattacttttaaaaattaatcaattataaatacatgtacttatataaacacataaaaaatacgggttaaaccagtacttatatgaactatactagtactaggctactagctaggaaatcaggagtacctgtacgtccagaattccagaaagggacgcacggtcattctctcacactgtcacgcgcatcggagaacatctatctcgtcaatttgactcgtagtatttgcgtccaaatttttttgtttgacttgtatgcgtttcctgcttctgttggctttcttcgaaaagccggatgtccggctgccgtcccaaatgaatttgcccctttggatcgtccgcgtgtcgctcaattaattagaatcgtcttcattcgtggggttcagaaaaaagaaaggacaatgcacagggtaaaaggtgcaaaatatactagaatttctttttacggattcgtgaaaactatcggcagtttttttcctctttaaaactttctaaggccctgtttatttcagtttgaaattattataatttagattattgagtcagattactataactaatctgtagtagaataagcggttagttatttctttcatagattattagagcctagattattgggtttgcaagtctaaatagggagtggggtggcatgatgggtaatttttcacccaataatctggaaaagctcacctaaatgagtttatcagattattattaactgggctccagattataataagctactttaataagttgtctgtttctttcagcttacttccaataatttagattataataatcccaagctgaaagaaacaggaccttaagtcatctaccatctgattgcatcgagattcatacaacgaaggacaaaaaaaatacttatgtttttctacacatgctcgagaaggacccaaaccagcggaagcaggctgcgctagccaaccggccaccactggtagagaaatcatctttggtcggtcgacccaaattcacaatagtcccggttccattaaaaaccaggatttttagtcccggttaataagaggaagatctttagtcccgctaaaaatcatctaaagttcatttttagtcccggttgattccatgtcaggccgtgtcaggaccctatgatctttagtcctggttagtaacaccaaccgggattaaaaacctatttttagtctcggttggtgttactgatcgggaataaaaatcaaaacacactatataatccatagtaccgatcctcttttcccgtccacacaacaaactcctccctctatctctttttttcctttctaacttcttgtctctttccttatctctaactcctctcctctccttccttttttccttcacccacagtgcaggcggccggcgcggaggcggcgacgcgggggacggcacggaggaggcctgcgcggcggcgcggggggccgtgcggcggctgcggtgggccgccggcgcggcggcgcggggggccgcgcggcggcgggcggcgctggctggccggcgcggaggggaggaggggaggcggcagtggccgccagccggattttttttctttttttttttttgagatgtgaatctgtgatgtatttttgtgtgagatgtgaatctgtgatgaattttttagaaccctgtgatgtaattttttttaagagtttgtgatgtatttagagatgatttgtttgaggatttgaggatttggagatgttctgtgatgtgatgatttggatatgggaggggatggtgtgaaatcaatattcaatattaaaagcggaaaataaaaagaaaaaatatctttagtcccggttggtgttagcaaccgggactacaccaaccgggactaaagatgctcctattaacaccaaccgggacgaaagattgatttttagtcccagttatttgaatcagtactaaagatagcgatctttagtcccggactcgtagtcccggttggaaaaccgggactacaggggggttacaaaccgggactaaaaagcatttctccaccagtgcacaaatcatttttttcaattatactagttgcatataagctatattatagtcataatgtagttacaatctaattacacttcatttgcagtatatttatatttataagttttcaatgaaaagactatcaactgttttaaagctactcctttttttaaaaaaaaaatactaggaagatagcccgcgcgttcgcttagacatgcgcattagtttttttgaaaatagttttacaaaacaaattgtgtcgacgtttgatgtcgcgactacagtatttggacagtatggggatcgttggtgctaggatatacgcgagactgaggtaaaagatggcggagacagagatttttatacaggttcgggcccctcggaaggtaataaccctacatcttgttggccggagccggtcgttgatctttattcaccataataacaccagtacagagcgtacgactaagtcttccgtcttgctgtaatcgagaatttggattgaagtcaagaaattttatctcggcgggtacaccatctcttcagtccgtattccttgtcgagatccagcaaccgttctcgagcgatcgagaaggcgtagagtctacgacggagccttgtcgacatttgttgtactcgccttagtcgatcttggtgtagaaccatagagacatggagtcttcaacaatgtcgaatagaattttccagtgttttgtatatgagcgttttctctcttaccgactccgatcagtcagtttgtagagtcatgcactctgcctagccccgagccttgtcttcggagaatcgttctcggatgataaggctcttggacctttgacctacctcatttgaacaagcactgatcctagcccccagccgtgaagttcgaaagctcaatttccgattacacggcttggttaatacgcacggcgagaactcttacacgaccagatcttacatggtgttttgtctctgaaggatccgacaaggccttatcggctctgggtgtccccagctgaagttcccttaggttcctcggaggccttgtcaagacggcgtaaagggacagtaggataggttgcaacgctaggtgtcttctgtggtgagggatctctgggtaaaacacttggcgatcttgtgtacctgatatcaaatttgttgaagtagaggtagtaggagaaatcgctacatcgctggtcgaggaccaggcagtagtcgtaactcgaccacttgaagtggaagtagtgggagagacactacatcgttggtcgagaactgggcagtagtcgtaactcgaccactagaagtggaagtagccagagaaacgctacatcgctggtcgaggaccagacagtagccgtaactcaaccacttgaagtggaaatagtgggagaaacgctacgtcgctggtcgaggacctggcagtagccgtaactcgaccacttaaagtggaaatagtgggaggaacgctacatcgctggtcgaggaccagacagtagccgtaactcgaccactgaaagtggaagtagtcggaggaacgctacatcgctggtcgaggaccaggtagtagccgtaactcgaccactgaaagtggaagtagtcggaggaacgctacatcgctggtcgaggaccaggcagtagccgtaactcgaccacttgaagcaaatgtacgagagatcactacgatcaactggttgagaaccggtgagtaggtgtccctcgatcatttggagtcgtggtacgaggaccgctacgctgccgtagtcgtaccttgaccatctgaagtaaaggtgcgagagattgctacgtactggtgcgagaaccagtgagcgagcagaattatgtctcgaacaccgatggaaggtgcggtgcgagaaccagtgagcgagcagaattatctctcgaacatcgatggaagttgcagtgcgagagattgctgcgtactagtgcgagaaccagtgagcgagcagaattatctctcgaacatcgatggaagttgcagtgcgagagaattctgcgtactggtgcgagaaccagtgagcgagcagaattatctctcgaacaccgatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatctgttaacaaccttttctcgagtagtccagccatggccggttctatgagataggtcatcgatcttcgttggcaggttgggtgcgataactccgcatttgttgagaatgttctcgataatggagtgtactcgaccataacctactcgagtgctcaattgttcctgaaaaatattttctagaaggcaagatatatagcagagaatatcgaatatgtacttaaaaaaactgcatggatcttctaatattatcacgatacaacaagcagatgtaaatatcagggcattatgtaaaccgtaaacaagcatgatttatacagaagaaaacagagcgagcccccagcgttagaccgtagttggcctatcgtcggaagtactcgcacaacggatattgtataaaaagcatgctctaggtaaacataataaattatagatctgacaatgctgtatgatctgaataggtacgataaattgcagataaaatattgtgtaccttagtagatacatgccggatgtatctacgaaattagtagattaatttaaaaaaccaatctaccaattaccttgttgcgtactcgttcgacatcatacggtctgacatctttttggtacgccgcgaagcttgaggcttgaatgatctcgatagaccaagttgttgacgacgatggttccgatctcgtcgggagacatactccggtcgggttggatgttcccacagcgaagtcgtcgagtagcttgttgtcggagagtccatcttttgaacccatctcgtcgaaatcctagagcaccaaaatccccctacctggcgcgccactgtcgacgtttgatgtcgcgactacggtatttggacagtatggggatcgttggtgctaggatatacgcgagactgaggtaaaagatggtggagacagggatttttatataggttcgggcccctcggaaggtaataaccctacatcctgttggccggagccggtcgttgatctttattcaccataataacaccagtacaatgtgtggggtagcctatctaactgttgtcgacattgcggtctgaagatctgactcgtagtcgacaacagggtagccttcctcctcgagcttatgccaggtgagaccagaggtagcgctagatccctacggctggcctctgaaggtaccgggtagggtcgatccaggcgtatctctgatgtcgatatccggcagcttgtcttggcgtatgttggcttgtatgttgtggcttctggtgggtgtatggggggtcttgtatttatacccataggtgtccccttatccaagtagaactaggaaaaccaatatggatacaatccgagtagtccttgtcgtttccatgtataactctggttgtcttttcttatccggaactcctcctatatccgaaggttgcttccgtataggacatagtatgtggtgggtcctgccgagatttagtcaactactattaggtatgtggtatccataaccatgacaaattgaaattaaaataagatatttttctatttttaatggagcgttcattatatctctttcttgtgaacaaatctcgacaaacttggtaataaatgtatttttttattatcctgctagccccctctttaattgcttcatatatatacaattcattatgcatttgaatcaataaagataaaaaattcttttaaaaaatatttattgtattttgaatttagtgattgagtgattcttatttcgaatttgtattcaaatcaaattattgttttattcaaaattgtctttttaggaattataaattatacctaatctcgtatcgtgttgtatttggactcttctttgaatacttgttttattattccaaatttcaaatatttataacttatggttttatatggactcttgttattttatattgagagaattacctatatggcactgaaaattcgcttggtttcttatatgccaatagaaaacatcaatctccttatatgccatccaaaaagtttttccatccctcttgggccactgccgtgagctctgttggagaaatcatccattggctggtcaagtttttatccaagtacccaccctacccttcttcagcattttccagcaagcttccatgaaatgaattgcagcaagcaagcaacgatgggctgggcggttgactacaatgtaagtagttgaaaactaatctttttttttattctcgtacaggatagctcaaaattttgagatgaaaaagtattgataggatccatgtcgggcatacatattgttgccgaatcatacagaaaccaaaggtaaaatggatgcccatcaaggcagaaataaccggagaggaaacgaaagaacgcatgagagatttgaagggcaacattgtcttttattaccttaattagcagcaaaccaacagctagctcacgtagtggcacgaaggggataaaaagttgaactcagtgacatataagggacccaacaattttcagtgacatataagggactgaggcaatttatagtggcatatagagaattttctctttctacatggaatcttgttatattttttatagttttaattatttttttaaaattttgtatgtgattttaatcaaattgcttgttttatctttttgttctgaatttaattatgaactccttgtagtgatccgcctgtcaccatcagcctcgcagatcattgtcaacctcctcaccagtgagcctctcttgatgcattggaaatgatgtggtggggctctttctagtccttgtcgaagacgtggaacgcctccctgtgccgctcctctcagtacttgcccttcacctaatcatctagcgtgctatttagggccaggagggctgcaggaa

SEQ ID NO: 64424 - DNA, 922 bp, Oryza sativa
attaatgtgttgtacttcttttaattttcattttagtttgttttctattatttaagattagctttcactgtattttccttctcaactattttataaaaccttctttagcaaataaactaaatttctatatattctttctttcccacacaaattttatctcttatcaacttacaactaaatttggagacaaaaagtgtgcaaaacatagctccaaatgtaatatgacaaaaaaacattggaggatgaaattgctaaccttttaggcacatccgatttgtatataatcaccaaaataaattcactagaaattttagcatgacctcccctcttttttgaagaaattttaaagcttgctcgggcagctggaggaggaagaagacatatatatataggggtgggactttagtcccggttggtgggatctttagccccgcttcataacaccaaccgggactaaagttacgatcttaccaaccgggactaaagttacgatcttaccaaccgggactaaagatcccggggggcctgacaaaccctggaagtatttgaaccgggactaaagatcaaatatgcccgttaccctttttaaccgggactaaagatcatctttagccccgatttttattgcaaccgggactactgtggaattcggccgaccgacgaaagatggtttctccacgagtaaaagtacatgagttttttaaaaaagaactgtggtcaataaacgagatgaaagggaaaaaaacatttccccttaaaaaatgaacccaagagctgtcgcatcgatcttgttcgtgtcaaccataggtcaaccaaatagggacgagatcgaagtgacgaagaaattaggtttggagacgaatcaatcagcagggttgttggttcatgcgacgtacgtacgtacacgcatatatatcctccc

SEQ ID NO: 64425 - DNA, 537 bp, Oryza sativa
cacgttcccctcctggttcccctccgcatccctctccatgttcccttcctcgttcaggtactggtttggatcctcgttcccctcttcttcgttccagtactggctgcttccctccgtgattgtatcgtacagtatctgttccttatcgcgatcagccatctgttcatacaagaaatatttgctaagtctgtaggtcatatttgctttaacaatcttatatgctaacaatcatatatgctaagtctaagtgtcgtatattagaaccctagataatcattaaaactgtactaatcttgtattagaaccctagacaatcatatatgctaagtctaattacaaatctaataatcctatattaaaactcaaataatcttgtattaaaactctaataatcttatattaaaactcaaatatcatatatgctaagtctaattgtcgtatattagaaccctagacaatcatatatgctaagtctaattacaaatctaataatcttatattaaaactcaaataatcttgtattaaaactctaataat

SEQ ID NO: 64426 - DNA, 47614 bp, Oryza sativa
tgtcgtgtaagtattgactattgtttcaatctggtcttatgcgagtttgatcgaattactaggctctttatatgtttgttttgtgttaagtgagacagactatgttggtttacacgaggatcaccaatcttaatctggaaatggtttcaatgaatgacatgtcaggctcgccagtgcttaaggcaacatgagttattgagttattggtagggatgaaaacggagcggatagtttccgtccgctccgaacaaaaacggataaggatacctttcagatcggataattgttggatagttcggatacggatacgaatacgaatatggtatcagggtttccgttggatacggataataattcggatatctggcgaacagtgctattcggatatccgcaggacccatgagacataccccatttctttctaactctataaccttcaatatacctttatagattttaatagtagtttaatctcttaacactagtccatactattaatattatttaaattttaaaaaatatttataaattatacctcattttatataaaatgagctaattatatatgttgatatttgtttctattagaagttgagttggttttcgtgttccgagaaaaaattgtttccgtattcgtgtccgatcatattcgattattattcgtattcgagataatccgaatttgtttccgtattcgagctatccgtattcgttttcgtatccggtaaaaaaaatatgaaaacgaatatggtatgagcattatccatccatatacgctccattttcatccctagttattggcatgttagtcgctggtggttattggcatgttagtcgctggtgacggggcgtacactactgcagctttgtacgatacagtgcttaagacataccacgggatccatctccgccacgaaataataagactcaaatagtcaaattttcacaacgttttgccaaattcacaatttattatgatgaatcattctttctcattttctttaggatatatccagcatcaccgatgtggagatgaatgcttgtgtcaatccaatgaccatggagcaagtcattgatgcactatcttgattccctacatcatcactgaccacgacgtctttagcaaccatcgttcgtgcagagagttcgtcttctatgtgctggcggtcgcttcctgcactagtgtggtctgtcatcatttggtcacgatttcgttaggaagtgttgaaccattatttgcttatgtagtggtcaatcccaaaattagaatccgtacgtatgtgcacgtccttctttttagctctctacgcacaaatgcagacatagggtttttagccttgggcatcctgtcacacaacaagtgtgtccatccaatcttatctgcattgtgattgctgcaaaagagaatatctaggtaaaccgttttacacagtgtgccctatttgcagaagctgagatccgaataacacgagggctacgccgacaccagcaccgcgtcgtggccgatgaagttgtaggagaaaaattgtatatttgggactccaaacgttgtgttttgtagatttgccattcctaacatcgacttgtaaaaataggtctccaaacatgtgacacttgatttgcatactattctatgtatttcttctcttttctaatcgctatacatgtatttggcaaccaaaaagacgtatctggcccttctcctccgtcgtgaccgttcacttgtgacgatgagaggatgccgaagagggagttccggaagccgaccatatgccgtggagtgctgtgcctggacgacgacggcgacgagccggcgctgtcatgctgcgggataggttacgcaccatctcacgcacgatatgtttccgaaacaaactctagaaatatttttgggtgcagcaaaactaaattgtaaaagaaatccgcatctgcgcaggcacgagaaccaattttgacggaccattcacgcgcatgtcttgtgcgcgcgtcccccggcccgtgcccaggcgaggtgaggcgagcgagcccacacgtgtgttcctctacttctttcttactcaagtggctagggagtactctcctagaactagtaatatgaaggttaacatgtgtgcttctcatgaggtaagcttttgtgattctctagaaataatcttcatatagaccttagcccacgtattaattctaacaatgcctgactagattttgcagcttagtatggcagcctcatattgaccttttatttaaacacattatgcgatatgttcgcaattaatttagtatttaaaggtgagacatttgtgtcaccatctgtaatttatgtaattgacagtcttacctactaacctcctctcaatttctacacacccgctggccggcgcgctgccggccacggctctatcttgtatgatctgccaccacactacttaaaaagtactcattgtgtcatttaattgagcaggtcgttgagcctgacataacccctcctttcctaggagtatgataagtgcaacggcatcttaaaagaactaagtcaatgcctcactgtcgatggcattgcacacttgctagtttcaaatgaacaaaagtgtctagtgttagactagacatatatgctactccctccgttccaaaatataaggcacattcatcttttatggaaagaccaagaagcatttaattgtgtatttacttgatacaaaccaaccaatgcatgctatatgtatttgcttttatttagtttttgccaatgcatgatgccctttgtcttattcaaaaaaaatgtaattatgaattattttgctagcatttgattcattattaaatatactttgagcataacatataattttctatatttcacaaaatttttgtgatcagaagcgatgacgggcctcgatcgtcctcacagccgatcgaccacgtggttcaggatatggagcccagcgataaactgtacgtgcggagtatgcttctgaacggtgtccaacaactaacagcccggcgataaactgtacgttgcactgcttaggattcctagactccgggaactttgaaccatcattcttcaatagagacggtgtaatcggggtcgggaactttgagccatcattcttcaatagagacagtgtaatcggggtcgggtacattaattcagaatatttatgctttcttcgttcgattgaattatcgggctttatgttctgtatatgtttgttttgtgtgaagtgagacagactacgttggtttacacaaggacgttaatatcaccaatcttaatctaaaaatggtctcaatgaagggcatgtcaggctcactagtactcaaaggcaacaagagttattggcatgttagtcgctagtgacggggcgtacactactgcagcttcttacatacactccttcaggaagacataccaagggatccatctccgccacgaaataataagactcaaatagtcaaattttcacaaagttttgccaaattcacaatttgtttttgctaacattatgatgaattattctttctcatttcagttagccatttgacgccatttagaagcatgttttgagtggagattatattaggtggtgggtagtagggttttacactgtttttgtataccagcagaaccagacatacaaaatgctttagttttgaaattagggcatttccctgcatgctttaggtggtgttaatttaaagtaggatgactattttgttgcccctctccctaattctaagtatattatagaacaaataagaacctaaagtatacttagagcctcttgtaatttagctctacatcttgtgtgagaatgaatgatgagaggggtatttataggtggaggtgccttggaggatagagtttcttccaagcatccaatgagcatcttcatcctcctagtgcaagtgtccattttatgaagttcttccaagcatccaatgagcatcttcatcctcctagtgccaagtgtgtattttatgacggttttcattcaaaaacctaaaccctaaaccctaattgttgccttagggtgtagggtatcagggttttagggtttagggtttagggttcagggttcaggatttagggtttagggttttgtcatgattatggataaggtatacctcctatcctacgacttatgaaatatgcggatatggcataccttcacatacgcggattgttcctgtgtacgccgtaggaatctgttacaaattatggaaaatatctctacgagtctagcgatttccaaagtcctgctcggaggggatagagtttctgttatatcgtacaagatccgatgtctccgagtcttggagatcaagatgatgcacgatataaaagggacccccggggaggggtgcaaggcatcaaatatcatcgccaacacactcgccatagcttacgaagccggagtacacggagctaagtcaccgggagatctcgtcgaatacatcgactacgatctcgtcgatcctcgttccaacgtaccccaataccctaatcatccggtctacgagtatcactcgtcgacaatggcgcgccgggtagtgggacttggtgctcaaggttccgctaatatgacttcaagccatctcgacaacagtaccaacaccggcatcaatcaaggagcttctacctcgacatcgctggtgtggactcaagtcggatctattatcttccagtctacaccgttacaccaatctcgactgacccagttactatcgggaatgagaacaacatggctacgacttcgagaaacgacgtcccgccaacagttcctcccacacaagtggagaacggaacatcaacggccccaacacctggaaggaatcctcaagcggctgagttatgtccttcgcgcagaaacccagagccgacaaggatgcctatccagaatctgagatcttggtgtctcgtccataagacatccaagcatactctggaagattgcctggtgatactccatgtgaaggccgaactctacgcctgctgggagcgtgggattcaacgcacttcaccaacgggcttcacctattgcccggtccataaatcaagatctcacgatctcacaagttgcaagatcttccttaggacattcaagccgccacgtcctcacatcaaacaaccacgaattcaatctcagtgcgttgccgaggaacgagacgtagcaatgactttagatcggttcgtgggttttgtcggtgtcaaccctaacgagccattcgtgctacaccttttggaagattacgagatgtaaacgtgatcaatgtcgctgagacaagtgcgtccgcagcagccagaacgcctgcccaacaactgtggaacctcgatgcgatattgagataaagcccctttgaccttgccctaaaccctgacgttgatcagcgggcaacgtgattacgagagactgtgaccaatctcaatagcgtgttcgcggacacagcgactgagcctccaccgcaagatccaccacgaggaaacggtgaaccagctaacgggaacgcagaagcggaaaaccctattggagaacgtcctccccgtgctcaatcgccacgggcagcccgagatccaactccaccgcgtcgtgagaatcgcgaccttcgcgaacatctggacgactggcggagggaaagacgagatcggaacgacactgatcgtcatcggcgtcgttctccctctcgacgagaagagaacaccgctcaccgttgacactgccaccgtctcccctcacgccaaggagggaacaatgatcgaggaggccgccctaacaaagatcgagatcggcaggcccgtagcgaccgccgagacaacaacgataacaaccatcgtgacgatggtgacaacaatcagcgagatcagggagccaatggtcaagttcagggcgacagcatcagtggcaaggcgacgacgatggacgggaacgcaattcccgatctcccgcatctagtcgagattgaagacgcgaccactgttcgagaagccgagctcccgacccgagcgatccctcgtcctcatcttcgtcgtcttcttcatcggacagacctcctcgacgacatcacaaccgcaggccacctttcgctccaggaggtgggtgcagagcgttcacgcccacattatgagatgtacgatggcccgaaaagtttcgaccaggagcgatcgagaaatatgacggaagtacagacctagaggaattcctgcaagtctactccacaattctctacgctactggcgcagatgacaacgtgctggcaaattacttaccagccgcgttgaaaggttctgctcgttcatggctggtccacgcgtccttgacatgtggggccacgtgggttctacgctgactcacccgccacgtagaacaaaatcggatcaaaatcactgaaggatgtaaagcgaacggttttgtaagttaagggatgttatatatctggttttgcggatgagggacgattttgtaattcgatgacaagttgtgggccctttgatgtactttttccaagtagaaaataaactagtaccataaggatatttatttttattgatttatatggtgggtcccgcaatatctccttctcgttcacctccctcttgtgttgttgaggtgcggtgcgacttgcgattgcgagtgagcggcatataccctacgaatcgaatcgaattccaagcccaccgccggcgatggccatcgccggcctgctactccgacctcctccgtgcgtcgccacgtgcactcctccttccccttccctttcctcacagtggaggaggcggaggctcaccctcgcccagccctactgcgcggtcggtctatccttcgtctccggccgccatctccgccgccgccgtcgtacgggcactctcctactactacaccacaaccaacaaacgattcattgattgattgattgtatgatactaagcgagccttcctgagtttattgtttggattcatttcttcccttcattcattgcgactcatagtatctagttgccttttaattgcactccttctttgtgttattatccgtcaaaagtattcatcatatcttagatgaaaatacccgtaatagcaactcttgtcacaagctctatacagtgcacaaattgggcggcattcaacattttgtcattgttcggcaaaatgcccaccatatgctcggcaaaatgcctgggatcatgtccctcgcatcacctggctgctcgccattctacactgtttagtttcatctcaattcaactctacccacttcttctttcgtttccataactaccattcctacgtgtctcggcagttcgatttcactaacctcatctacaaattttctcttggactggaattagacgtcaacacactaccatctttgtatgaaaaacaggaaagctaaagactaggaaaggaagagatcaggatttcttacccatctaatttgtcttcgccgatataactgcccatctaccttcctgctttacatagctggatgaaggatattccctttactatatttactatgcctgtattcatatcgtgctgttccataattctttgccaaattaggcatctcactgcgtttgtgtttctttgacttcttcaatgtagagagcaaaagaacaagtcgtggaactggtgtttacgcttctttatttggagttggagctcccgaagctctggttattggagtggttgctctgttagtctttggtctcaaaggactagcagaggtaaactctttcccagcaagcctagacatcatatttttgctgttgtccggcttcctattctagctaattcttcactaaaccctcagcattagtactccaaataaactgctcctgaagttattcagggggaagtcatacccaattaatttaaagcactcgtcttgaaatccacattagaaattcatgtatgtcagtaaaaaatcacaattgcaccttgatacatttgcagtgtttggacccctgggttgttgctggttagctccacttatctatttacatttccttcagtcctagactcatatcctgcttctcattcaacgctgttaaaaactaaggtggcattcaaacaagggtcttgacattttcctagtcttgagcaagcacacatttttttcccgtgatttgagcttaagacccgtgaatgtaatgttgtcttcccttgtttttttgttccttgaaacacaaaaggctcggatgataagcctgaggctgcaccttacaccagcgaagaactcatgaaagtaattgaagaacaactagctgcatctgcagctgctgcttggaatactcaagaacctcctccatcacagcaaaaaggttgtgacattttctttgtgccagttcttcaattaggtacacatgttcagtattcataagataaattgtgcagattgtcttatgttgtatgacattttccaactgtgtaaaattctggtttgtctttgccaagttctcaggactctatgctcctgtaagcatatagtagtcctagaacaaaatggaagcaacactgccagtggcttatgtgagcatgtgttgattgctggggtagttgttaaaggtcctagtgactgcacttgtttttgctctgaatttgtgtaaatcgtaagcctgtttcaggggacactcccttgtagtatcgtttttacttacgttgtatctgaaagtaatcgcttacgaatttctggtcaagctaattaacttgattctgctgtgtcatatttcagaagcagcagctacttctgaaagtaatgacggtgctatatcaagagggagtgatggtgctggtgctgcaatgagtgagcccaatcggaacatttctgagaagacggaaaccgagagatgaagcataacgatgtactactgtattaagaccgacgcaagaacacgctgtggaggttggaaagagcggattatgatttttaatttggggagctaggtatgcctgggtttgggtagggagtgatttgagaagtctgatcaggtgtgatgcatatgtgttgctttgctgtgtactagtactagatcgattgtagaatggacggacagactgacaggtgatcgtccctcccttcctccgacctctagttttgctatggatgatgttagaccctgtttatatgtgagtaaaagttttaagttactgtcacatcggatatttggactataaatattaaacgtagactattaataaaattcatccataatcttgaattaattcgcgagacgaatttattgagcctaattaatacatgattaggctatgtgatgctacagtaaacatgcgttaattatagattaactaggctttaaaaatttgtcacacgaattagcactcatttatataattagttttataagtagtctatgtttaatactccaaattcatccgatatgatagaatactccaaattcattcgatatgatagaggctaaagtttagtcactggatctaaacaccaccttaatttgtaggagtagctgtctgtctatgcccattgactatccctagtactactatgtgtttgatcagttgtcatctgcaatcacttgatgagcttgatttgtaaggtgaagaggatataagttaatgccaaaggagacgatgcaagtaatgaattgatggatgatgtgtctgattattggcactgcaggcatgtccagtataggtgttattatattttattattatcactatgatcacttttaacttaaactatcatcgtctcaaaatataagtattttttgacttcaacatagcctcgaagatactactttgagcaacaatatctatgaaagtaatagatagtaatatgttttaaatataaatagttacatactacgatagtttgtttaatgattaatctagtaacattaattttacattattgatcttttttattttttattaatagttaaaattaaaaatgtttgacttagactattctaaaaatgtttatattttgggacagagggtgtatgtatgtagacattcataataataataataataaaactttttatattctggtaaagagataatagtagattttattactgtatttgtttggaaatgtagctataaatttggacgtatgaattgaaaaggtagaaaggtacgctcccatccttggatgcaaaatgaaatgggagtgggagagggccaccgagcagctgagactcggtttggttgacctgaccaccggtcgtcgtcttgggttggcttggcttgctgtccgcccgcgttcacaaggagaggagaggaggttgaggttgatcttgagtgtgaggagaggcgagatcggaaaaaggggaaatcggcgttgcgatgccgaagcgggtggccgacgagatcgcggcgctcccggagccgcgtgggcccctgcgccgcccctgcgccgacctctcccgccgcgtccgcctcctcgccccgctgctcgaccacctccccgcctcctcctcctcctcctcgagtactcccctcgccgacgccctcggggccgcgcgagacctcctccgcaagacccgcgacggcagtaagatcgaccaggtctcttgtcaattctcctcctgctcttcctgctgctgatttcaattctcaaccatcaatctatatactatatactatatgatggatggatgcaggccatgcgaggggatgcgttcctggacgaatttgcaggcgtcaacaggcagattcacctcgccttggatgccttgccctacaacaccttccacatgccccaagaggtccaagagcaggtactcactatattatgcagcccccaactccttcctggacttggacttggaatggaatgtttgaatgtatgttttctcctcatcaggtcgcgctcgtccactcccagttccaacgagcctccacaaggacggatcccccggatacacagctttccatggatcttgcttgggctcttaccgacaacccttccgaccccgcccttctcaccaggatctctcacaagctgcagctgcacaccatggctgacatgaagaacgagtccatcgcccttcataacatggtcatttccactgccggagaacctgatggctgtgtcgaccaaatgtcttccctgctcaagaagctcaaagactgcgtcgtcactgaagatcatgccaacgatgccctcaccactaggtctgcctccattaagcataggtctcctatcatcccagacgagtttaggtgccccatatccctcgagctcatgcaggaccctgtcattgtgtccagcggccaggtacatgtttcttgtagtatattctttccaccacatacattttttcagtccaaaaaatttaaaaagcaattgtgtcttctttttttcagacatatgagcgatcctgcatccaaaagtggcttgattctggccacaagacctgccctaagacgcagcagccactctcgcatacttctctcaccccaaactttgtcctcaaaagcctcatctcacaatggtgcgaagctaatggtattgagcttcccaagaacaaacagaattcccgtgataagaaggcggcaaaaagttccgactatgaccatgctggtctagtctcgctgatgaacaggctcaggagtgggaaccaagatgagcagcgggcagctgcaggtgagatacgactgcttgccaagagaaatgtcaacaaccggatatgcatcgctgaggcaggagccatccccttgctggtcaatctgctctcctcttcagatccacgaacacaggaacatgcagtgacagcactcctgaacctctccattcatgagaacaacaaggcaagcatcgtggactctcatgctatccctaagatagtggaagtgctgaaaactgggagcatggaaaccagagagaatgcagcagccacactattcagcttatcagttgttgatgagaacaaggtaactattggcgccgctggtgcaatccctccactcatcaaccttctgtgcgatgggagcccaagaggcaagaaagatgctgcgacggcaatttttaacctgtgcatatatcagggaaacaaggtccgggcagtgaaagctggaatcgtcatccatctgatgaacttcttggtggatcctacagggggaatgattgacgaggcacttagtcttctgtcaattcttgcaggcaacccagaaggcaagattgtaattgcgcggtcagaaccaattcctccacttgttgaggttatcaaaacagggtctcctcgcaatagggagaacgctgcagccattctatggttgctctgttctgctgatactgagcagacattggctgcaaaggcagctggagtggaggatgcactcaaggagctgtcagaaactggaacagatcgtgcaaagaggaaagcttctagcatcctcgaactcatgcaccaagcaaatgaggcatgaagcagacaacattcatttgtttaaatctgatttgtggtcgtcttatagctgtagcccattgtacacatagacatataaacactaaattgtttctcaattatgttgaagtttgatatatatatgtaggcagattttttaaaagggaatatgccgtaaacgtataaagtgttgtataatttatattgtaacttgctaccatgtacttgataaaactggtaaaaaaatccatgtgtttcagtttgctggctattattgtttcagatctgacgcattcacatgcattttcatttgttggcatttgactgcttgttgagcaggattctttgaagggaaatggacactgaaagttgcttcttcctggggaagctctgtgctttgggcaatgcatttggtggcttcattctgaagtaagttcgatttcagaaaattgttaccacatttagttgttttttttcacagattagtactgcatgttagtatattggtttcttgaacccacaaaatgtgtctattatcaaattgtctgatttaagcaatgagcagcatttctttttcctttttatttaccaaaagcaacatttcttcacttgatgaaaacctaagacatagaagattaccattgcatctacttcactttgtgtttcttaagccttttgctaatgacatccttaacttgtgattattatttaatgaaatcaaacaaaatgaatggtgtcattgccatgtaactaaatctgttttgcaaccaaaagattcataacatgcttgggcacatgtaagttgtaacatactaaaactgctatgttggggcaacaagaagtggcccagttgtctatgattccaatttccaaaccacttctaaaaaatataaatttttggtgcaaaataaatactgacaaagaaacaaagaagacaagaaattgctgaaaattgttgcccgggtgcagcacgtggatcagcatggtgcataatttagttgtagctaatttcaagagatagtgctttgcggattaattacaaaaaaacacgttattggtatgttagtatgaccgtttacactcttactaggatgcagggaaaagaagtcataggaataaagagacagtaaaaggaaagatacatatgcctccatgaggaggacatataattatatatcatcactgcacttgtggtatgtgagaatacacagcacgttgagaccataactaggtgtcgagaaatgctattcattcgcatgatctggtcttttctcggactctatcaatgcagtcttactattcttatttaatctcttttgagaacatgagaggatctggtcgtttatcttgtggcacaaagagctgagtggctgggacagagtagagtgttgggcttcatgcattccacccatgtggggacaattgttgtcgtgctggttgctctgtaattcctgtcagttctagccgaacccatttacagtctaaaatggaagggggcacaatatagtagtagcagataaatgtaacagcacactacacagtataatgagctgggcttgctatggcatgacgtctggttaatggcactagtaaaaatgaactgcctgtgtcctctcaacttttgaatcgtgatgcatagaaaaagttcatcaggtcccattgcctcctattaacaaatagctccagctctctcctcaccacggtatgtcatgtcagtagtagtgcacaaacatgcagccgcaaccacatggccaacctaagcaacgagggcatgcgcatatcatttgcttgcttaatctttcttaactcatctgtcagattgtcacagccctcttgttggagtaataatcaatactacttgtggtgtgatgacacagctacgatctaatccttgtacttaaaacatataagcaagttgggttgaggaagatctaaacaccgggcagcctgcagattcagttgtgttcaactttgtcctttgaccacaactactagctagtgcgtgtacctaatcaagattcttgttacaagcagctagctagcaaaacatgtattgtgatattattctatatatgttcacatgtgatgtcccctgttggcttggtgcatttggtaaaacaaaactactctatattatgatagactatggatactccaataatccacaatctgttgctagggggggtgtcaacttgcattaacttgttaacaaaatacagattaaggtgggagcccggttggagaatcagtggccaagacgcatgcatgtgcatggcgcttaattagttgagttgtagcttgttgcttatggagcaggagtagtatacatggaggtactccagtataaaggaaggtgatgtgattaatttgcatcgatctgctgcaggggtgagccgcgagccagagccatcaggtatttgtcagcagcagccaaagaagctactcgatcagtagctatcttggggagctaagggaggtcatgggtcacattggcgaggctggcggcggcgctgttgtcatgggctgcaaggtgctgccgatgtggagggagagcggcggcatggtggatggcgcgaggaagacgatggtgcatggcaagaaagctgtcgctcgggtgaaggagctcctcaggcgggctgctcagcccaggtcccctcaccctcaccctcaggccactggcgccagcaggtggaaggtaaattcattcaccttttttaattccttcttaaatcttcctacttgtaaagaagaagaaggaagatgataagtatgtgttgcatggatggcagaaggttatgagcttccaggcgagggatagcagcaacagcaaagcaggcaacgacagcacgagcaagctgagtttcaagtgggacgcgggtagctgctcgtctgcatcatcgtcggctatgtattccccgctgtcagccgtgtccgcgccggcgaaggcgccgtcgagccagcagcagctgcggccttggtccactgtccctgatgatggcgagcagcggatggcgcagtggatcaccaccgattcagactgtatgtatatactcctatcatagcatctttcttctactagtgtaccatatatacacacaatatacatatgtgaagaaggatcgaagcaaaagtaacgatgattttggttcatctgcagttgtggtgctggagctgtgacctcaactaatcccgttccttgggatgatggagtggaggccaggcaagcaattaagctgcagatactcatggatggctctcactaatttactgactgactacattcacaagtttagaccgatggaggaggggaagacggaagcagcgaagacagtagtattatttatgaatctcaacggccaagagcagaggctgcagctaggttgctgctgatcaatccatatcatgaggaaacttgaatggattattaaaagtaataataacagaccggtttattactagcacaagaggagagtcatcgatgaaatactagtgcgatgtatagtatacgtttgtgtttcttttttctttgacacgtaggatgtgtttgtgttggttgtcctattggagtgagtgaatttagagtagcatacatgccatgccatgaatcgtttgatcctctctgtttatgttccacgtggatggaggtttgggcagggtactacacgattcattttaagcccgcccttctctgatctccgctcgaaatagtccaatttatttcccaagtgaaaaaaatagatatttcatctttagaaacccgcacttagttgagtactactccctcgtttcaaaataaaaaaaacatttccaaagtttaaattatatattaaaatataactactttatcatttactcccttaccttatcaatcaaaaatcacctcttgtctaatctcttcacatgctttctcattttaattaatgataactcatgaaaaactttagaaatgattatattattaaaacagagggagtactatgcaatcccaaccccacaattctatgtatcttcaagacccatactccaagggtatatggccgatgaaaatgaatgataggaggtggtgatctactctagctagttgtgataaacatgataagaaaaatttctaactttcttatctatgagtgtcgatgctataaattcaagtcaagatgtcgaaaatatcatcgtacagatatttttgtcccgctctttgtcatcactatcagctatgtgttatttggcacctattaggctcttaaagaaaccggtttttaccctagattccacttgtaccatcgcgagtcccctgaagccctaaaattccaatgttgtcgctacaaatcgtgtgcgcctacatgcgcattgtcaccaatgtcgctcagatacccctcctcccacccaagcggattaaccataacatagttgccttccgctagagccgtgttggataggctccttttcaaactaaaagcaaaaaaaaacgtaaagcataagttgtcggacattccaatattgggtcaaacactctgatatagctattgacttttacacactaaatcgcactctaatatagctatatcgaccactcaaacaacaacgcatatacatcaactaactataagcgttgcaactagcaatgcgtcaagaaagtaaagatggaaataaatcatcgagatttgtgcgatgatgtatttcccagagttcaaatacttgagggaattctattgatgcagcaatgggacttcatgatctttcaatgagagtagtataacttcgatttggggtgagaagtcgacattgacggttcgactacaaataccatgggggtgctgcgacttagcaactaatgccgtgccaggaacaaccttgaacctgaagcaatcgaagaacaagtaagaacatgttggcaggtaaacagttcacaacacttgccaaatgaaactgatacacaaagctagggtaagtatctgggcggtctagttgatatgcgagtacaatgaaatagttgaaactaaacttgcatctaaacaaaacccaagttgcaatggtggctgcaaagggtttatataggtggaggaatgataaggagagaaggtgggagaaaaccctagtctttatggacctctaatggctctattgaatataagccagaaacccaagtttctggtgcgaacactattttggttattctgagcagcttcgggtgaatatgatggtgagacaatacatatatgaaagtatacgacaagatcatttaacaagtactcatttgcccccattgtcctctggagtgaagagccatgacctcatattccttgacttcatacaaccatgcccctaatgctcctagtcttgttcgtgaatctggttgctctcccatattcgtaagaacaagtagaccataacaactagttagtagcatccaatttaaagaacttatatgaatagttaggaacaactttacttgatagttaatttcttaagattgagctctagccattcgtccttgctgtgcagtagacatgattgtttcgttgaaagggatgtcctcatcatttactctccgttgagtagctcataaagagtcagtttttttttcaacactagtagacacatctctccactaatataaatagtatgatagaaaaaatcaaaccacattccagccaagctagaaaaaacatatcttgtaccacaccccaaccatttttatttacttttcattttagcattgtcgatctcctgtcgcattcccagatttttttagagatgtctttcctttgctacttttaatcaatgcaaccatagtagtacaaggaattttaatgcttttcttttgggatctccctccatttgacatttttttttcaaaaatcaaacatccttagatttaaatatgtttataaaaaattgacatagcaatacgtaaacatcaaattagttcactaaatctaatatcggatatgtttttatactttgtttgtttcatggttagattttataaatttaattaaagtttgaaagattaattatattaaatcaaaacatgttataatataaaacgaataatcaggttacaacttaaccacatatattggattcggataatcaaattgcaactatactactgagtactacactagccaccgaaccttttttaggaggcatttaactatttgccactcgcagttatgtcatgtggcttctcatgtgtctatgatatataacgagattgctaattggcgcgcgcatgccctccacccgccacgtgtctatttttttagtgatttttttcatgcgtttttccttttttttcacgatttttttcttttatttttgctctttttctgattatttttttaattttcggcacacgtgttttcaaatattttgtgttaaaagtttttaaatcatgacttgaaaattttttaatttggatttgaatattttcaagtctcgagttgaaagttttcaaatatgtgttgaaagtttttgaaatttgagatgaaaagttgaaagttttcaaatttgaatttaaattttgaaaatttgacttcatatatatatatatatatatatatatatatatatttcaatttcttagttaaaaaaatctagtggaaaaaaaaatcttagctactactgttattatgtctaagataagactaatagattagtctaatctaactacctaaaaaagttgggatggctagaaggagctagccatccaatggaattaagataggaggagccacatatttccaacccttcatttaattcaggtgtcatttaatccaggtggaaggtgagtagttcaggaattgaaccttggctgcaacgttcacactgaacgcttgtaccaactgcgctagaagcgcatctctaatctaactatctatagtccaaaaaaaatatgtgccggtagcgcgtacgcgtccactagcaacccccaatacacaagatgtaatgtatctatgataagtgggtccagcgataaatttataattgccacttataatagtgtatgaaatagttaaatatctcccttacggatctcaataaaagtaaagaaaatagagttgagggaaaaaaaagaaaaagaaaaaaagagggcgacccaccgaaccgaacaagaaacaaaactagagaggaactctcccgtcgtcgtctccccctccggctccgtccgaccaatccgccccgcataaacccccgcgactgccggcgccgcatcccctccgctccggccggcccgaccagagagcactgcccactggccactggagtggactcgcgggaacatctgggcgccgccactgatcgatctcctctccgtccgtcctctacctggtaagccctagtttgtttgtttgtttgtttgtgttttcaaccctggcctcaattgacattggcgtcggcaggggcagggcagctaggtgatcgatgccaaggaagaaggccagctcgccctcgccgacctccaccgccagggagactagaagctcctccgctcgtggtcatgcatcaccaaccccaaccccaaccctcaggaggtccacccgagaaaccacatccagattttcttcttcttcttcgtcttccgcaaacaagcacgaaggctcccccgccaagcaaagtgccaacaacaacaccgcaaaacggaagatgaataatgctgccgcagatacctccaccaggccaatcaagaagaacaaaaagctaaacgcaaagtcctatttagcactcttctccacaccccaacaaaccgccaaatcccctcctgcccctggtaggaatttcatctctttctcttctttattaatcgaggaggaaattcccggctgtattctaactttggcaatgtagcccctcctctcctagtccaagtggatgacgacaatgcttccacggtgcctatgcaagacagtggcactcttctggagcatgaagaagctgacacacaagagcaaggttaccagtctggcttgcacaaagttcctgaggtggtactggaggagactgatgtctccaagaacaaagctgatgaacatgcttccacttctgaggtctcatccttcctaggccttaaacccctgagtaacatcataactagatatctgcttatttcagtattacgtgttctgtttgtttatacctgcaaaatctatacgacctctggagggagctactttggtttataataatatgaccaaacacagtatctgccagatgaggatacttactacacatgctcttttctgtttaccacctcagtccctttaattactatgtttcatggctcttagcagcaccctggttctttgaatattgtgttatgttagttccgtttgttttgagagatataagatttgcaactccattgtggtgcactctaggatttgccttatccgccattttgttggagtgacaaattcttgattgcccccatcctagtcattaatgatctttcaagttccatgtgtacaagggaattaaaagcgtaacatgtatttttctacagccacttattcctgttgatctgtgttcaaacgataatgcttctgaaagcagccatgggatggaagtcaaagagcaaaccgtgggatgttcaaagtaatccacttatcactgtgtgaatgctgattttcctatagagttgttaccacttaccatgatgacgctgagcatcaccctttcattttgcagcccatgttttgtaacagatttgccaaataggccttgctccattgttcatcatgaagaggtgatactaaaacaagtctttcagcatctttttctgtcactagcattgtatttcttctgtcttcgttttggtggaacaggaccaacatttttagttaatgttcttttgatgcttctctaggccaagaagacaattgaagcaggtgatcccagagagatcaaaggggcttctacttcaaatcaggctttagtaacccattctgatggaacagattacaacgagtacctgtgtgctgtttgcagaagtagggaaaccccaggaattctcaagtaagtcaatttacttcattcttgctgctccttgcggtgctgttcctttctgttacttctgcagatcctgtccattcttgctgtggatcctgtattggctttccacatgttaaactgttcatgccccagtgtagaaaatatgtggtgattgttactcccattgacagctggcattctgtacagtgagttaataccagtgacaaaacactctcaaactgccaaatgtatggagggcactgtgaccacctgcccttcgtgaggatggagggatttgggactatctgcgactgtggaggttgatccaggccatgtagcctccctcgttggttggttggtaggggctacttctgcctcttttgtaggtttaaaatgaggcagctcaggagatgccaccatgaaaggctgtgggagaggtcattcaagaagaatttgtatgacagaatggggcacaccggcagtgtgatgggatcatgggagtagtaggtggtagggtacgagaaggtggcagtggagcatgagaggagagagggtacgaagatagtccgttggacttgagtgaatagtgtgccctttatccttcatatcttcttctcttatttttttcacattcatgctgtggatataatagttggctttgttagattgtgttttcggcatatacttaatttgtaaggatctcaataattttaaatcatcgtttcttttttcaatctggtaacaggtcttgtgatggaaaagattgcaaaaatcggtaccatgattcttgtctggatcctcccctgcaatatgtgtcgctaggtatctggttgtgcaccttatgtactaaaaagaggctccagtttggtttatttgcagtcagtgagggcattgaatctttgtgggatgttaaggaaggtaagtactaaataaagcgacaaaacatatagatagatatcttgaagtgtaaccattcatttattagttctattactttgtcaccctaggagtgcagaacaacaagcagtattttgtgaagtacaaaaatttagctcatgtacataatcaatggcttccagaaagcgatataattcgcaccccaggaggtcaagatctaatcaacaaattttgtaagaggattcaaaaagaaaaggtggtctctgtgaattttttgttttgtcatattagaagagactattaggttctgcaagcctactgatgtttgtccttttcaaatgtggtttcttagacaataaggtggaagcaggaatgggctgagccacaccggctattgaagaaaagacctcttatgtctgaaaaggaagctgaagaattttttaattcacttggtgataaatttgcttactgtaatgtcgaatggttagtgaaatggaaagatctgggctatgagtatgcaacatgggagcttgagacttcatcatttttatgtacccctgaggctaaggatctgaaaaggaactatgagagccgccatgaagatgcaagaagaggttttgatcctgcaaaaataaataaggtatacctctgagaacagttatccacattaactgattcaccattgcttaattggataaggatcacacatatcacctgtacatgctgatctgctgcatgcatgcatttttgtggttgtccacctcataaaaataatgatgtttgtaaatttttaataaactattgacttcttttcatagtcatgtcttatcttcatgtcattttattgtacaaattcgaccagttatggccggttgattatcagaaattgaagctttataattggttctcaatcaactttgaatctataccaatgatcttctgtgctgtttgttaaccttgtctttctcctttcatgctacattttgcacttctaattcttcagtgatttaattcttattctacatgaaacagcaggtgtatttctgactgagttcttgttagattcttcgtgtcatttaccttatataaacccatagtctcctagaatcattttgaattgctaaaatttggtcggacaacttttttgtacttactccctccaaccaaaaatataaggcctagtagctttttacattgtctccaacattatactttgaccattaatttcttttataatatatcaacaactatgaaattaacattatgtgaaagcaatttcaaatgctattcgaatgatatcacattcaatatgcatgaaattaaacatgtgttttgttagttcaattattagtcaaaattttcagatgttgattttcctaaaaataaggatgccctatatttttggatggagggaataacattttgctcatgtaacttcactggtatcattcggttactggcattttcttagtttgtttcatgctttccaagttagttcattatgggcctgtttggcatagctccagctccaactccacctctcatggagttggagctcagccaaacagtttcagctccacctaaaatgggagtagagctgggtggagtctctcacaaaatgaactagagaggtggagctgggtttaggcagctccacaactccactccagacccaactcctagagctaaatttaggaattggagctctaccaaacaggccctatgtttaaatccatatattcattaggactgtttgaaatgtgggaacccgcagggagatacactctttcctatatgactatatttgaaacatgtcttagactggtatatctttctatgattatgcaggtttctctttaaataactcaatgggggtgttttttcttaaatattaacagtttatagtgtctttggtgtttacagggtaagcaatgtctgtttcagaaacttcagaagctaccggatgggttcccccctggtttagacaaagatcatttgagttcacttaaccggctccgcgagttctggcacaattctgatggtgctatttgtctcgatgatcaggtagtactctctgaatgttttagctgctatgcacaagaactgatatagcgtttactccaacttgggttggcttccttttttttcacccacccacttttgtcagttcttacttcttagttataagtatatagtggactgcatggctaaatgctgtagtgcccttgacattttattgtggattctttccagttatgttccacatctgaaggtttaactatgtaacttatctattgactttatacaggagagagtaatcaaaaccattcttttttctatgtccatattgcctgatgtctgccaaccacttctcattgtctctacttctgcttctctctcattgtgggaagctaagttcaatcgcttggcaccatcgatcaatgttgttgtgtataatggggagaaagacgtacgcaaacagattcaagatttggagttttatgagaacggtttggtgacgtttcaagttctcttgtcccatcctgatgccatcctagaggtacttgtttctcatttccatcagcatcaaaacacatcaatgactactcttgttctcatttccatcagcattatccaatcatgaaagtcagctatcaagattactcacatcctatttctttccttttttccactgtaatacaggacattcagaccatggaatcaattgtttgggaggcagttatggttgacgattgtcaaagcttgagagtttcaaaatgccttgaacaacttaagcatctttctaccaattttaggatggttcttttgagtttcccactcaaggtgctgttagcaaccgtaacctgtagaattattttcactctttttccacaaacaggcaatgttaattccttttgttttgcaggagagtattcctgagtacatcaacctgctgtctttcctcaaccctgaaggaagtgtcatttcgagtagttcaaatggtgattttactgatacaggtgatatcttagcaacgctgaaagaaaaatttgctcgtcatgttgcatttgagcggaaagcagattcttcaaaatttttggagtactgggttcctgctcgtctttcacgagtgcagctagaaatgtactgttataccttactttcaaactccccagcactccgatcacactcaagaactgatagtgttggtgctcttcgtgacattcttgtatccctccggaaggtttgctcttcaattttctgagcacaatatattgttttaattcatggcagggaattagatagtctagatgatggaatctgtatgcaacagtttcttctgacatagctgctgacacaatatatccttgtttcttctggcacagtgctgtgaccacccttacctggttgatcaatcactgcaaagctcacttactaagggccattctctgactgatattctagatattggagtgtgtgcaagtggcaagctactgctgcttgataaaatgctccaaggatcagaaaccaaggccggagagttctcattgtttcccaggcaagatactagataacattcatccataatgtttttacatgctatacttaaatccaaagttgtgaagagtgattgcttagtacataagtccaaagtttactttcctcaaacatatttgggtgttttcttatcatttccaaagatagtcattgctatgcgcaattattatcatctgagaaaaatattgtgagctgtctttaatatgcacgttttagtgtcagggcttaaccactcaaattagggcagtatctgacttgcctcaaatgcaacatcaagggctgcataaaaaccttacacgatttaatacagtcatgcagaacatgtagggctggtgtctctctctataaaaattcttagggctgtagctggggtagaatgcagttgtttgcttgagccctcctgttcatattttatactagaaacaaaggctcaaaccatgttattctagcttgcacactccatattctgcaggaatccaggtgttggagctgcaccatatgaaccctaccaaaaagaattaaataagttactgaaatgtacaaagtacaaactcttttaggagtatatacttctttatttctaattgaactcattatttcgatatgctttggttcatcacttatagaacttaagtgtttggcattcttatatttttcttccaaagtatgtcagtccaatctggttctcctttttcttatatggcagtctggtggcggggctggcaaccctatgggtgacattttggatgattttgtccgtcagagatttggttttgagtcatatgagcgtgtagaacgcggattgctagtgccgaagaaacaaacagcactgaatatgttcaatgacaaaactaaggggcgttttattttcttgattgatagtcgtgcttgtgttccaagcattaaattatcatctgtcgatgccatcatcatatattgtagtgattggaatccaaccaatgacttgagagttctccagaggatcagtatagagtctcaatctgaatgtgtgcctatttttcgcttgtattcgtcttgtacggtggaggaaaagactcttatactgcgaagcatgatcatattcttgacagcaacgtccagaatgtaatgcctatcgtgagccattccctgcttagttggggtgcatcgtttctcttcaatagacttgaggagttccaaaagcatgactactccagtaaagattctgaggatgatggtctcttcatgaataatgtatttttggagtttgcagcgaaactatccaccaacgttgaagccagcactaaaatggaaaatgcagtcatatctcgagctcagcagagtggatcgttttattctagagatattgctgttataagcgagagggagggaatatctgcagttgatggtgatttgccaaagttctggaccttctggtcaaatttactaggtgggaggtctcctcattggcaatatatatctgagccagtgcaaaggaaccgtaggaagatacaaaatatggaagaccaaatgagaatacctgcagaagaaactgatgaagcaataatgaaacgtagaaaaatcggagaaatcatggattcatctccgaagatcctacctgtcaaagacaatgatgctgtgctgcctgaaaatagtacagcatccagttctcatgaaacatcagttgatgacacttggcaagagctaggtattccaactgtaacagtaattaacagctcttatgctttatgtgcatatgctacatttttttataatacactccattttgtaggggcagaaagccttcagggcacacagaaaggtcttcacacccaactcaagccagagctgtcaaagttgtatgaattgttggaattgccggtactgccaagtatattaaaataaatgcttgctttatgttattaatttgagaaaaatattttagttcactgcaagtacaggacataatctgctcttttagcattcaatttaatagctaatattttttagttttcaacagcagagttccacaccttgtgaagagttatttatcaagttggatcttgataacttttgctcttcataacggaaacattttctttgactcttagtgtgtcattttgatccatatatgttacttcctccgtttcacaatgtaagactttctagcattgcccacattcatttagatgttaatgaatccagacatatgtatgtgtttagattcattaacatatatatgtatgtgggcaatactagaaagtcttacattgtgaaatggagggagtattagttgctactatatcctgcttttagctcaggttatgagctttgatatcacctactccctccgccccatagaaaaccaacctagtactggatgcctgtctagattcgtagtactaggatgtgtcacatccggtactaggttggttttctatgggacggagggagtgcatgtttctacatgcttccaatatgaatttatgcaggacagctgtgtcctgcagtcctgctgttaaaaagttgcctcctcttctgtagaatttatgcagcatgctgttaccctaagtttcagtttaagcgaacttttcctgaagtcacttgattctctagttaaataatataagctgattggatgcttggatgcttgataaaaccttttgcaggagactgtcaaatgtttatgtgaggaattacttgattacattttgaagaatcatcaagtcagtcaggagccaaagggcatattgcatgcattcaacattgccctgggtagattataaaaatattttataggttttttagctaaatttgcatggctaaatgctattattttttccatgtgcttttcagtgttggcgtgctgcttctctcttaaagcataagatcaatcgaagagagtcacttgccctttctgtgagaaacttgaactatgagtgcgatgaagtgctcgctgaatatgtttatgagaagctaaggatcctcaagaaaaagttttcgcgtagagcaagtgaaacaagcaagcagagccaatctactccagtaaataacacatcatcttacaaacaacagacctcaccgaaattgagaagtgacggatcaatttgtcatcaggtaacgacaattgatggtgatttggaaaatgtttcacatgaagaggctccacatgatatcttgaccgaggagatgatattagaacagaaggaattgatatctgttctagaaactcatagagaagaacatgttttaagggatgaacttcttgaaagaatcacagagaaaagaattaatttaattaacatggttttctccttaagagaaaagaatattcaggataaacaaggaaacgagaccacactgttagacatgcacaagcaaaaggaagtggcaaagctgcaagaaacatgcaatttggtcgtggaacatcttcgtaaaggtcacattgattcagaggacagggatgccacggtgaagctaataattgaatggtttactttgcttctgtatgcatttttgaatcacatgagatgccagcataacaagttgaagatgcagcaatcaacttcatggaacaaggagttacaattgaaggaaattttccttcagcaagcaaaatctggccacttagatcgtagctttgatcaacaaattcctttaccagattcatgctttactttggaagaattcagccacttcaaggaaatagttggtaatttccctgtcggtgcagctacttcagcaaattgccagcattctttggcatcaaccatggaaattgcattggtccggagtgtcagtccatctgaagttgggaattcagaagcagcgataaatggggctgttgaagttcctgtccacaccgaaaaaagaccaacatcagaagttgggttgtcgcagaacaggatggacaatgattctgatggcattgactcacaaggagggccacctctggctgttcaacattcattaagttctaatcctgcaattgacaattccaataatttggtatgttgtattttgttcatatgccttctttttctgcgtgataacgtatcgtattctgacttgacaacttattacatgcacagctagtcgacatttattcatttaagtagttgccctattttatataaaaagattaaattgcctggacactatatattagtaggaagatctagttagttgctctgttaatctgtccagcatggattgaacatcatgctaaccgtatatagtatgtggcctttgatgcatagcattctcttgggcattattcatttgctctatccattttacttgaatgcattctttagttgtggacatcttcagttgatgcagctggtacactttgtctttgcatgggaatagtggttagaatatttcattcttttttaaaaaattaatggcacctcactacttttgtgaaattttgtgctgtaaatatcattgtacactatatttattttgtttgttgttatttatttcataaaatatataatgccagaaacagcacgttgtaaaatgttgtccatattatatcaggaatcttcagttgccagccatagaagcgaacatcttggggatattgcagtggaagttaatgccgacaattgtggcactactcttgcagattcacctcacttagaggcaccaactgtggctgccctgcccagccagagtgccttgccaatggctatggaagttgacattcagacagatcatgtagttcagtctgcccagcagaacatagtgacaggacgagttccacaagaagaagagcgagaaggttcgaccactgtaacatcagctcagcctttgcaacctgaaatgcgaccatcaagtccagtatccggtattttgcgtgaaagaacaaatcctgatcagaggagggaaagtcgtcagccagaggctgcacctagttcggtggatccaacacaactctttcccgtggcatcactgatgtttaatcacccaccacttggcaatgaaccattgaaaaatgagctgcacagattacaagtacacatggattctcttaataaaatctacgaactgaaggtttgcatatttctccctcttgctaatataccaactgctcacactattcccagattcatcatagtttcatcaattctgcttttacctctggacagaaatcacaacttcaaacggagtgcagccaagaaatcgagaagataaaacagaagtatgatttgttaattaaagaacaagactccgctcatcatcagcacaggaagacactggatgacttgtatgggaaagttctcctaaaccaatcactagctgatgattttcgggtcaaatttgtatcaacatctgcagctcaaggtatacttgatatcttgcaaaaaaaatgttttctgatattgttagtgtggatatgaaacaatctgggccaaatttctgctacaacattatattttgataatttgaatttttcacaaaaaacgaaatagatctcctacaagccattgtttgtttttgaatttaggagatcatatcgcttactgtgccttgatgatccattctcttgcttatccaaaggagggcctaattcgatcctaaggtcaagtagtagtaagtaacctatttgttaagtcggacccaagagctaaaagataacctcttccttattatgattggaaggaaacatcaaaactacgttaaaactgagcgaatgcattccgttctacccctcctgttaatgtaggcctttccctgggagaaaggggcatggttgttctggatttctggtcctatagtggaagaataatttttcacaatgagataatgccgcataggaattgagcgccaggaaatgccaagttcatttgcagtgcttgacagacctagtgttttgcacaatgaataagattgtgcttaaaaaagatttgtaaagaaaattattgtcctggaccgagttgttttctgtagaagtattgtttgttactaatgttcactctatttggactgcagccagagccgtttctcctccactttgccagacaactcgccagacagctggggtatctcagcaggtaccaactaggccttcggtggctggatcgattgcattgccagtcggttcatcatcagctagtcgaccatcgctgcagaggcattgtgctcaaccatcgcatgtggatcggtcatcatcatcgggggggagtcattcatcatcgccatcttcacaagttgtacgacctcccccagcaatactaggcagcgttgtcagggcaacatcaactccttttagtcacacacctgcagcccgtggaaactatggagttgggagtgaagtagcacgggcaccagctccccatctccagttcaggctgccacgagcacatcccacggcccctgtaaatcagcagcagcggcagctcccagttaggctagagagcacatgttcaaggacacagttgactcctgtgagcaccccagtaaacgcaaggcagttgagttcacaatcagtttccccggtgagcaattcatcatcatcgtcaagctcacatccaggtccagcactctcaaatccagccttggcagcaaattcaagttcaaatccagttttgagtgcaggcacagtggcattgccgccaagtccacacccacccgagtcgatagcagcaccaaggggacagcaaaagggggcaccgtcaggcttgaatacagtgcctgttgtaggctcgggtttgccgccaagtaggtccatgtcagattcggtgtcgctggatgcatggcttacatccaatcttggtctgaaggacggtgaaaccagcacacctcgcactcgcatggatagtcatcgtacagtagatgtggtgtgcttgtccgatgacgaaccagaagagcactagagctagagctagactgacctgacttttgtagtacagcagtattttcttggaatgccattttttgcctgcctggcacaaggagctgaatttggccggactggtggcttgcatgtatatgttgttactactagtttgttattagtagtaccattccattctagcttagcttgtaagctgggtgggttggggttcccttccctccaggccttgtgcagcatgcctagtaaggtctgctagggtaacttaggttgttgtaaatagtactaagtaattagtactgtacaagtaataacttgctaaccagccaaccaggaagtgaattaagcatggtggtaatggcctccttggttgcttgattggttgtagtcgacgaccttttggtttactaatatacttgtgtccttgaatcttttttttgttttatttttgaaagggtgtactttagagaaagactacacaacggtataccgttgaacggtatactgcttatcccccatgccacggccccgcgtgccggcttcttccgagtatgtcgcctgctgctaggattatcatcatgcacgtttgctgtgtgtatcagtgtatagtcttgttcctgacagctagctagtacccagcatgcttgtcctgcctttgataaatattttatgtatatgataaaagtaacttacatatgtaataaaagtaatatacaaatataaatattttttcatcgtaatataatcatgtaagattttgttctgaagatttaattgcaacgagtacaatgatataatcggattatagatcggataagtaacttgagagaaaacttcataagaagataaaaaagacatgtataacctaatagcaaaaaaatagttgcatatatgtgaggtgcaatagtacttctcgcacgtattgcgctgtcgcctagcaggagatgtctctcgaaatagattttgcgcaatttaatatatatttttttagacggagagggtaatagtcgagaagggttgagagtgaaaaaaaaaaggtggaaatggaaaatgaggtgggttgcgagtgccagctgtgcggtgggcggcgtggcgtggtgttctgcggcgcccacggcgggcgcctctgcctccaatgcgaccgagccctgcaccaagcccacggcggggccggcgatcacccccgcgcgccgctctgcgactcgtgcaacgccgccgccgccgagctgcgcctcaacgacggggccacgctgtgcgggccgtgcgcctacccctacgcctacgcctacccctacacatacacctacgtctacaccggctgccccaccccgctggagatgatgcgcctcctccatgccgccccgccgccgccggtattcagtcaccctcatctcttctctcatctgaatttggctctatagtttcctgcagtcggcaggtccaggaaacccgatgctggtacaataatgcatcatatgcagccagctacctgcagtttacaacaacgaggagaaggagaagagctacttccaactctcttatctgcgactgcgactcctaatactgctactgctgcgccaatggcaatgccacccccaccactacaacaccacaccaccacctccctcatcatgatgataaggaacattcacaagcgggaggagaggaacagagccaagctcaggtacaatgataagaagaagacgaggaagtacgtatatatatactctacttattactacttgcaagtgcaacaacccccaaatgatctcatcttaacataagctaattaaattaaattgatgcaggttcagcaagcagatcaagtatgcctgccgcaaggccggagccgacgcacgaaagcgggtcaaaggccgattcgcaaaggcctcttcctcctcctcctcctcctcctcctcttcttcttccatcgatcatcgattatgataacccacgctctcaactctcaaccacatttcctattcaattccacatcccctatctagcgatcattctttcatcttctggaccttgtgttccgtcatgaccagcaataatgacctagcaacttctcagtgcgcacactgtaaataaaatcttcccacacctgagtcatcccatccctgatttttttttttttgagaatttccttgattgttttatgtcccctatatacttctgcctgtcctttttctttctcttctttagaaaaaaacaatggaccaattatattcttgctccattcaaatgatgtaataatccttgtattcagtttaattagctcattgatactcctatcctatgttaagtcccagcaggttctgaaattcaaaatctgcaaaatcatctgccctcagatcgatacgtgatgagcttcctcatttcggcatcatcaagaaactgcagcctgacgatgctgatcactactacttgattctggacagttaacttgttttgtaagcagcagcgcagttttggttaacggactatcttgtctctaatcttgtgcatcagacgtacttgagttaaatatatgccatcctgtcaagtcaaagttagtatctgaaatctattagttacttgatcgggttgagcacatgcagcttcctttgattttcctcttcctccttttctgttagtacatttttacattaggaattcgtctacgcaacaactagtagcctttttttttaggccggaccggaacaagtagaaagaaggggtgtgctgctattgcagaatgcaggtagtctccaggcacattccctagttcgttcctaaacagtgaaactggcaccattcatcagattcaaactttggctgtttgtcttttttagaatatttaagaagcttgaaaacataagatattatattatttaagtatgtaatgtcataaataacttttattcgttataatataattattcagaaataatttgtgatcgaagtaagatgagtagatgatgataataattaacagtcaggttattcgagaatggaagaaatactctttcctcgactcatccgcttttgtacgtgtatatcaataaatatactttctctgttttacaatgtaaaatgtaagtcattctagcatttcacatatttaattcattaacattaatatatgtctagattcattaacatcaataaaaatgtagaaaatgctaaaatgacttatattatgaaacgcaggggtagtatataagtgctaacacgattattatgaatggtcttcttgctttcaaaatagaatacccagtgatgctgatgctaatggtactaagtcgacggttattctagaattagttggatcacatggagtactatttagcagccggaggcataggcaggctcatgtcagacgtgacgactgacgacttgtactagtaaactgtagaacctgagcttccatttgaaaattcagtcaatcaacgtgtcaaaacctgagcttcagcctcaagtccactagtattccctccatgtaaaaaaagcttaaccttgtgtactagggctgcgttggagagagtgagtttgtttgtttagtttttcacgcgcacgtttcttaaactactaaacggtgtattttttataaaaaaaaattatatagaaaagttgttttaaaaaatcatattaatctatttttgaaatttaaaatagttaatactcaattaatcatgagctaatagctcaacttgttttgcgtatcttaccaatctcctcaatccccttctcctcaaacacaccctagatgctgatacatagtagttaggggcaaatcacaaaccctaagaagtaggagtaaaatcacaattgaactagaaagtaagggcaggaacacaattgcccctagtagttactactcctacgtactaatattatgaatttgaaccgctgtacagatttatagtactaagatatattaatatttagtatgaggttaaattttttttgaaacggagaaaatagacaagttaagaatcaacatggaaaatgcatatgcacgcaccgtgcagtaacagtagtaagtagagggaaatgtacttatatgtgtagtgtagtaatatgctctacagttttataatgggtgaatagctaatttagtcccttaagtttcaccgaaggcttaatttggtccttcatgttttattttgtccacatagctcctccaaatatttgttttgacttgaaatcatccttggacccacttaatatgttatatggctatttctagtcaatatttctattaaaaaaatgtcttttttgcccttaatttgcatagaactatatactagaaaaaagaaagtcaacatgaataaacaacattacagatgtacttcccattatttcaacatgtgcacatgaaacttaagcaattactatcgtatacacttgctagtacataatttattttcattttacatcatatactatgtattatctataaaaaattcaagcatgcaatttttctcttatatatgtgaatgatgaggggtataagtgtcatttatgaatagagttgttggtttaaggataagtttgaactaaaaagaaaactcgaaggactaatatggatagattgaaacatcaaggactaaactgagtctcagatgaaacttggaggaccaatttgaccattcacccttttataatactgaaattgacttgggaaaccatttcttcaacgactataaaattggtaacaataaatccttgcagtatttgacattaattcctttttctttcttgtttgtgagtaaaatattgttgggccaccaacccacagcttacattgccttgtagactagtactagtataaatgaatgggatatacacgtagtaataatccaatccaatccagtaatatcgcaaattaagcagcaggtgcaggaggatgtcgtcggcggcggcggtggtgcgcgtggtgtcgaggcgcaccgtgaagccggcagcgcctcggccgcgggagagcatccccctcacctcctgggacctctccatgctctccgccgattacatccagaaaggcctcgtcttccccccgccgccgccttgcctcctagtcgtcgaccacctcgccgccgccctctccaccacgctcaacacctactaccccgtcgccggccgcttcgtcacccacaaccacccggaacctgaaggcggctgctccgtctccatcgactgcgacggccaggcgtccagatcgtccacgccgtcgccgatgccgtcactgtcgccgacctcctccctcccgacgcccacgtcccgcccctcctccactccttcttcccgctcggggacgccgtcaactacgacggccaccatctccccctcttcgtcgtccaggtcacccacctcgttgacggcgtcttcctctccttcgtctacaaccacgcgctctccgatggaaccgcattctgggacttcctcaatgcgtgggtcgagattgcgcgcgccagctgcctcgccgcgcccacctcgcccccacccttgttcaaccgttggtctccctctcccggagacggagccccggtcgtgctgccgtacgccgacctgtcggagctgatcgagaggctgcagccgccgctgctgtgcgagcggatgctacacttctcatcggagtcgctggtggcgctcaaggagcgggctcgccaagagctcctggcggccggggacacggcgggcgcggccgcgctgacgaggttccaggcgctgagctcgctgctgtggaggtgcatcacccgcgccaggcggctgccggcggagcaacagaccatgtgccgcgcggccatcaacaaccgcgggcgcctccagccggcgctgcccagggagtacttcggcaacagcatctacgccatcagcacggagaaggtgcaggcgtcggagctggtggagcgcgggcacgggtgggcggcggcggcggtggggcgggcggtggcggcgcacacggacgcggacatcagggcccgggtggcggcgtggaaggtgaacccgataatatacacggcgaggtacttcgacccgtcgggggtgatgatggggagctcgccgcggttcgacatgtacggctgcgactttgggtggggaaaggcgctggcggcgcggaacggcaaggccaacaagatggacggcaaggcgtcgctgtacccggggcgggagggcggaggaagcatagatgcggaggtggtgctcactccacaccacatggcggcgctggacgacgaccacgagctgtgggccgccgtcacgccgctactgctcaacaacaacaaaccttgaagcttttcttcctcctccttcctgccttaattagtgcctgccttttcttccaaaattaaataataaaataagaagctttaagcttttccttccgatgatattgtttcccgtctctgtctcaggttttggtttccttagtgtttgtttgcttgcttgattgataatccagcatcaacaaacaaagtaaagatatatctattcatgtcatgacatcattccagtgaggatgcaatgcacaacaccttcttcttctttttttcttttgacgtaacagaggttgcaaacttatgggttcgtgtctaattcattatctacaaaaactgaggttgcaagcaaactacatagatactgtattatcttacaagtaccaaatcacttgagccatccagcattatcttcagttgctacacaagaaagattggtttggtttccttatacaccaacaccacaagtatgcacatatgagaaaattgatgttctggactggaggaaaccctccatgcgttcagtttgagaccaagaatttgacaggttccgctctaaacaccaaaccaattattatatcataggtccaaaaccaaaaccaaaatagatcaattttatctatctcaactccccacatcaatctgtatctcaacagaggggaacatgttaacagtcccaagttgcgaatgtaacatcttctttccggcggcatgttaatggtacctcacacggtgtccatccatccattcattcattcatggtgttacaaacacgcctgtactaatctgcctacagtgtaggcaacctcttattgaaattgacattcttgcttctgataatgctatacccacgattgtacagtacaggctgctgagcattattgtctttacttacacggatctggtgaatggttcagttacagcctcacaaaatatacacaagcacagcatcataagctactaaaactgatcaaagctactttctgcatggttcttcgctggttgcccctccattgtcatgtgagaagtgggatttcaatccaatccagcactggtagtaatcgagatcccgggatggggaatcgagggcccattggcaaaccctggggatgagtgcagactcgaacatgaatgcaagcgtgccgcttagccttgatggctcattggcatcaggacggctgattgttgcctgcaaattgatgcaacacaccatgttacaaacacatcagcagccataccacctacaaggaaggaattcctccctaccatcggcatgactaacctcgtatgtcttggtgtctgggccatgaggtgtcatgcaactgtgaaggctagcacctccaggaagaaaaccatcagctttggcctgcataagttcagaaagatgagttctgatcatgactagcttagtcaatacacaccagagagaaagagcagatgctagcgaatgatcaggtctgacctcgtatattccatagatcaatcccataaattcactcatgcaattgcgatgatagtatggagggcgaaatgtgttctcagcgaccaaccatctaggcgggaatatcacaaaatcaagcaatgcgacaccaggcttatcagttggtgcagtcagcactgaaagttgaagaaatatatcatgtaaaatccccctcactgaattgaatgaactatacacattgtgttttaagataatgtaatacaactattatcattgtgttggtcgtgaaaagcaatcacctgtatttactgatggatcagcatgatcgaatagaacagtgttaaatggacagaatttactcaggtcgtactgaaagaaagaaagaaaagaaaatcagatcatatgcctctacctgcaaatttctgcatagaaagaaaggaattaacatggctagataaaaaggtttaccttgtaagggacataatttccatgccacgctaccacattaaatggagaaaagtcctgagtggcagtgaatagctcaccaccatatttctgcacaattgtgtatcctgggcggtggacttgctcaaaccatgctgttggggaaaggaaatcccttgccgaagccaagccatttgcacctgcacaccaaccggacatcttctagcaacataaaccttgtatgcttacactgtaaatatttttctttttttttaaaaaaaaaagaaacaaatgcagaaaggttgaaggcactggtattaccaatcgggccaagatcagggagctgaaagtgggtaccgaaaatctcagaaacatagccacgtgaaggaccatcgggcaaatcaacagcaaagcgaaaaccctggggaatgacaacaatttcaccaggtgggactagcagcttcccacattcagttgtgatcaacagctctgggcttgatagaaaaaggaggaactacggttagcatacatattcctgtagaaggtaggcataactgaatggaaattgcattaagcattatactacttttgaagcatggtgcttgttttcctttttttttttaaaaaaaaagaagaaggtacgttaacaaccacagacacagagtggcacaagtggagcactggaaatgatgaagattgaataattcaggggagaagagaaataatgtcattgttcatatggtggtaagcaaggcaagtggcaatcatgttgtggtgtggaacaattgataactggaggggaaaagtgtcatgaggttaattaatagtacagtagtgggttaatttgcagagatgaagaaggaagggcagggcaggatagaagtgaagaagggaatggaagatactacaacatacttccttgctgggggacaatgaggaaatcgccgtcagcgttgcaaaaggcgcatccgtccatggacttgttagcagcgtacctggagcaagcaggatataatggattgaaagaaagtagaatcagcatggatatacatacatacatacatacatacatacatacatacatacatacatacatgtggatggcgtatccgtggcgcaggaaggagctgccagcgccgcagacggtgtagaggccatcgatgaaatcgaggggaggatggtgggggggcacgtcggcggggcgccagcgcagctgggtgggcgtggcgacggtgtcggtggtggtgcggtcgaaatccccaattaagcgggggtgggcggggcgacgggggtggaagggctcgtgggtcaccgaaggcttgatccggtacagccatctgcatctttctttcatttgatctgatagaattgaggaaagattgaagaatctgatagaattgcttacgttcggaggttgcgggcgcgcggggcggtgaagggcgtgccggagagctgctcggcgtagagtcccagcgggcagaccagcgggctgttctgcccgcgcgggagcgtccccgccaccgcctccgacgacaagctgttgcccagccccgacagatatacgtactccaacccccccttctcctgctgctcattctgcgccgcgggggttgccgttgccatggccatggccgctggccggaggagagggagaaggacaacacaactgcttgtctcctttcagtttcaggaggcttctcctctcctgtatctcactcttcttctcaccgtctgtatatatcctccaatcaactactcctcctaaataaaaataataataattactctctcatattactactacatactagtagtaatctaatactgattactaacacatattctatgtattagcatctcttctttatcaatatacttttaccctcttctaaagaaaatttgttctgtattagcctctcctattagggggaggagtattgttgcaagacgtttgcttattacaacacaacaattttcgcaactccgaatgtgcgtagtgtacaacaagaagaagaagaagaggaggagcagtttgtcttgccttcacttactcagacagcgatggattggatgccatctccacgtactaagtatctcttatcttcttcatctaacactgaccgttctaaactataagatctatattttgtttataataacatattttgattattaatttatttcatatttatattattaataaatgcataatacttagcatttactattgttatcattattattattattattaccgagttgaattttttaaaaaagtataccctataattttggactactactgaccagtcatcctaatcttctcaggaaactggagtagtttgctgcctctgcctacttaaaagaaaaggaaaaaaaacaagtcaacttaacccaagctatgatgcacagatgcacccctatcttgtttcttggtggaggagatgcatttgctgaagctttagttgtagtatctcgcggttcaaacagacatgcagttcagcaaataaaacttgggagtaccacctttgtggtaactggtaagagtcaaacaaacgacttgctcttcaactatcgatcgcctgcaggcaagcaggcctcacggacacggaggctgctgcggatcagggcaaggagtgatacaagttggcaggtagacacgcagaggacggaccacctcttctgctgggacgttgtccatccaactttagtatcaccgatgcccatgaccacttcgattgcgcaattctagctatggctcaacaggatcatcgcttgttcaattaatgatgatccattatatatgttcaatcctgatgcatgcatgttacagtcaggctgctcaagcagattgtttgtttgcagcagtatctatgcaatttgcgtattttagtgagttgagtattgcctcttaagtggtctccttctcctcttgtaaaggtggcttgagctgagcaacaacaactcatcaacatcatgaatgtctgcttcagggtcccccctcctagccatccaaacagaatagataaataccggtcaatccccctgggcaacacaaaacaacccatttgatgttcctcaacagcttctgtacaaatcaagagatcaatcaatcaagcagcatctcaccaacacaacaaacatatgcctggtgaacaaacacatataacacagctttgttaaacatgcacgcaaacattgcagctcacaacaaggtgtagtaagacatcccagaaatattcttcatcgtatatgtagaaccatcagcgacacaagatccaactccataccattaaattgacagaaacaagtccactaggcttgccaacatttagatttaggtaccaccggcaacatcaacacatttcataaaccaaacctaatgatagaacaggtcttgcacaaaagcatcagttgaaccttcccctgtacataagtaataaccagctccaaatcttttcaatagctttccaggataagatgaacctactgctaccgctgcatcaaaaatctatgtccacagcccgagagccaatcaaagtctaagtagtcaatcctcgtcgacgacatccaccagctcatactcgaccagcgacacgttgttgtcttccttaacttgaaagctggcagggtccgtcacctcgatccggccccatttgtcaactgccagcctcatggtccccttgaacatgtcaatcttggcattgcggaagatgaccgtggtgcctggcttcaccaagtcaactgttgacacgaaaaaaggatagggcttacttagatggatgagacacacaccacagcttttgaacaaaaaagcgaagtgattataatgatagtaagtgactagcacatatccatcatcgaccaagatcaattaacgggcataatatagaaaagtaaacatacaccattattatgtaatgaagtgaataggaacgtgaggcagtgtttcagatcagaaagcaataagaaacacatatcactttgcatcaatgtggtatagaaataataagatgagacaccagaaatatttgtctccttcattgcctagggacacacgcggtatatgtgttgcatcaagcgcaatttaagttacattagaaaaaaactgtgatccttgagcagtggcggagcatgggtctccacaatggtggttcagacttagtatatggcaaaccaataaagccaaaggcacattgaaacaagtcaatgaatggaatgattcaattggcatacaaaagttaaatggttttttttttctggcataagcttcttgtttcagtatataagggtatataatgggtgttgtgccgccaatttgcttgagcaaaggatacatgagaggttgcagttgaatactgtaatgaataaggaagtaggaggggagaggagaggaccttgttggttgcgggcggtgaaaaggacggtgccggtgttgtccccgacgaggcactcagcgagacgagcgcggggaggagggttgtcgaggatgatgcgggcggaaaggacgcgggcggtgagggtgtggccgtggctctggggccgcagccgctccacggtggtgaacaccggtttacgcagttgctgcggcggccgtgcgggagcgggagcggatggcgaggggttgggtgcgcgggggcgcggcacgtaggagggagcggcgccgccgcgacggccgtaggggcgaccggtggaagacatggccggcaatctctccgaatcttcttcttgttggattggaatcggaaagccgcagccgccgccgccgccgccgccgcctaaaccctagcagcacagcacagcagagcagagcagctagtattcccagagtatgatttatgaagaagaggatcggatcggatcggcgacgcaacgcaacgcaaccgaagaggcctacgatggtgggcctgggcctttcgttcctcatggcatgggatgggccttactcctactactggaccggacagagttttgatgggcctaaatataatccacatgtacggtactagagagaccgttcgaatttgagagcctttctttgtctaaaaaatttaaaaagaaaacagaaaagataaggaataaactccaatttaactccctcaactattggctggcatagcctccaaccataacatgggatatattaacccccaactcctaaaaccgatgtaaaagactcactgaacggttttcgctgacgtgtcttctactctttatctagtccaatttgaagatcatatgttagcgcctctttctcttttctactttctttgtgctaaaatattacaacatccatcctagtacaacgaatgatagtctagattcgttgtcttagaataagtcaaatcctattataaattataatattttgggacggatgaagtaccccatgaacacgtacgtactgcgccaataatgcagaacctgagcggcgtgtaggtgggtgcatgtcagtgttatccgctagctactactccacaacatagtaaaaaaaccggatcgggggttgacctgctctggctgcggttcaccgatcgaaccatcggttatttatttatttattattatattatatttctactatttttaatatagaaccatcacaaatcggtgaaaatatgtactccgaccacatcctttctcttctttcaaagtggactactactactcctttctccgtcctaaaatataaagcatttctaaggttgacacgagtatactaagaaagtatgtgaggatgattaaataaagcgtgtaattggttgagaagagaaactaggtgaaagagaatgcttgtgattggttaagagaaggatgtaggtagagaaataacctcattttaaaacaaggtattgtactgttatattttgggacggaggtagtacctgagtttatccgacttcactggactggacaggggtatggacagtgcaacctatttgattgagattgatgtggtcgtgttgcgttgttcacaaatcacacaaatcattgagattgattggacggagcaacgagctaaacgtgccttcttcgttagtggtcaactatttgattcgattccatatattcggattcattcaacaatcgtcatggatgcatgcctttcttatataaaaaggtcactggtttggacaagtggagggagcatatcaggccctgtaatatcaaaaccagcggcgctaggagctgttcccacccacgaatccacgatctttccgactgcagtctactcctctccataaaaaaaaaaactgggattccgtgtttaacggttgactgctcatcttatataaaattttcttataattagtatttttattattgttagatgataaaacatgattaatattttacgcgtgtcttgtctttttaacttttttcataattttttcaaataagacaaactgtcaaacgttagacacggaaatccaggtttttttttgacagagggagtgcttcacaagttgatatgaagtggagttgtggagttggctccaccctttaattcattatgtgataacactctaaccaattttataccgttcatatgtagagttgaaacttactccaacttcaagaaaggtcaagctgcagctaaaactatgccaaacggccccctaagcatatcgactccaccattttctcttcagcttaagctaaaattttaatttcaaaacttaattttatatcctttttaaaaaaacatagtataaacttatacggtcttataaatatacacaccacactttacctatatcaacatctttgaaaga

SEQ ID NO: 64427 - DNA, 6092 bp, Oryza sativa
cctgcagcccttgcatctaagcttggggtaggcagccactcataaatagtagcttttcatctccctcaacacaaaaaccaagtgtgcgaacctaatttctatgttgtaatttcgcaataagagtaacttcgttcctgaattccttcgttccttgttgagaattcctgcttaaccttttaatagcacttactgaccccctagcattccctttaaattgtgagaaaagaaattagatttgagcatatgacatacaaaataaattattgaataacctagaacatataaaaggaagctactaccgaatgatttaccttgtagacttttccaaaacctccctgaccaattttgtatgcttccgaaaagttgttagttgctagagcaatatcctcaaatgttacaaatgggaattcaagatcttggacaggatttccttccccaacctcttcagctgcactcatgccaaacaaaatttgctttctgtgcttttctcgatttcttttcttgcatgctgaacaagatcaatcttaattatagtcatcagcttttaagaataacatatgtttacaagagaaaaaaacactaaatatacctttcatttttaaccatgcaaaagaaatgcatagaattaccagaatactacttgctaacactggaagcacaatcttgactgcattgctcttcgtccttccacctgtgcaaagttttagtgtttaagtagttttttcaaaaaaaaaataaatattattggaggtggaatagaaatataatatttttctgttgatttgtataggactttcaaaaagtacttaagactaaactttaaccattcatttattatcgtataataatatattttagatagctataagacctactccatccgtccccaaaaaaactcaacttatggagattgaattttgtcaaaaaaaaaaaccaacttctgccattctacctactctcagcacgtaaaacgagaaagttttatctcttaaataccctttacctacctatcaatattactacttttttcaataacgaggggcattttggtcatctttactcttcactaaatttgcattgggattctaggattgctctttctgtgagacggagggattaccttgttagtctaaaacatgaatggattaccttgttagtctaaaacatgaatttcttggtagactcatcatagaggaatttttataccaactgatcaaaatctatagagaatttgacttttagacatcaaagtactcctacgtcctatgaacaacaacggatgtagtaattgattttagaaaaaatgtactaaaaattaacggtgtgtttacccgcatgaagctgaaggcctgcaagcctgaggtagagcgtatcgctgcccagcccttgtgcaccaacttttgccatgtcaatcagctcccctgaccacaccaagcacctcgtcgtgtcgcccctggacctgctgttgctcaggttggcgtacgcgtacgccacgcacgagcagttgctgctgcactccgcggcgcacgcctccagcgtcctgttcgggacgtgcacgaacttgtcggggcactgcatcccctgcacggccaagaagccgtcgccgcaccgcaccgcctccttccgccggcaaccccgcgagaaccggccgctgctccactccgccgcgctcgccggctcgaagccgtcgaggcacctgcacgccgggagaggcgcctccgccgccgtgctgtcgcagtacccgttcgggccgcagaagtcgtaggggtcgcacccggccggccactcctggagcaccacccacgccgacgatccgctgctccacctctgaagctggtacttgccggcgtaggtcagcacgaacctggtgtgcggggcgtcgtcagcgacgctgaacgtgatgtatatctcctcgtcggtgtcgatgatcgcgacgtagacaatggcgctggtgttcgtctggtactggctatccaccatgtagcctgtccacggcccgtcccgcatcaacggccgcgtcccgttccacatgatcacctggaggaacgtgtccgtgtcgccgccgtacgagaagctccccggcgacgggtcgccggggcccctccacgacaccagccggtcggaggcgcgcgtcctgtacatcatccgcagcttcatcccgggcaggaacgagtcggtcggtgctcgaagctctgccaaaagatggtgccgttcggtgaccggacgacgaggttgccggtgttcatcagcaccgcggtcgtgttgccgttgccggcggcgccaccggtgatgttggtcgtccagcggacgcggccgtcagcgtcggacacgacgaggttggaggattcggtcagggacagcgttgtgccatttgtgaccggagtttctcggtcggcgacccacaccaccgtgcgccgggggatgtcgttgtaccatataccgaggtagagcttggccggggtggagttggagggggagaagaagcccatggcgaaggcgccgccgtcggagacgacggtggcatcagaggttagcggcttaccggggacaagccggtcgtcggctgaacacggcggcggcaggaggacgacgacgacgctcatgatgatgacgtagatgaaagcatctgatcgatccatggaaaccaagccctttcttccttttcgtgagccaatgtgctagctcgtaatcgcgtagttgttgttgagcatgtgtttgactataaatatgtggaaattcaaatgtactagtctgtgcgtagctaaccggcgtatagttttcgtatcacgggtagattttctcgtgcaatttcagcggaccagctagaaatgtcgagatgtatttttttttaaaccccgcggggtgtatttgtattaagtagggagaaaaactgtaaaatagctcgaggctaggagattacgaaaggaaaataaatagaaaagcgagagggggaggggtgggctgctaggggaaaggggttgggggtatatgtcacgacttacatattgttgattgtacttccacgggtgtccgggagcagggattgaatgttccttgctccacttgtgcgccatagccaaacttcatcaatcgaccggttaatgattactacttgtgacggtgctgtcgagatgtattttgatgtgcaactcttgcttatgttttcataaatacaaactgtattttgtaaattatattgattctatctccataaatacgatttttacgacaaagattggaaatgatgatactccttcattgtaaagtcggagctgctgcgtcactattgcgggcttgacaacgacgatgatcgtttgcatgaagtcgaagctgctatgccattgtcagctctcaatgtcctatcattttcttacttttctacttcatccgttcctaaatatttgatgtcgttgacttttttaaacatatttgaccattcgtcttattcaaaatttttttttgtacatattattcaaaaacttgagtagtagtaatatatttaacaatgaatcaaatgataggaaaataattaataaatacttaaattttttaaataagacgaacggtcaaacatgtttaaacaagttaaaaatatcaaatatttagggatggagggagtatcatgttaagtggtgtcattctctcgaaatgaccgttggtccaaaatgtggactattctgcacgcaggcgtggacaatttcaaaccaacttgcgttcttatcatgcttcaaccaacggtacagcaaaaaatatatttctaaaagaccaaaaaagtagtttgaatttcactttgctgcaggaggggcgcagtattagcgtgtgctttggcatagtttggcttagaagctagccgaagctaattttagaaattagaccttaataaactgagccctcctttggaacacaataattttgcaggggtcttattggagttagttttaattagcttccagaaaatttatccaattacctgtatttcaaacgacgcataagagtcttgctgttgtctgagaccgaagattgcggttgttaaatggcactatcattcctagtggcagaaaaaaacccgagcagtccatgcactgcaactctgcaagtttattttccacagacagaccgaattcggctcttcttttctctgaaggggatttgcctaaaatctgaagctgcggacgttgtaactttcgcccgcgatctctatcctccatgtgtagcaagttttcaagatgtttcttcgagagtcacgtcggaagaaacaatacaggcatgcagaagaagtcttggatcctagccatacgttttagggcccctttgaatcaaagaatttatgtaggaattttataggattcaaaacctataggaaattttcttatttggccctttaattcaaaggattaaagttttccaaatcctatgaaattcctatgaaatggcacattgcatgtggattttggagaaaatttagcaagagctccaacctcttggaaaatttcctttgagtctatctctctcatccgattcctgcgtttttcctgcgctccaatcaaacgaccattcatgtgtttttcctgtattttgcaatcctctgttttacacttcaattcctgtcagaatcctgtgtttttcctattcctccgttttttctaccctacgattcaaaggggcctttaatctgagggttcgtgatggcctgggggccagggttcggagattaaaactccgaccccagtaaggttgtattttgttcacactgaagtttggaagtttggttgaaattggaacgatctgactgaaaagttgtatgtgtatgaaaggtttgatgtgatggaaagttagaagtttagaaaaaaactttggaactaaacagggcctaacttctaaaacagccatctcaaatcgcatccaagaagaaggcacatcatgcgaagaaccaggataatccaacaaaaaagagatatgcatcagtcatcacattagaactgcgaactatggtagatttcagttgctaggtgttgacagaaaacacgaggcttgggagatctgcttaactctagtgcaggtccaaagctcgccttcgaatgtatgagcgtgccagttgatttgatcctgcaatcaacaagaaacaaagacaaagaatctgtagttaaatccataaatgatagccgatcggctagatgccgatgacatatcatttatctttgagacgatgtcatatgtgaatcgatcggcaatcgttaataagaaagaaagacctagatctgctcaatcggctgtaggtatcaacgatatataatcttcatgctagtatatacttaaatcgagtgattgggatagatcggtcgtaatgccgagacagtataaatcactacgatcgaaatatatactaataagaggattatatatgtttatagcatagccgatcatgtagacctggcacgtatcggctaatactccgatactactctgtattaagatactaaagcaaatcaaatataccaaacagtagcctaatatactttagatgcgacaagatcttaatgcaaatggcagatttaacgtatcaaataagcgtataggatagaagtagttaaatcagataagatcggctgaaactccgacactactctactcggcaactagaaagcaggctagagattacaattctaagcacgacttaatagatcaaactcaactgatgcagcattaagtatgaaaagaaggacaatatctagacaatcaagccgctagatgtttcatagagtggtagatatcttgtataatctaagccaacgtcgctatttaacctaatcggctgccttctactaacagatattggccgattatagattagataatgatattgtcgaagattatacaagatatatgatagctcgacgaattacataaacaagattagagtgtcataaagatggaagcactaatcccgaaaacacaagtcgccatgacaagttttacctcttgttgaagatcgaaaccgatgcagctcaacccgaaagcgagaactcgtcgaaataaaactaaagcaaaaggatggcgatgcgccgaaattgtattgaacgtctgttgttttt

SEQ ID NO: 64428 - DNA, 1561 bp, Oryza sativa
tctcggatcctagccgtacgttttaatccgagggttcgtgatggcctggggggttcagagattaaaactccgaccccatccaagaagaaggcgcatcatgcgaagaaccaggataatccaacccaaaaagagatacgcatcagtcatcacattagaactacgaactatggtagttttcagttgctaggtcgccaacattgcaggtgttcacgtagcggatggaagcttttttggggtttcggtgttttctactccgacccctaacaaatcgtggattaaaacgtgattcctgtagagactaggactactattttgtagcccataaagcggcccaactatatgagcccgttactccaaggggccagggaatcggcctcatcaggtgatccatcatctcagtcgccggaggccttttcgaccacgcctgcgacacggccatcagatcttcaaatattttttgtgcgttggctgaacaactgtagactgtactggtagccttgcttcttagcacagaataacgggggtggattctaaactctcgaggggacaccgtctcgttatttgtatgtcatcgaaatggttatgtacaaatttgctatctaacaatcggtaccatagagatggaactaagtgtttcagttagatagcactagtaagcagttggagcagaattttcaatatcaggcgtttcgattggggaggtagccagaagcgatttctccgagcttccatggttgcacttgcagctgagcatgcccgcaaagaagatgatgaccgaagtcgcccaacacaccatcttcaacaatttggacatcccatccatagtcataggaaacggagtactcccttcgccccaaaaaagacttaacctagtattggatgggacatttttctagattcattgtactagaaaacatcaaatccaatactaggttgattttttgtgggacggagggagtaggtggcagcgttcctccgcgcggtcattttcgttcccaccttgtaaaagcctctcacgagtcgcgtaccacgttcctgaccctgttccttgcttccatcgacccgggaactttgcaactttgtgactttattattcccagggacaaagaagctggagagcatgacacctacagtgacgagggacctttttatcagaggcattttggacctctcgtaaccctcccaaatgcgagccttgatcacctcttgtgtaatcgaccgtccggaatctcctctggatatcatctatgaacctaagctgcatatcaacgggtacgctgtattccgtgtgttcccggatgaggtgctgcttgacgtacttgggtgagccccgtaagaagcgatccaatctatccaggatgaatcccttcttcatatcctgcagaggtgcagcttcttggcagcacgcttatcggccgcagcatcgatccgcaacctgtgagattcctcccaagcccggatcttgacccgcttctcgtgatcgcctaccccgaaattctgttccacacgttcgttaagaatctcctggacttcgtcaacgatctcgtatctaactctaaag

SEQ ID NO: 64429 - DNA, 2081 bp, Oryza sativa
  unsure (1)..(2081): unsure at all n locations
aatacttgtctctgcatccatccatttttaagtctcgtgcgctaccccttttattattgtcgaattcatgtttcgatagttgcaccaatagtagaattagagcaccttgattagaatagtaaaataatcacagagcatgtactgctgaagctgaaacatatctagctgcactttcgtgccgcgtcgactcgaggtgtttctcatgtggaggtcaagaaggattctacgattcagggctgtctatatgggattcgcataattttttagactttcatcatgcagtgtttcaataagtagatcgaaaatgtatcttttaaaaaaaagttggaacacaatcaaatcaccccttaaaacattttgctacaacgtataaaacaacggttccgaatatattgaaacatgaaacaaatttgagtacatcgagaaaaagtctatataagattcgcatgatttttaggcttccataatatagattttgaagtaatcgggcattgttttaccaagtatatcgaaaatatttcaatcttttaaaaagctgaaatacaatcaaatcacctcatatgaaacattttgctacaacgtatgaaacaacggttctaaatatacgaaacatgaatgatttagctatgaaagatcattcaacagccatttagcctttctgttatttttttatacaacgtgcacgagataatgtgatgtttcgtatttgatatagcagtaaaaaaaatgcaaccacaccacacacgtctagaactgtaacctgctactgcagagcaaaacacctagatgaatggatcttcaaactacacctctagggaggatacgatgctgagagtgttcctgccgcccgtcagggagagaagacagattccgcgacaatgcccaaggaggaggaggatgaggtgtgtaatacaccgtatattaaaatatatttaggtttttttaagtttgggttggctttttaaaataaatatatcaacagaaataaataaaagaaaaatatctttagacgtgtgctaacataacaaggcctataaacccaacccattagttctcccctaaaacctaaagagaggggaaccgaatctcacctcccctcatggtgccgccacccctctccctagccggcgcctccttcctcccctcctcctgtgttcgcatctctcgtctctacaacaaattgctctctctagatctcctccttcatagcttggattaaaaagcgaagtagaaaaacggaacgaggaggaggacaggagtagaaggaggggttagaccggagtctctcctattgtctcctcacaagttctctaaagaaaccttaggtgagacttattcccttattatatcagttgttctagcatggctttagtgctttaattcgcggatagggaagactagagaaggagtttgggtagttgcggttcggtttgttgcagttctacatgtgggtagatttgcagtgcttcagtgtttcgatgtttcggagctctaaatgttattttatgcaaaagtgtattactaggaagttgtagataatgtttggatctatcttcttaccaaagggagcgattttatctcaagtggtttaggagatatagtttttttagtatgactgttgtttntgtgtcataatctgtatagcagtagattgaactgtttttggaggggttaaacagtggaatcagccaggctgcctatagaagaagttgtagaggttttccttagctttccatattggtaaagtacaccctgattgggcaagtagaactctagttatggttgtttagtgtggacagtctaaaattctggacagattctgaaacctgctttcaagcgcaaattagaccatttttatggcagaataaaaatatgctttctacatcaaagttgtaggtattgttctgtaaattttcaaaatgtatatattttcagtcatagccttttcatattcaagatataaaggtttgaagcagcagtcttgtatatagtccaagcggcgttccttgttattgagttttgatgggatggggcaataggttcacctttttcattattttatacgcctgtttgaatgtgtt

SEQ ID NO: 64430 - DNA, 1092 bp, Oryza sativa
aaatgacttataatatgtaacgggagcagggtttaatctgttggtttgaccgatcgtatcggggttgggcgatataccgaaatttcggtccaaaattttgagcaaaaatttaaacaaatactaccgaaattcatgaaaaattaaaagaattaaaagtttcgactgaaataatatcatatctgaggatccgaaatgactgaattttagaaatttcagtccgaaactttcaaccctgaacgggagtatatatctgaccagaaaatgaagtggttaccaagttttctacgttagcaagaacactgtgtgaactgtcaattcttcaagccggacgaagccaaaaatcctataaatgagatcagatctgcagttctgcatcgccgtgcgaggaatgatttggcagtcatctgtaatttgcagacagaaatggagctttccatcgatcaaaatttaatctgacggtgcgtttggtttccttgcacacggcacccatttgcctataaattgcgtgctcccctcctcgtgttgctcataacgcagatcagccaagaacgagttcatcttcttcttcgtgttgttgtagcatttgattcgagatatggcggcgactgacatgtctcccaaggccggcaagccgctcgtcgagaatgacgctggctcatacctggcgtggtccggcaaggaccagccggccgtcgccggcgagaagctcgggtgcggcctactcgtcctgaagcccctcggcttcgcgctgccgcactacgccgactccggcaagttcggctacgttcttggcggcagcgcggtggtcggggttcttccggcaggggtggacgccagggagagggtggtgcggctcgaggccggcgacgtgatcgccatgcgcgccggggaggtcacgtggtggtacaacgacacggacggtgaggatgtcaccatcgtgttcatgggcgacaccgccggcgccgtcagcccaggcgacatctcgtacttcgtcctcgccggcccgatgggcgtcctgggaggcctcgacgccggcctcctcgccaaggcgttggggctgacgtcgccggagcaggcggccaccgccttccg

SEQ ID NO: 64431 - DNA, 1549 bp, Oryza sativa
tagtttcttccccatggattataaggatggattgtattgtgggaatgatattgttattagtttaacttataattgcctgtcatggatgtccatatttacaagggagattctgccgaaatttctaataattttgggagtgttgatgaaaaacacgaggcctgggagatctgcttaactccagtgcaggtccaaaactcgctttcgggtatgcaagcgtgctagttgatttgatcctgcaatcaacaagaaataaagacaaagaaaccgcggttaaacctataaacgatagccgatcggctaagtgccgatgacatatcatttatctttgagccgatgtcatgtatgtatcgatcggcagttataaatagataataaagaactaaacctacccgatcggctatagatattaacaatatataatccttatatcgatatatacttaaatcaagtgattgggatagatcggtcgccatgccgagacagtataaatcacttagattgaggctatatatgttcatagcatagctgatcagatagatttagcatgtattggctaatactccgataccactctatgttaagatattaaagcaagcagaatatatcaaacaaaagcctaatatacttaaatgcaataagatcttagcataaagggcagatttaacacatcaataaaacatatagagtaaatatagttaaattagataagatcggctgaaaccccgatactaccctaatcggcaaccaagaagcaggctagagattgagaattcctaatcatgactcataagatcaaacttaactaatgcagctatatgtataaaaagaaagacaatatctagacaatcaagccgttggaagtttcatagagtggtggataccttatataatctaagtcgataacgatatctaacctaatcggctgccctctaccgatagatgttagccgattgtagattagatagcgatattaccagagattatgtaagatatatgataactcgacgaattacataaacaagatcagagtatcataaagatggaagcactaatcccgagaacgcaagccgccataacaagttttacctcttgttgaagatcgaaatcgatgcagctcaacccgaaagcaagaactcgtcgaaacaaaactaaagcaaaaagggtggcgatgcgccgagattgtattgaatgtgtgttatttgattacatggggttgggggtctatttatacctgaaaattacaaactatgtccatatcggacacgactcttatctctaacaaactctaagataccataagtctttacggcagacttttgcccaaacatatatctaagaaaattacataaaatatcctaattaatagatacaattgccttcccaggactctatccatgcgtggcaatcaccttgaagcatatcaactcaacccgatgtcgtataccaagtcgtattgtcggaatcggctgtatcacctgacctagtctaactcggacttagccgatccaatcgtagccgatccggactccagccgattcttactctgttt

SEQ ID NO: 64432 - DNA, 13831 bp, Oryza sativa
  unsure (1)..(13831): unsure at all n locations
ccgcggacgacgccggcggcatggagctggtgtcgctgatcaaaagccccaggtaacaagacgagcagcggcaggcaatcgtgacgtcatacgtgagcgcatgagttttcacttgggatttcgttgtgtcatgcaggccggcgacggagcacttcaccgggaagggatcggtgatcggcggcctgacggcggagatcgtgcaggcggcgctcaacgtgtcgccggaatttgtggaacagctcaggaccaagtactgaacgccggatttgatgaatccggtactgtacgtccatgtgtcctctcgtctctatacgtttcctgttttcagcacgcgacgaagttaattaggcagtggctactgctccggtgttcagtcttgacacgtgaatagtctctaaacgaaataattaatcgaaaccatactgtaattagctgaagctgaaactacttgtatgcaatattattataaagtacattacgcagcgtggtgtaatggtccattgtactatctatacgcaactaaaacaatgtgtctatagagtgtctggacaatgaatagggtgtagaaaagaggatcggaaaatcaacagttcttccccctctgccataccaccttgaagacaacgattcatcttcttgcgtactgcacactatcaaaaagaatctgaaaggaggtccagtgttagatcgggctaaaccaagtcctctaaagtcgttagttgtcctcgtctcttggaaagccatggtacgagcgtaatgcaagaatcttcgggcgtatcggagctgtatgcgcccagccgcaactatcatcataaagataaaaggaataagctgcaacaggcaaaggcggggacgagtcccttgcagagtttatatttttagagacagaggttaaatatgtttgaacaactttttctgctctatcaatatatatacgcggcaaagtttgtgccctcttttcaaaaaaaaaagaaagaaaacaatgtgccgattaccctatagtcaaagaaaacaatgtgccgattaccctatagtcaaagaaaacaatgtgccgattaccctatagtctccgttgtattgtaagattggcagtctttgtttaagataaaattggcgctctttgtttaaatgttactcccttatttctaagatataaggacttttcgagtagaatacaagtattaagaagaaaggtaaaaattaaatggcaaatggttgtaatcagttaaaatgatgtggtagatagagaaattaaataggaaacgattgtggatgattaacggtgaaaatatagctagtatactttattttaagacaaattttaaatgttaatactagctagtatattttaggatggataagcaaacattatttactttctttacgccaaatatatttgaccgaaacccaagcgtgggatctggatcagctgcaattatagtattgactgcaacttaatcagttgtagatactgcattggatcaaatctaaacgatatatagattagcttggtactgtagcaaaagtgtttgtagcataaaatgttgttcgagttttgtagcgatgaatctgtgctactgatcatcgaaatgagcgactgaaaatacatgcaatcatatatactccctctgtcctaaaaaaaaagtaaactctagatttcgtgtccaactttgactgtccgtcttatatgattttttttataatttgtatttttattgctgttagatgataaaacatgattaatattttatgtgtgacttgtctttttaattttttataatttttttaaataagacggacggtcaaatgttcgacacggaaaccagggtttgtatttttttttgagacgagggagtatggtgcagccgtacgtagctatgactgcacaagccggatctccaatccacaagcctgtgcacgttgatgtccccgcacgcaacaagcaccgtacatcgatcatccccggagtggctaacggtcgaagtacgcggacgtgtcacgcgtgcgtggtggggcctgatcggcgaagatgtcgtcggtcgttcgcctgctcgatcgatcgatcggtcgcgttcttgcagatagctagctctgatatgatttgcttgtacgtcttccctgtggttaggcaagggttactactttgcttcagttcagcttctgtagccacgcgaatcacgatcgtcttaaaataagttttaccgtaccccatccaacaggtctgtattgtagctaaagtgaatgttcaaattctaaaaataagttttttaaatggtttaatttcaaattaaaaattttaaaagttcaaaataataggaaaaaaactctgcacacggacacgggaaataacggccacgacgactatagccttgtttagttggaaacaatttttaggtttaattgtcacatcagatatacagacacgtatttttaagtattaaatgtagtctaataataaaataaattatagattccgctaggaaactacgagatgaatttattaagcctaattaatccgtcattaacaaatgtttactatagcaacacattatcaaattatggtgcaattagcgatatatctcgcaattcacacgtaaactgtgtaattggttttttctttatctacatttaatattttatacatgtgtcaacattcgatgtaataggtaaaaagtttttgttttgcgaactagacaaggcctatctataaattgcgagctcccctcctcgcgctggtcataataacgcggatcagctaagagcgatttcttcttcttcttcttcttcttcttcttcttcttcttcttgcttgttgttgtagcatttgattttagatatggcggcacttcccaaggccggcaagccgctcgtcgagaatgacgccggctcatacctcgcgtggtccggcaagaaccagccggccctcgccggcgagaagctcggctgcggcctgctcgtcctgaagcccctcggcttcgcgctgccgcactacgccgactccggcaagttcggctacgttcttggcggcagcgcggtggtcggggttcttccggtggggttggacgccagggagagggtggtgcggctcgaggccggcgacgtgatcgccatgcgcgccggggaggtcacgtggtggtacaacgacgcggacggtgaggatgtcaccatcgtgttcatgggcgacaccgcccgcgccgccagccccggcgacatctcgtacttcgtcctcgccggcccgatgggcgtccttggaggcctcgacgccggcctcctcgccacggcgtcggggctgacgtcgccggagcaggcggccaccgccttccgcagccagcccgccgtgctgctcaccaggctgagccgcaagctgcaagacgtccgcccacgcgagcacgacaggcacgggatcgtcgtgaacgccgcgcgcatgccggcggacagcagcaccggcggtgccgccgccgggacgaagattgtcaccgcggcgcacctgccggtgctggggcagctcgggttcagcgtcgggctcacgcctctcgacgcgggcgccgcggtgcgcgggccctgggtgctccgcgacgccgcggcgcaggcggtgtacgtcgcccgtggaagcgggcgcgtccaggtcgccggcgccggcggcgcgtcgacgctgctcgacgcggaggccgcggcgggcagcctgctcgtcgtgccgcggtacgcggtggcgctcgtgggcgtggacgccggcggcatggagctggtgtcgctgatcaaaagccccaggtaagtagacgatcatggagcatgtgcatgcattctgtgtcggcgtcgtacgtgagcggatgggtttttcacttggactttgttgtgtcatgcaggccggcgatgaagcagttcaccgggaagggatcggtgatcggcggcctgacgccggagatcgtgcaggcggcgctcaacgtgtcgccggagttggtcgagcagctcaggatgaccaagtgagcgaagccaactccggatttgatctctccggcgatggggtgtggtgatgcccacagtagaacactgcgcgtgtctttgtctttcagtcttcaccttgcgagaagtcatggcaggattaagtgttgatcagtctcagcatgcgaataatgtcaccaagtacaataataatcggaactagcagtgcaataattaaagctgaaaatggatggatcgatgaaattttacttttaaatttcacgacgtgttttatatgtttggtctattgtactacccaacagaaaattgtgttcacatacatatctactcccttcatcataaaataaatcaatatgttaacatgagcacgctcatagcgtgatcacttttgtgagtttggccaggggacaagtcacgttcgagtcttaatttgtaacaaaaacacgcgggattgggagcttgggtttatactggttcgaactattcgaaattataacaccctactcttgttgtgttgttgatttttctctcggtgagaaaggatcttacatgtttacacaaactcaacgtagttcctattattctcttctggattctctaaaaatttcgcaacaggtagcacaccaaacccctctctccatggttatgacacgtcaaaaagtttacactctttactgaaggacaataatgcacttgtgttggaaggcatcataaaagagtgataattggttattggacacccacaacattattttattatatccaaaatatacggaaagagaaataacggtgcacgtgcaagtatgaatcttcctatctccattggttaatgatcacttttaatccacgtctttgaatccacatcgcggttaatccatagccattcaccggtcgggttgaaagcagttagcccgtaagcaatcttgtctttagtgaatatttcactctatatttcttccggatataacgaattaatattgtgggtgtctagcagacaacaacaaattactgcttctatatgatgcctttaaacagaaacacgttcttacagtatcttcgagcaaaaggtataaactttggatactgtctattactaataatagctatatattttaggacagagactttctattacgttacgtcgccatctcgcgctgcacattcctcacttaattactctacacaagaaagcatcggcatcgagaattcgagatcatcgatcatatatggggcatttacaaatttgctactgtttcttttagttttgcaaggatgccacttgaatgacagttatagtggcatttttgtaattttttagtggtatttttgcaataccgattcaaagcagtggtaaatttacaattgacccatcatttatatatatatatatatatatatatatatatatatatatatatatatatatatatatatatatatatgggcgtggcctccggcccggtcggtgcgtagttcatgcatcatgtataacggtcgatccggacaaaagcacataaagtatcacgtcgcgatcggtcgatcgatatatcctgacgccgacgtgtgtttgtggtggggcttgcatcatcggcgaagatgttaggcaagggctacgtacgtacgtactgctttgcttcagtgcttcttcacttcttcagtctcaaggtatttataaattctactcccgggagtctatatgggatgcttttaagcaacgatatatcccttttggaaccggatataacaagttaaaacaaaattgaattggaacttagtaaacggacacgaagttttgaaggattctcgactgggttctgaagacaaatttccagtttaagaagctaatgtgaaaggccatatctcggatggagatctccagcgatcgctgccgttgaggcggtgctacatacgtacgtactccgtgcactacgtgcatggtgggaaacaacaattaattaagctactacgtactgtagcaactgttgaaatctccagctctctctggtggccgagtaccgtcaggtttagcgtttgataagcgaccagcgttactcggctcgctccgcctaccaggcttttttcctcggacaacaatcctttgcttacggtgattttctaggcgggctaaaagctctactaaatgcatgctcctcctttagcttgaatttcagtagtgttgttggacggccgatctcttgcataagtgttaaattgacagccacttggtctgttcgttcggtgtcccgaaactcgagacggcgaatcatatcgtcctcgatcgtgtctttgctcgctagatctagcatcggattctgtctccgcctgacctgtcgaacctctctcctgcccttggctcctctcttcaagcctggtggccacctttcaaagcttgtatngcaccacacctttacaaggggtttgattacttagtccttctcgtttcctggcaactatgaaaaggacaaaactccaaaattttcgatttctctctttgtaggtctcggtagttctgagctccatcctgcaaaaagaccgcctgaggtctgctgcaggtgtcatgtcttttgaagactcgttgggtgagtagtggggcttagccttcaccttccccttactagcgtccagcttagatcaatcatttttctcttcatcgttcagttttttcctttttcctgtcccaatgttgcgcgttcgaaaaaaaaaaagcaaccgttgaaagttcaaacaagctccaatattcttagaatgcgaaaatggagtggttacaagtagtctacgtacgttagcaagacacactgtgtgaactgtcaaatttcaagcaggataaagccaaaaatattttaaaaatttatcagatctgcatttccgtatggcgagatctgtgtgtagccagaaatggagatttccaccatcaaaattcaattttcacggtgcatttgatcgatcgtgcacacggcacctacgtacggcgacgaagaccgccacccacttgctgatttgcctacaaattgcgagctctcctcctacggttgctcgcgcaacgcggactcttcttcttcttcttgcttgttgttgtagcatttgatttgagatatggcggcgcctgacatgtctcccaaggccggcaagccgctcgtccagaatgacgccggctcatacctcgcgtggtccggcaaggaccagccgaccctcgccggcgagaagctcggctgcggcctgctcgtcctcaagcccctcggcttcgcgctgccacactacgccgactccggcaagttcggctatgttcttggcggcagcgcggtggtcggggttcttccggtgggggtggacgccagggagagggtggtgcggctcgaggccgccgacgtgatcgccatgcgcgccggggaggtcacgtggtggtacaacgacgcggacggtggtggtggcgaggatgtaacccatcctgttcgtgggcgacaccgccggcgccgtcagccccggcgacttctcgtacttcatcctcgccggcccgatgagcgtcctgggaggcctcgatgccggcctcctcgccacggcgtcggggctgacgtcgccggagcaggcggccaccgccttccgcagccagcccgccgcgctgctcaccaggctgagccgcaagctgcacggcgtccgcccacgcgagcacgacaggcacgggatcgtcgtgaacgcggcgcgcgtgccaccggacagcaccggcggaaagacggtcaccgcggcgcacctgccggcgctggcgcagctcgggttaagcgtcgggctcgcgcttcttgacgcgggcgccgcggtgcgcgggccctgggtgctccgcgacgccgcggcgcaggcggtgtacgtcgccagggggagcgggcgcgtgcaggtagccagcgccggcggcgcgtcgacgctgctcgatgcggaggtcgcggcgggcagcctgctcgtcgtgccacggtacgcggttgcgctcgtggccgcggacgacgccggcggcatggagctggtgtcgctgatcaaaagctctaggtaagagaagtaatttgtacacctagatgtcctgactcatgacatctaaatgccggtttaatagttatttaaaaatttcataaaataataagatagattatggtaatataagatactacgaaaacattcaacaatgatgggatatcacctcgagagataaaaacatgtatttttctcattcagaaatataaaagtttaaatttaatctacacacgaagaaacagaataacatattttatttgttttgtataggtactccctccgttttttaatagatgacgccgttgattttttctcacatgtttgaccattcgtcttattcaaaaatttttatgcaaatgtataagatataaatcacacttaaagtactatgagtgataaaacaactcatagcaaaataaattataattacgtaaattttttaaataagacgaatggttaaacatatgagaaaaagttaacacgtcatatattaaaaaacggaggtattactatttagcgtctgatttttctattgtttaagacgatcatacatcatgtgcatgcatgcattcgtgtggggtgccgtacgtgagcggatgggtttttcacttggactttgttgtgtcatgcagaccggcgatggagcacttcaccgggaaggggtcggtgatcggcggcctgacgccggagatagtgcaggcggcgctcaacgtgtcgccagagttggtggagcagctcaggaccaagtgaacgccggatctgatctgtccggtgattgtgtgtggctgtcgtctcgtgtctgcgtgtcttgtctccggtgttcgatcagtccggacacttgaataatctgaaccaaataataacaatcaaaactgtactgtagtctgtaataataagctgaagctgaaattacatttcacaacgtggtgtttatatatgtggttgtggtccattgtactattcttggtgtaaacaatgtactatatatatttgatgaaaaacaatgtgttgacattgaatatttgcatcagactatggccgtgtttagattcaaacttttttttaacttccaacttttctgtcacatcaaatgtttggacatatgcatgaagcattaaatgtgaacggaaaaaatcaattacacaatttacatgtaaatcgcgagacgaatattttgagcctaattatgctatgatttgacaatgtggtgctaccgtaaatatttgctaatgatggattaattatgcttaatatatttgtctcacagtttacatgcgaaatctgtaatttgttttgttaattaattcttattatcttactactatcgatggtgtgcagtaaaaatggaagtacaaccctatgatcatggtcaattggattttttttttacttcagcgaccttcaaagttttgtccaattagagggcagtagtagaaattgaaaagtgttgttgagaccaagaaaatgcgaaggacgatcggactgacgtcaattcgtatacgtcaattccacgatcgatcgacttcggaagtctagttcacaccaaaattaaaagtttggttgaaattggaacgatatgacagaaaaattgaaagtttgcatgtgtagaaaaattttaatataatggaaaagttgaaagtttgaagagttattttggaactaaacatggtgctatctctcctccaaagtccaaacgtttccattcatatgtaccgtacatacgggaaaaaagattaacacagctttgtctgttatactcctaccttccaaaagtctaagccctatttctttttcatcaagaccaaggtgtaattaattcatttatcatgtgacaaaaccaatgagcatacaaccaataagtactaaaatgacttgttgggttcttatcaagaatctaatagacttttaaaaaaaccaaaaaatgaaatatgacttaaacttttggaaggagggagctgagtatgtaaaatactccatcgatagtaaaatataataacttttagatttcagaatttttccaaaaatataataagttctctccctaacattttttttcaaacaatcacaactgaaaccattcaatttatttacatacttctacttctcaatcaataataacttctctcgttaaattctatcaacttcttcaataatcgttccaaccttaaattccttttatattctgagacgtgggtggtacgtgtactgtacgcacattatatatctacacgtgcatatatacacgcagcggtagaagtacaaacgggtcgctttgggcctctttgtcccatggatgatcgatcgagctgagtatccccccgatgcggacgcgcacggtgggcctcgatcggcgagatgtcgcccggccgatctgatcgaggcgtcgtagttgcatgaaggaattccttgcatgaatataattttctcgcacaagtgtcgccgatacattgtaaatccaatcaaaaatataaagtggtcaaatcaagatagtagaattagagattgggaacaacaatctagggaaggcggaagcttgatattaggattagagaaatagaaaacaggggaggcagaactagaggaggaagaaagtcatggcagaaccagtttaatttctgttctttatgtacaatcctacgtgttcgcggaaaataatttgtgttcttcgtgccgatatagcctggacgctaataggccgggcggcttctctatcaggagcagagatgcacgtggacatggagagcaatccgcacggcccatatcaaccaccggaaacgaacgttgcggcccatagaacaccagtgctcaccaaacgcatcgcatggcccacttatttccgaccaccgacggccgcgagcggcccattatcctcgtcggtcgccggcacgccgcaacgtcagcccaccacggcaacggccacggtggtgcacgtctcctgttcgtttctgcacgtaaattttgcgtggactacgtggtttttcccatagagtgtagtgcgagtctgccgcgtttatccgttacgttttcattttttaatacgccccgttctactactagacgcaattaataccaacaagggcctgacaggtgcacgcacacgtgccgcatcaaccagacagccactttaccactaactacgcaatcagtgcggcctggcccatctccagccacccacccaccggcctaaaccacggcggcccatttcaacataaccacacaaacttatggagcatatagcgtacagttgactagtggtccgcctgggttccggtcccacaagtcagcgaaacaaagtgattcaaatcgaatagtagtagtaccactgtaccagcttataataaaagttagtattacaattaaggaggcaattatattttctaattgcggtgtgattaggttaattagcaccgggatctctctcgtttctcgcggcggtggcggaacggtcacttctcttcttcacccgacgcaacaatcccatcgctggtggcgatttcgcgaatccacctcgtttaaaaaggcaaagtctagcctagctttcctccctcttgctcgccggctgcggagaaggggttcgagtgagatagaatccggaggaggaggaggaggagattgcggcggccggacggcggcggatcggttgattgattgattggttggttggttggttgggttgatcgatggcgttcttggggaacggctactgctcgtcggggtcggagggggaggacgaggacgaggggatggaggggtaccggaagggagggtaccacgccgccaggcccggcgaccgcttcgccggcgggaggttcgtcgcgcagcggaagctcggctgggggaacttctccaccgtctggctcgcgtacgacaccctcctcaacgtacgcctctcttgccgcccccgattcctctcttgctttccgtttcttgtcttgtttttccccctctctctttgcctgttctttactcgatgctcggttggtttggttcggttgcttttggatattggaaacttcggttgaggtcgttggaagcttgctttttatctgaaactgtgcgccctgtctcctatctcctgttcatcaactgatttgtgtttggtttcccttcttcttttggtacagatttctgaaatgctctgcagccatttgtttgcttctgatgaaaaaaaaaagggagaaattttcctacatgtttatattgtttctaccgcacgtctactattccgattcgtgcaaaaaaaaagttttttttctccatcacaaatatagcagttgtatggtgcaaccaatatatcatgagttgtcaatttgagtattgcaagtccgaattttgcagagatttgtcgcgctcaagatccagaaaagcgcgagggattacgcacaggcggcactccacgagattgagttgctgtcggcgatagccaaaggtgacccgacaaattccaagaatgttgtgcaattgctggaccatttcaagcatgctggtccaaacggacatcacgtttgcctggtcaccgagttcctcggtgatagcttgctaaggttgatacggtacaaccggaataagggcattggtctgagcggagtcaaggaaatctgccgatcagtgttggtcggtcttgattacttgcacagagagctcggcatcatccacacggatttgaagccggagaatgttcttcttgtatcgacaataaacccatcgaaggacccagtgcgctctgggttcacaccgattcttgagagaactgtgagcaaccagtacagcggatcagtaattagtttcagtgagaagatgcttaagatgcgggcaagacgcgctgtcgccaagatttcactgaggagggagtctcttggtggagttgcagcagagatggagaaggagagaagcctggatggtattagcttgaagtgcaagattgttgattttgggaatgcctgctggggtagtcagcagcttgctggtgaaattcagacaaggcagtacagagctcctgaggtgatcattggtgctgggtactcatattctgctgatatgtggtcatttgcttgcatggcctttgagcttgcaaccggtgaagtgctgtttgctcccaagacttgccagggctgtagtgaagatgaggtaagaaactgttatttatgttgtttaatttcaacttctcaagaataccatcctatgtcttagtattcctgctagttctgatgataatccaggcatacaaatatgcatcaatatgtcacatagtcccttgcaacatacgacatattaaccaaataataaaatgcttttaaaagcatctgctagggccttggcctcttgggccacttcatcaaacaaatgtgcaagcagttatcatgaaagatgcacccaacctgacaagcaccaacctagctactgaatctttagaaaaatgaaaaatgaatttattgggtccacactcttactcagtagtattcaaattaacttaaccaacttctgatctgcagaagttgatggtgaaggatatcatgtgatgttgctatttgagcagtttttatcatcttgcaaagtcactttcgtttcaatatcaatttccgattaaaagtactgaacctattaaattttttcgcataaaaggtgccagccaggatactaggactgttgtgcagtgtaaactgcgtcgtaatatgtactgggacaaattgatctgtgttgttattgtattgaagaaaaaaggaaattgtcctctgttctgattctgttaaattcatacttatgaagaaaaatatctaactgagaaattcctcttgccagatataatgcactggtacatataaagtaccaaccggtgatccttgtcctattaaaaataact

SEQ ID NO: 64433 - DNA, 16306 bp, Oryza sativa
cagaacagtcgcattatcttttatatagtaaatatgagcaatatggatcttggattatgtatttaattataaataacacaaaaaatcaaataaactaagaaaagtacatgtaacttgggagccatgatcacttagctattatttttttcatatatatgatatattatgtgtcaactagaaaatatgaaaagttagatagaaaataggagatgagagttggatcccagaggtgagttgcacggtggagggagtatgcatgtacatgcgtgctcacatatggtaggggtggaggtgggggtaccggatttattttttgtgacatgtagtagttataattattgggtccacgtacctatttaaaggaaaatcgatggtttgattttttttatcataatttctaggttttttttaaatttatttgagcaccacatggtgttttaggagtgtttgtagaacaccatgtgacagattgagagcatttgtagggagtttaatggacttttagtacataatagatagttaatatattgtgtagttaatatattgtattgtttatgtactgagctactggctagaaaatatggataagaaagtgagcaagagagataatatgagatcatttatgatggcatgatatattttatttttataatattttattactatttagttgtgatataaagaagtttatgtcaaatgatatatttcttatatatgtacatgccaaaatatggtaaatttagttcaaagtaaaatcaaatatattataagatattctaattatttagttattgtgttttatatataaaattttgctactataaatggaagaaagaagagaggggtgggggagacggacatacgtacgtgtgaggagaggagtgagaggtgtggacgtaggtgacacttttttttttaacatatatagatttaatgttgtaaaatgatgggtccaccatattaaatgaaaattaatggtaggatttttttccttttttttggaatttcttagatttctctaatttattagagcgccacgtggtggcttaggaacgtttgtagaagccatgtggcggtttaagagtgtttctaggaagtttaatgaacttttagtatataccagatagatatttacaaaatatattatgtaaatatacatagagggtaacaggtgcaaaatactacttccgtcctagaatataaggatttatagggttggttatggttattgagaaagtaggtagaattaattgtgagaatgttgtgattggatgagaagtggaagtaggtgaaaaaaaatgaatgttagtgacgaattttttatattttatgataaattctaaagactataagttgttatattttaaaacggagagaatataaagttctcctcggttccaataatccgagacaggtgaagctctaaccaacggcgcagcttaaatttcatccatgctctctatgtcaagacagtctctttgctatcccacaaggctcttcagaaatatctccgtggcattctttactatatggtcccatgacccagtgtcgaacataattctcaatgtcatctagtatgatagtgtataccccttgctggagataggttatgatagggtataccctctgctggagatgagtgttgagattgataggtaatatgtgcttcgtatgaaggcccgctcccttgacagccttgttgccatggttcgtacaaccacttgtttaggagcataatgccctggaataccttagctaccagcagtgcaatctttatatggttttacaggtgacaataaagaagatatgctataaaacctatgatcgtgcatgctaagctaaaaaacactccaagcatttaaagattgcatcatttcttaagtctatgacttgtgatgtgttgtccttgttaactaatgaagaaacattaaaaaactataccattgttgatgcagctcttcaataagtgtataaaatattagaagtgaaaaactcatatatttcaccatcaatggataattctaaattatgtccaacagcctggaatatgcgggatgtgcgaatgactttatgcagaagcagaagttttttcatcaacccttaaaagaacggtggtatgattactcgaatcagcatacttgggtaattataatttaacccttgattacttgtatttttttagttgctagttttttttactttaagttgattgattgtttgcttgaatagtttagataatctatttttataggaaataaaatttctcgaactgctattgcaaaaatttatgtcatttcaatccaatttgggttaagtttatgcttataaaacatgctttatttgttttttatagaacttgttctaacttatttaacttatttataaaacatgttctaacttaattactcctgacggtctggtctattctcgtagaaatatatctttatctcaattagtctagtttgttgctagaattttatattagtttgaattgatcagacagcgagacacatggataatcactaaatcttaattaattagggacaaatatgatctatgtgataatggatagaagcattgttgtgtatgtactgctggagtataatcgttcataggctcatgcttggagctagtgggcttgattagtgttgtcgaatgacaagttcgtccgtcgaaggactagattcactctttttttagaagtattacatccgtcctataaaagttgaatttatatggaattaaggacataataggaggatagacaaataactaccataaactcatttaatgaacaaagtacatgcatatattccatatataaacttgattagaaggaaggttgagacaacgggttagtgatgggaaggaaggaagaaagactaatggtcccatattagtagaaatacaatttttatgggacaaaagttcaatggtagaaattcaatttttatgggacgaaggcagtattaatgtttaaaatttttttggatccctcaatacatgccccttagggcctatttatagacttagtacaaactcatgtgccctagggttatcaagtgcatgggaatttacatggctacccttataataggaacatttatgagggtaattgtaggtaattcagctttgggcttcttcttgggccaccaagtgggcctccataggccagttggccccttcgggtcctgagccctttgttttgaggtgaaaggtccttgactcgtggcgaagatcttcggctttgtctagcgatttgccttaagccttcgtcttcgtgacgaccgaaactttgctgccatgcttcgccctagcaactgtgaattggttttagcagacttgatcgaatgccttcatgacatgtctccaacaattaggattggaacaaagaattggttatcaattggcatacttctatgtatttctgttgaaattcaattttcaagtgcttgtaagaatatatctcgtctcaattaatcagttaaagatcacatatattcatgttaaaaaggagtatttttatgaggacatattatttggatagattgtggagtacattttaaccttatgccaccctacttagagcaggtacaatagcagctataaacatattttaaagagataaataaaaagaaataatagtctatagctagctgcaatacggactccaaaacgtaatgtgtgtatgacaggtgggaccaggtattaatagtatagtaagcaactatttaatgaattggctattacattagctatagatgatttggagctagtagtgggctataccattaaacttgctcttattgtgggaactagttccaaagcgtggtgtgaagaaaaacaacagtgggcattcaatgtcctaccacatcagtttcttggcatattataatgatgatccttcagtccgtgtgctcttcttcgctgaagtgtgggagtcaagcttgagcattgaactgcatcttggattctgctaactgaaagcactgctacatagtacataggagtgccatgtaaaagagaatgacattttcagaagtgtacatatggagctcgcatgtggagtaacaaatgtaaacatcacaataaaggcttacttatcaattaaggagccttattgttccttcaatattccttaaaaaaatccaccttccaaaggagccttattgttctaccacatactatgtaaaactctagtactcctaataactgatataatccatcaattacaatttcagttcataatatttggtactgaaacaaaacttcaacagtaataaactatggtaattggcatcaaatcaacatcccaagcctaataacagatagtccattgttcacaatctcattctgcataaataaatagcatggatccaacatccgaaccatggtctagtttagttcttaactttttcttcaaacttccaactttttcatcacatcaaaactttcctacacacataaactttcaactttttcgtcacatcattccaatttcaatcaaacttccaattttagtgtgaactaaacacacccagaccaggaataaacaccctgaggtgtgggtgtactgacctaaatgaaggtccccagcccctacctaggtcccagccagctcaatcaatatcaacattagtgtggagtgataaggtttcaaggataagaatgagctgatataagaaggcgtgaaggattatttgccagaaaaatatgtccaaaaatatggttaattaccaagtaaattttctgttgcttgtccatcagaagagctcattgcatcattaataacataacaagaatagaacacgtaaaatataagaaaaatattgtataggtagtgctctaattacataggtgcaggggcaggtgagatatggttcgggttccagctgcttgataatcctccccgatccgaattggagtgattatgtaccactcccaaaccagcaaacattatataagttatatgtaagaagagaagccagttgtagatggaagcgacggcgaacggatactgcctcctgacggtgtgagcccggtgactgagccacaaaaacctccagaatgcacgcgccgtcgtcacaggtccaatccactgtgcgacaaagagagacaaaacgatgatgcccacgtagataacaatgtacacgatggattctgccgtcgaggttctcatcacggcacgggaggccgcgaagaaggccaggattaggctgacgagcgagacccagatgcagtgcaacgccgccacgaagctcttccacgacccggtggagcgcgacgccttcccgtagacgagcaggatcacggcgatcaccgatgatgctaccgcgatggggtcgaggaccacgaaccatctgaacaaggacatgccctcgaggcttgccgagccgtcgttcgtgtacccgcccggcatgttgaatccagctgcaaggcaacggtggcgatgagcacggccaccaccgcgaggctgtccgaagtcctctctatccccttccctatgttgtcatggccgctccatggctcagatggtcattcctttgtggtcggcattgtgccccgaaggcaactaatgccatcacgaaccttacctgcattgtgtgcacaccatggatatatatgtaagtgtttcttttatatgatgaagatcaataatcatatcatataaaacttctacatcaagatgcattgggacaatgcatgcgcatatttggttattgcttaccatattgaacaaactgggcgatgtggaagcgagatctagcggtgtgtgtccatcgtcgttcaagacatcggtttgcactttccccttctggagtagagcattcacgatgccaggcgcgccggcaaccacggcgatgtggagcggcgtgttcccatccccgtcctgcgcatccagaagaccaccgacctgcttgtgtttcttgatggcaagggacacgatcgaggagcgcttctccctgactgcggagtgcacgaaggtctcaccatggctgtcacgaagctcgacagcatcagggcggatcccaatcaactgcttgacaacatcggcatgccccaacttagctgcgacatgaagagcagagaggccatccgagtccttcatgtacactgtgccaggtggcgcagtggccatgattgcacgtatgattttgctgttgccatcggatgccgcgaaatggagcggggtgctaccattgcagtcgacttggctagccagttctggcttccattgcaataagaggtgaaccatctctgcaaaagtcataactttatcaatcaagttgatgaacgcattcttgttttgtgcttgaaagctatcgaatcaacaagctgatatctcacctaagctccgaaagacagcagcatgcagagcattctgcgagctcggcccaacggctgatgcgtcactgcaggtagtaactattgctcttacagcaggcaccgacctgctcatcaccgccaagtacaacggagacacgccgactttgttcagctctgtcgcctttgcgtgtgccgcgacaagagcctccacagtggcgccatgaccatgcctcgctgccagatgtagggccgtgtccccggccgtgttctggcaccccatgatattctccacacggtcctgggctagatgtactagggttgtcacggtgccggtgtgcccttcccttgctgcgcagtgcagaggcgtgttcagtgccgagtttcgacgagagaggaagttgttgtccttgatgaacctgtggtagagctccttgatcagctcgatgtgccctttctccgctgcgacatgaagaacggtgttcctctccgccgtcacctcgagtaggttgcattgttcatgctgaataatgcctgaaaaaggtgtttggagcattaaatgttgttttcatggtaactagctgggtcgcccatgtaattgcacggctagcacccatgttaaattatctattttctaatatatgatattacttaaaatttgttaaatagccatcacgttgtcttagaaccttaaaagattgaaccttatcatcccttaatttttaattttattgtttttaaagtcacatcagtctctacctcttactctaattttatcacccttctatcttgttttcccgatttaccatggcttctatttatccttcttgaaatctttaataattgggccttctagttttcagagtccattgtctcgtcaggttctgttattataatgtttagaagtgtcgtcaaacatcgctattgtactcctctatgacccatccgttgtctcccctacttattgttattgggattttaaaatttgaacataattatcattggggtttatttttttactttctagaagtcccgccaaccgccaccggctccggcactatactcctgtatggcccgcccattgttgccttccctatttattattattgagattaaaaaaatcgaaaatgattgtcattgcggtttatttttttactttatataagtcccaccaactatcgtgaccttgctacctaacggtctgtgtgtcgtcctcctcttaatcgtcattgggattctattcatggttttgcttatagtttttagatgtccattaaccaccaccatcttactcttttatgagtctattgcttctctcctttttattgttatttgtcatcattgacatctagataaactgctttttttcaaaatttcatatttttcattccaatattttttttacttataaagtgtattcctacatgaagtcctataattatttttctatttttttatttttttattttgaattttaattaatctcgtattcagttttatatgaactcttcttacaatattacttatttttaattccgaatttcagttatttctaaattgtattcctatgtatgcatttatttatatatttgtttgaatgtttcaatgttgtagctaactttagggcgaatgtacctaaaagaattgaatagatgaagattagacgtgcacgtatttgtatttgaaaatggggacaattttgatttacgatactaacattacatcaatttgtatggcctccttcatcggcgctttgcacctcaagcaaacatcatgtttgtcccaaataacttcggatatactccctctgtttaaaataatactcaccattgaatactatttaccttttttactttttcactttgaccgctcgttccttttgtaaaaactttgaatatactcaaaagtatgagacgtacattagcaaaatatatatgtgttatacaataaatacaaccatgcaacttttataaatatgagttatatttggtacgaattgaactaatactaatctttatagtacatattgttcccgtaggacattgattttgtatctttgataataaaaatatcattgtagccttattgtaggacaagtcaaaagtttatggatttttatcaaaccaaaacttaccagggccacaaggtcttttggtgctcttgtatgtaccactagcctagttcccgtaccgttgcaaccaaaaaaaaaagagtttcaagcttatctattactactaatttagtttaagtaatactaatattttcttatcaaacaaattggtgattttaaaatttgaaggagccaatagtaaaatatgggatgacttgttgaaaagtggtgtaatagtataaattgtggagcccagctgctagtaataaagggtggcgaggaaatggacatcactgctactaacaactttttaagtaatactccctccgtcccaagatgtagctatttttagcacagtatcttgtcctaaaatgaagctatttcttcacctacctcctcctctcaaccaatcacaaccattcttctttacctagtttctcttttcaactaatcacacacttccttcaatcattctcacatactttcttaatacccgtgccaacctcaaaaatgtctttattttgggacggaggaagtatagatgagcaggatgtggaaaaaatatgaagttgacgtgttacgtcttcttgtagggtcatgtgtacgtcaagaaagaaacatgtctgtatacaagcaaagaaaggaccaatacaattctaagtcacattgaatccttgacgcatatcacattcctattgtgacgtttgaaattaatgattgaatagactaaggacagttgcttttaggggtgaattacatgttataaaatatactccctacgtttcaaaatatttgacaccgttaacttttttagtacgtgtttgaccattcgtcttattcaaaaaatttaagtaattatttattcttttcatattatttgattcattgttaaatatactttcatgtacacaaatagttttacatatttcataattttttttaataagacgaacggtcaaacatgtgctaaaaagttaacggtgttaaatattttgaaacggagggagtagtttagaacgagttatatgtaagcaatgctgattaatgccaatgagtcgtagtgacattaaatcatatttttagaagcgtaacattaattaattaataatgcgaaaacaatattcactggccattagccgaaaaagaacgcatggtagttgtacctatcgacacagtgaatgatttggatatatccaagtatccaacatagctggaatgtgtgaccacgagtcaccgtgatctcatggccaaccgcgaacgaaataatacttgccttggtttgttatacatgttggaattaatgaatgggccttagcccacacgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgtgctcgcctcgcctcgcctcgcctcgcctcgcctggcagggcaggcggcgcgcgtgcacgacgtacgcgcagtagagtccgaataagttacgcgcgacttatccggttcggttacgcgcagtagagatcgtgcgggcgccctgatcaagcgacccttctctatataaaccgacctgccgtcttcacgcaacacttgcgaaatcaatctagggtttgcctcctactctgtactgcgccgtcgctcgtagactactccatcccgctcgccggcgtgcaccggcgatcgggagagcaggtctccggaacctctgcctttgacgttctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcaaccaagcaaccggtctttacgtcacctcggtacgtgttcaatatgttgcgcatatttgatctgttcatattatactatgtagtttacatgtatagatctaatgatgcgttcatgctagttttcatctgtaatgtcatgatttatttatggaatagattaaatcattatatgtctataatatcaacaatacatgactaattatatgttcaagttacaatttttcatgtgttgtattattgtataaggttaggttagctattacccagccaataacttagaaaaagttagacagctgataaataatacaattgtatatacacttatatctttgaaaaaagacatccggctgtgttcatttgaagcacattggaaagaaaagctcctcgattaccacaccttcctgaactgtaaataatgtgttttttaaaaagatttcataggaatggtttgaaaattatattatattattttttaaatttaaaataattaatacttaattaagagataatccattatatgccactgactttgtcgcacgtctacgatttgccactgactttgtcacgttctacaatatgccatcgacttttgcttaacttctacgatttaccatcaccgtccggttagccaccgttagtactgtacaaatttatcgaaatgaccaaaatacccctatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgacaaatttgtatagtactaacggagactaaccggacggcgatggtaaattgtagaagttaagcaaaagtcgatggcatattgtagaacatgataaagtcagtggcaaatcgtagacgtgtgataaagtcagtggtaaataatggattctctccttgattaatcatacactggtgactcacctcgttgcgaggatcttctacaatcacctcctctcaaacacaacagacctgttatataactcaaactatgtaaagagtttcacattgattggagagaatcaattaagatggcatatgctgcagtaaaatactctcttcgcaaatgaaccagactgcagcaatactctgtctgtggtttactgttaattaatcaaattaccagcgacttgatgacgatgtcctgctgctgatccagcgccgtgccgttgttgcagaagcaacgccacgacctcctccgagcggccgctgcgtgcagcgcgatagagagacgggcacatctccatgcgaggcgtcgactcaccactcgccgccgccgcaggtggctgatctgcggacggcgagcctgaataacggtgctgcgcgagctggactacgacatggtgatccattgatggagtatatatctggctagctatagctactgcgcgaagaactagagaggaatatatgcgagtacgaactagctgtggactgtggcagagctaggagggagatgatacggcctaatctggactgaatttgaggcggtgaattgcccggcctctgcaacccttccttgttgctgctgctactgtcatggcaaagtctcctatactctcaacagcgtgaaacaaatttactgcggtcagtttcaaaccaaacaaaaggtcttatcttttcgcttaggcttttatttatcagtcaaaattaaattttttaaccttaaatttggagctgattttaaggttttttttatcaaaatttttttcatcatttgcttttacccatatgcatatagacgttgtgtctagattcattaacatctacaggaatgtgggcaacgctagaaagtctaacattataaaacgggggaactagatagctaagaatacgtatataaaagttttattcacaaattacctttcgtttgcaaatatgctaagtgaaacaatggctccaaaagtgtagcatgtactcactctgttaaaaaaaatccaattctaaatatgtatatggacaaacacttttagaattgggttgtttttgacaaaaaaaaaatgtaaagaagtccagatctgaagaacatcttctattcatctcacccggttctagagatcgaatccccttgccctagaaaaagggacgaacggtcatttttacacacataggagaacatcttttactcgtatcgtactagtacattttgctttagaaaaattttcaagagctttgcttgcttagcctgcaatcctaaaaacatcgatatgtgactacctgacaggatgagtgtgtctttttatttaaaactctctctgttattttatttgacgttctagctcaaatcggatcagtgtttacgttcgcggttttgatcctagtataaaaaaccggaccaccccggcggttgaaccggaatcaggcctctcaccggttcggtttagtaaaaagaccgattatgcatttgacccaataggaacgaaccgggctagtaagaaccggcggttcactataagttcagctaacgcttgggctagccttataaggcccatcatcctactccacggcccatttacattttaattatttcacccgtttcttaatttggtcaaacatgtctgaagggtcaaataaagaaaaacggagggagtacgaaggataatccggtttttactctaaagaggctgaaggaggaggcattggactgaagagccacgccgacggacggtggcggtttgtacatagcgagccgcgtgcgatcgagctcatcgcgattcgaccgtgtgaagtccggcacgccatccctggatctcggacgaacggctatatagcttggttcaaggctcggaaggctggctggcctggatcaggtcgactagcttgtcttagcagtatccctgtttgtgcttaatataacaatcaatcagctatggcttggctcggttaaaaaggagagagagagagaatgaatttcgaattatgttgaaaattttcaattattacctttatagtacaatttatacataccccttttacaatatttcaaatccaaattaaaactatacatcaagtaaaatatgtatgaacaagatggttggtggaggcgcctccaatctcattcctccagagtaaaatatatacaggatggttttattagctgtaaaaatttccctttgatacccaaaataaactctctacacaatcatccttcttatatcaatgagttttattctgaatatatcactcatatctcactgacatgtaagcttagtttcatgcatgtcccatatattctcacatattctcacataagtgcgggggcagtgagatgttatggattacctgataatcttctaccaaaaaataaggcatcattcccaaaacagaaagttcatgtttcatttcatgttcaagttcacgatgttattcatgtttcattcatctggaagtttttgtttacattattcaagtaccatgcgtagtcatgggagtgcaatttggatctttgttcatgatccttgagaagcgttgattacgcttgctcggcttaccggtaatgctaagaggatattcatacctgcccgggagtgaactactatattttgacttctttgttttagaataatgtaaatccaaattttcatattggtttcttattgcattaaacttgtctatgttttactagtttaatgttgtacttgctgagtaatctttactcactcttgtgtttaatttggtttttaggtacctaatgacttttgatcggcatagggcggggtacgcggttacctggggtgttacatcgacgacgcgagatgtgccagcaaccagatgcacatgctggttgcgaaattactacctgtttggaataacttaaaattgttaaactttgattctttataatatctcacttgtccttataacaattaaataaagagaaccagtctatgaaagtaaccaaaaaccaataataaaatctaatagtctcgtgattagacaatgtggaatgattttagaaagatgaggttctcttttaaaactccattgcaacacacgggcatttagctagtaatataagtagatttattatcttaccaataggggcatcatacaaagtttgaaactaaattagatgaaagttagacattaatttgtatagaaaatcacacaaggactacacatatttgaattctatttaaatggcgatattaatggctaatttggcagagctccatgtctagctccatcctggagctggagcctaaccaaaatggtcttatgtccacctaaaatgggagttgagcgagctaattaaaatgctctcacaaaatgagttagagagatggagcgggatttaggctgctccacaactctattccagacctagctcttaaaattaaatttaaaaattgaaagctctgccaataagggtggattcaatgtagatgccggggggactcaagtctcccctaccccactagatcaccattgaggtaagaagagaggggagtgggaagaagagaaagagaaggaagagtaaggtggcttaaggaggaagaatgagataaacccttctctattagaattatggatccgtccctgccggccaaacaggtacggatactccttcatacaatctcatccgggggtatctcaaggaaatcaaggttgtgccaagtaactttgggccattcagctgtatataaggcatccaagtctccaaaaatatcatcaaactttgtaatagtttatacaaaagattaatcataatgtatatttggtgcagatagtaagcttcatattaaaaataactcacacaggatttttatattgtagctatcatagtaataaaataatgtaggacaagtcaaagtctaattaaggattacagtggaacgaaaacttgcaagtgttgttgatctatgagcatgacgtttgcaggttgcaaccacgacattgctacatgttccaataggattactggaggccttgtcaagaaagatacagctctatatgaaaaccaagattttttttttgagaacttagtataaaaaaccaagataagaagtccaagatactcctatatacttctacattcaaaaccaccttgatgtatggcttgatgttacgtatatttcccaattcccaaaacaagccagctagcgctaacacctccatttactagaagatatatacggaccgctcaacatagatcggatataggaaaaaataatagtagagattaaacaaactaaaacagatccgccaatggagcatgttccatagtatagcacactactacctccaattcatctatagccaatttaataaccaattcatacaatagttgcttactatactattaatatatggtcccacctgttatacatacattgtgtcttagagtccgtgctacagctgcctacaaatctgtagcccactgctcttctctctcatcgtttatctcattaaaatatgtttatagctagctaatagcctgctattgtacctgctcttagaagtacacaataattttactcttgcctttagtccatctaaaaatagtaaatctaaaagtagctgtgttttagaataaatggagtataataagtttaggctattcgttgcgcaagtttatcaagagaaaaaaaattcaatgaagaagagtcggcagtaaactcgagatctgtgtgtgctgttaatattacttaccagcgagatgatgatgacgatctcctcctgcatcagcaccgtgccgtcgctgcaggagcagcgccatggcatcctccgctggccctccgtgtgcagcgagagatacagagacgggcacatcatctcgatccgtgcgacgctctgcagacgccgaagaaccagctgccggcggctgctgcggagggc

SEQ ID NO: 64434 - DNA, 1977 bp, Oryza sativa
attcgagttcgaatcggatcggcttttctctctccgagctcgagctttccatctcgtcgccggccgccgtgggccttcgccgttgcctcctagcccctttaaaaggacccccgagctctcctctacccgccgccaccctcgccttcgcctctcgtcgtctgtagagctctagcgccgtgagacctagcgccgccgtcgctccagccgtgcgccgccgccgttccagacgtcgccgtcgctcgggaagaccgtcgtcgtggtcgccaagtcgtcgccgtcctcgtccgcctcttcgtcgccgccgaagaccgccggagcaccgtcgccgccgtcaacccgaagagcgccgccgcttcttcctcgtcgccgtcgccgtccgttcctcttccgccgtcgctttggtcgccggtgagttcgccgtgccgtccgctacccgttggtgccttccgttcgcgccgccgtgccgtcgttcgccggcgagcatgtgcgcccgagccgccgagccgccgccgccggtggtgacgtcatcgccgacgtcatcgtcccctctcccgtgagccggtcgtggatcgatcgatctcggccgtccgttttggatcaagtcgatctcagccgtccgttcgcgtgaactgccgccgtgcgcccggtccaccgaaaccctagcccactgacgcaataaatccctttttccttttcaaaaataattcattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgtttcggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctctatatattgattcagctagatattaggtgtgattgcttagccatgcttagaaacattagcacactattgggataacttatgattcactattaattatttaatgatggcttaatgatagttcacgatggtcaatcgtgattggttaattaattaatgggacggctaatgccttatcatggtgggttgtgagctcatggttttgagagtcgtgctcatgacaattaaggaccggttcacgagtttcggttgtgaaacattaaccgtgccaaccacaagccagcgtgggcaatggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcttagtaaaagatgctataactggtaataatttgtttagctcctggtttgaaatgctatattcctggtttgagatagatctgtacagccgggtgtggttgttcagaatggttgggcctatacaacagggtatgttgtatagcgttggtttaatattgtttaattattact

SEQ ID NO: 64435 - DNA, 19014 bp, Oryza sativa
tgttgaacactgttgaagtgtttgggcactgtttcgcactgtgcaacactgtttcgtactgtgcgtggggcgcttccgcacattggaaccgcgggattgcccatgaacagtgacaaaacagtgacaaacagtaaaaaaaacagtcctaaatagtgccacgcagtataaattcgctgtcatataataagcgcgtggcagaggacgggaacgagccgtcccgcgcaaccgtgacgcgcaatcggcgcggtcccgcgcattggcgacgcgcgaccggcgcggtcccgcacaacggagacgcgggaccgtctcgggacgcgtgggcgcgagagggaggcggtgccgcacttccgcgccgcgggagcgagacggtgccgcatggacgttctgcgcgaccgccagtcccgcggaatggaagagcggcactactcggtcccgcgtccccgccgtgcggcgaaggtatatttgtgcaaatatttttcatgcagatatataaacataaaatattaaaaaaagggtatattttcaatttttttcccggagggcaacgcgagagctggactacatgtcgactacgatccattcaataatatgtgtagctagctaggggataaattaattaaccgcctgatcaagactgaatttgatgctgtgaatggcctcaccaagtgttctatgctcctttgctcgatctatatgcatgtataactatataaagcggatctattatctaaaaaaaactataaatattaagctgatcaagtcgttatcaggtcgtactgcatacgcttgagccaggattaatgctatttttcctacaaggaatacgtggaaaaaattttggaaatatacgtgtttttgaccggaattgcaaaagtaggttgattaggggcagttttgcggaaatatactggcatcgcgctttgaatgtgcgagagcgcgatatcatcgcgcatggaatgcgcgaaagcggcggcgctatcgctaattgagagggagggagcgctaatgcatcggtctcacattcggaaagcgcgagagcgaagtggtctcgcacttttagcgtgggccggccggccgacgccgcctgacgcactcgggccaggaagcggtctcgcactttgagtgcgcaatagcgtgtgcagtatcgcggtcggctcgcgtgagaccgtagcgacgggggccgtctgacgcacgtgggtcccggagaggtctcgctctatgtgctagcgagagcgcggtcagtatcgcgctatacgcgagcgagagcgccaggggtatcgcggtcggctagcgcgataccgttgcggcgtggcccacccctaatcagctgctaatcccgtgggaggcgacagcgatggcttcggtctcgctctttgaaagcgcgagaccgcgagcgatatcgcacctcgcgggcgtgagagcggtgagctaattgcgcatatgtggccttctcgctttcgcgcatgccgcgtcaccggtctcgcgcgcgcaaagcgcgataccgcgtgcccacatttcccccgtcgcgtcactctcggtctcgcgctttcggattacgataccgaccttggtctcgcgcaacgaaaaagcgagagcgatggctccgcctgaggtagtttcgtggatttctccacgtggcgttctcgcgctacggaaaagcgataccgctgcagtttcgcctttcgcttccgcgataccgccaactcaacttcgctttcgctctttcacatcgcgatttcgccacgttatcgcacttttcagatgcgaacatcagtatcgctcttccaaacagcgataccgatagtatatttccgcaaaaccttcgttatccgatatatttttacaaaatcaatggacaaacagtatattttcaaaaaaatttcggaatacgtgtcctaaggttccagcatctaggaatcagccagtagtatatatatgcgtccagaaatatctgatcaatctgacttattcttaatataacaccaatccttcaatttttcctaccctcgccttaatatatggactagttcttgtccgccatgacgcctcgtcacactcgcaggtttgcattgcatataagtcgataaacacaggtaaccatcattggggcccaataggggatcgccacaaagatggtagttagtggtgccaaggggagttcggccgaaccacctccaccgtctctggccatcgcatttctcctgtatatgacttgtgggcccggcccctgaggtagttgacgatggtttggcccctcttaagtcggtttatactgtcatgtgggtcctccgatccttgtactcgcacataattggtcgaagaacattttcatggtatattgggtgtattttctccttaattaacctgcatatatatatatatatatatataccaaaactagtggaaatggttagtaataaactcctaccactaagttttgatagtatatttgatatcttttatgtatgagttgacggttaaagtttgcacttaatgaccgtcaacaccagcccacgaattttgtggtgtgggccagtactcgggttggttcattggagggtgaggcgcgatgctgctcggctggttgccgccaccaccaccgcctctgccgccgcgacatcggtgattgcgagaagaattgttcccacagccttgattctcgttggagccgcatttgttccctgcaccgaaataggtggcgtgggcggggttggagccgacgagcagcttggcgaaggtgctggcgaggaagacagtggactggtcggtgtgcctgttcgccttggagagttcctcaagtagaagttgagagcgcacgtcggcgaaagacaggaatgggcactgcatcgttattaaggtttgcatattatcaaacttggagctccaactgttgagggtggtgacgacgagatagcggttcgtgacagggtcgccaagggagtccgccatggccttcatcttgcggcagtagtcggtgatagataggtcaacttgatggaatgtgcgaaactcaacagagagattgagcgcacgtcgttcactgttgccaaggaattgcaacttgagcactcgctagatggagtgtgcggttgcggtgtgcgacataacctcctagaggagaccggcagagatggagccgtacagccaccagagaacaatgcaatccatctgaagccagtcggagtggtcggggtagtaagcgctgaagagaacgtggtatgccaaagcatatttgccaagagccacaatgaagagggagtgagggactccagagcgtcgtgttgtagaagccggatgcagatggccctacagcaagacgagccacggcgaagagggactccaggacaggcggcagagaggccgcaccggagggggccgaggagatcggtgggggaatcggcacggtggataccggaggagtcgtagtgtcagtagtcggtggtggatcaatcggcgctggggatgtggaggaggaaaagagcgaggcgaaggcattggtgatggcgtcgtggggggcttgagaagcgtgcttagcagcgacgttggcgatagtcgaagcggtgcctggatcgacgtcggtagaggcagaggtagtgaaggagtcgcgcaccgcgtcggcgatggctttgacaaccttctcaagagcggtgcttgcagattcggaggaaaagggcaacgacatggcgtcgtgcggcgctaaggagagcacgcgggggtttgggtttggagtggagcgaaagcggagatgaatctggtaccatgtgggaaggaataactcaacgcaattgtattgatcacggagtgtttacatatataagcccgtccatataaccactcaactaacttatagcaacagaatcggaaggataaggaacagggatttgaggagataagatacatgcaaacagtatagtctaacaatatatatcatatatgtacacacaaatacacaattgtcccagaaaagcctagacgttattatccattaagtcttatagatagatatagaccaacgatcagatgtagccatatatgcacgatgcagctatggacttgaactgaccagagcttaatcagctttttgaaagtgccaagaaggcaccaacgtatgccaagatgtttgtgacaacgaagacagaatagttacgcgagtaagtgccggcaaacggatactgccgagcgacacgcctgtgatgtctctcaggcaataaactgctgaacataaacttcacgaagctgatccacgacgccggcttagtcaagatcatgatgctcaagaccaagacatagatcccattgattatgacttcgtatatcacaatattgattgtcctccttctcatgacggcgaccagagccgcccagaaagccacgatcatgccgatcatcgaaacccacatgaagtgcagagctaaaatgaagctcttccatgaaccagatgctttcccatacacaataagtatcactgcgacaacggaagtcgtcatggcgacgctgtcgaagacgatgaagaatttgtaggcggtcttcgcctggaggaccgccttgccatcgtccccgtagcccccgggcacgttgaacgtggcggagaaggcgacggtggcgacgagcacggccacgacagcgaggctgttggacgtcttccttatccaatctgttgtgtcattgcctctccattgattcaggtggtcttgcctctgcgggcaggattgtgccccgtaggcagacagtgtcaccacaaggcttatctgcaccatttatatgtacatgatattactctcatcgagtaaataatatattaaactagtttagtttaccaacattgcatatatattggactagggttaaactaaatattcactttagaccaggtatcttctctgcttgttctcatatctctcttcttcctctcctttttcccggattcagtctcaaggagaagatcagaagactatgagagcaagtacaatagcagcatataagccagctataaacatattttaaagaggtaaaaaagaagagagaatagcagcgagctacatccctgtagccagctgtagcacgaactctaaaacgtaatgtgtaaatgaaaggtgggaccagatattacagtagtatagtaagcaactattatatgaattgactattaaattggagcacatagttggctatactattaaacttgctcttaggctatgttcggcaccccttttcccaacccatctccctcgttttccgcgcacacgcttttcaaactgctaaacgatgttttttttgcaaaaagtttctatacgaaagttacttttaaaaatcaaattaatctatttttaaaaaaaatagctaatatttaattaatcacgtgctaatgaatcgctctattttctccatgctcactgtacggctgccgaacacagcataatgaagaagaaactcttctgtcacggatgtgcgtgcctacaggtactccaaagtgcaaaacttggtaatagaacatggtttaaagtgaaaaaaaaaaggcaattccgttatccaatataagatattggtaataaaaattggtccaaactgtaatctactccatgcttatgagccaaatgttacataacgactagcaaaattgagttcaccacattaaagtactttttcaacatactccaaactagagaatgttcgaggaaaattttatgttaactacagaaaaatataaggatataaccatatattgtccacttgtagcaccaaattgctacagatacagagaaattaattaaaattaagaataaagaaagaaaggaaactagtgcaatatattgtataaactaatttctacactaaaaattaatattgaaatttggagttgaaaaactagtagacaataacaattgcaattcgtataagaaatcggcttgaatcataagaattaattttgaaatttaaatgataaaaaatagacaatattattgactctaatttcatattaatcaacttatatatgtatcataacaatttgtatcttaaactatggtaaaactccttattttgtaaaacttagtaattactactcaaacttagtaaaacttaataattaactctggtaagaaaacttgatttagaactataaattatatataaacaacagcaaaatgatttatgtgcaccgatgcatatttttcatgtatacaatttgaaatttaatcgttctaaagaaatatgcatatgaatatgtatttgaattgaaaacaaatatgcatataatatgtatttgaaatgaaattaacgaaaaaaacatatataatagagtgcttttctacaacaagtatataaaatcataattaatatcagccaataaataaaacatcctaaaaaattccaaaatggcatttaaatagatgggttataggagaagttaatttctaccaatataaataatagattttgcactaaagttggagtcttttatattgtacaagttttgtattggtgaccgagggcctgacaaccagctgacagcaaacgctaatattacatgcatgttaacattgatgctatcttaatggttcaaaaaagatatcttttatgtgaaagggcctgtaacatagttgttacatgagcctcagcagtagtaccttaggtcctgggttcgactctccatgcgagcgaatttttcatgatttaacaacttcgtgctttcggtgtaggcaacgtacccgtcaacagcgaagtgcctgtagtggtgacttcgttaatctcaaagattttccggcttgccggcccagtcttcgaaaatgcttatatgggtagggtttgcgtgcgtgtgttcttagagatgagtgtgcatgtaattctaaagaaaaatgattttttatagtaaatactcaatgtagttagagttgaccaggttacaaaaattttctggataaaatcatgacgagttgtagatagcaaattttttttgtttgcttaccatggagaggaagctagacgagttggcagcgagatcaaacggtgtgtacccatcgttgttcatgatgttgactcgtacgttgtctccggcggaaagtagtgcggctagtcccttggacgcggctgcagccaccgcgaggtggagcgccgtgttgccatccttgtcctgcgcgttcacgatgccgcaaagcatcgggttcttgacggcgagcgagatgaccggcgcgtgccctttctcggccgcggcgtggaggaacgtcctgccgcggccgtcgcggagctcggcggcgtcgggccaggcagatatcagctcctcgacgacatggtggtggcccatccgcgcggcgacatggatggccgagaggccgtccgagtccttcaggaacgccgtggacggcggcgcggcgcgcacgatcgcgcttacgatggagcggtcgccgtcggacgacgcgagatggagcgggctgctgcctttgacgtcgcattgtccagacagagctggcttccatttcaataccaggtcgaccatttctgcaaattaatgaacatgatgtgacatttttgctcatgcgcttgatagctagagtgggtgttaagcaaatgagatcatgacctgagatctggaagacggcagcgtgcagagcattctgcttgttcggcccaacgggcgatgcatcgctgcacgtggtaatgatcgctttcacggctgtaaccgacttactcatcaccgccaagtacagcggcgacacgccggcggcattcagctcggaggacagctccggcgccgccgccgagacaagggcctctaccgccgcgccatggccgttcctcgccgccaggtgaagggccgtatctccggcctcgttcttgcatcccaggatgctgtccagggccagcagctggacgatggccgtgacggccccggcgtgtccggctctcgccgcgcagtgcagcggcgtgtcctgcgacgagttccggcgagagaggaggctgctctccttgaacctgaggtacacctcccggatcagctcgtcgtgtccttgctccgcagccacgtgaaacacggtgttactctccgcgctcacctctgatatgttgcactggccatgccgctgtagaacacctgagtaatttttttacacggatattggattaagcttttagggtaaactggtcactaacggtaattaattcagagttcggccgaaaaatgactcaaactgtgttcggcccctccttgccgtcacacaaaacgaagcacttattattgcatgattaattaagtattaactgtttttaaaaaaatatagattaatatagtttttaagaaagggggaaatttcagcaaatactccatatatccaaatcgatcatccgcgttcttccttgtcggctaattaagtagtatacgtactaaattcttacttcatgatatgaatgcattatgcatataaatattttataacttttccatctatctaaataaagaggtttgttacggtccagcagatagtacctcgaggtactagtaccaccaggtaccaaatgaaatccaaccgttgaattagcagggcacgataggaaacgaattgaaaaggggcggagaaggcccgtgacacacatgcgcgtgcagatgccgccgcaatctcctcgtcctcacgcgccaacgggaaaaaaaatttggtggagaccgggtgtaaaccggctcccgtgcagccccgaccccgatgattgccgcgtggcaatcacagaatcggacgtctcgctatgcatggctccaggcgcagcgcaaacaggatggaggagccgactcgctcgatggctcccgggcccgtcggctcaccggctcaccggctcatatcacatcgatatctcttctcagcagcagccattgccaccgacacaacctctctcatccgtcgtccgcatggcggtgatagcgagtggccgatggcgaccgccctgactgaggacgaagacgacacagcgccgcctgggacgaggttgccctgtttgccggcggctagtgcagagatgtactccatcttcctgtgggcagtagctgctatctcttcccgatcacgggcttttttcttaccatggtgcaggattgatttgattagttattagtttgatttgggcctctgcattcaaactttaatatagttgttaactgctacatttcaatggatgcagtctgaatgtttgcagattctaattagatttgacaaagtacaatattgattttagtcctctaccatttcgatttgatacatactgaagattttggagacatgagcatttcatttcttcatggtcacttggtcagtgcatatatttccagggccggtcctaatattttaggggcctagggcgacacaaaaattagggccctatattgagttcgttttttttaattgtattaggtgccagaattgaagaaaacttcattttagagtagcataagaaaaacagatttgcataaaaaaatttaatcatagtatcttaaacttatcatattttatgaagattttccaatgtagattaatttgatggttagaattttaaatatgtatggcccgatggagtaatttttacaaatctagtatttatgggttcaaaatcaatatcagtgatcctttcaaaaaaatcaatatcagtgatcccttcattaaggagtagtagcactaaaattgttgataaatgataatcaccttggccatcagcctataggcttgcttgaccaatcaaatgactgctctgccttctatagctacgcgtatgggcctcaataaattaaggggcttgtgtttttacgctgttgttggattgcaaagcagacgatgcgatccactggaaatcaacgaattgtacgatggcaatagcaaacctacttacgtatacctggtcagggggcccctgacttggcggggcccagggcgcttgcactgctcgccctgccccagggccgggcctgtatatttcagtaaaagactgtcaagttcagttgaacaaattaacatatcatattctggccaatatgtgaacagcggataaagtaaatggcagacttttgtttaacaacaatgctttactaatattatctagtacctttctgtctctctgaacaaatttgctccaaattcacgctacatttcttgggtttcatctatataaactgagaatctgcatctatatacatgatactgatagtgccactaacattttctgatggcataatgtgcagttcaagaagatgagtgacaagaccgatgtgtacagcctccgtgtcatcatcctcaacctcaatctccttaccggtaattaagtttcttgccgaaacgaaaccatgcatggagttgccgcagtgggtgtcgtcaattgtgaatttgtgatgaagtggcgaacgagccggttgccctcgccatcaccgccgagaggacgacgtctgagagagggagcggtggcggatgagagacagtagatgagagaggcgccgctggcagccggcgcggcggcgactgcggacgaatgaggccggtaggagagggatctgagcccgcgagccggcgtgcccgggagccgagtcgagcgaggctcatcttatttgcgctgtgcctgaagccgcaacgagctaaacgtccgattctacgattgtccacgcggcaatcatcgggatcggggctgcacgggagctaatttacacccggtctccaccaattttttttcccgccaacgccaatatccttgccatcatgcgtgctaacttcctccatcatcgccgccaaatcctcgattccatacagccccctccagcgcgagcgcaaaatccgccgctgcctagcgcagaaggtcatcctggagttggcctcaacttcacccattgaattttgtttctacggctgagactaggtcatcgcacttcaaactatcctggttcataaatcggcaagatgtatggcaatatcgcatcgttgtggtggtcgacttgattgctccgccgacgttgctgctcacgctgggccgtgcgctgggaaagcttactgctgcagcttgtgcaagcacgaaggttttgcaatgcatgtgtggcaagatgactagatgtctagatggggctatgtaccgaacatcccggaaggagtgaggaagcgtcggctgtaagattgcagcttcatcttccttgcttcgtctcctgtagcgccggctgcgaagtcgcgatggcagtggttgccgtcggagatgacaggaggggcctccccatcacgatgcagggaggagagggcaaggtggctcctacggctctggcttctggccttccggcccgcctgcctgcccgaggcgagggcgccgtgcggaggcgagggaacggcgaccaggacggggccggaacggcggcggcggtggatcctatcgctccacagttttgactcgcacaattgctaatgcgaaaggacgaccttacccttccacctctctaccattatgcggtaccatccaagtacctggcggtaccggcagataacagccattggatctgatccaatcgatggctacgatttggtaccgccccaacctgctggactgtaaaaaaactcctaaataaaactatctgaggttattgttaaaaagaaaattagtacgtgtaacagtgctctttaagtatactaaatgtgtaaaagcaaactaagaggacatgaaactgcgtaattgctgtcaattacttaccattgacttgatcaagatgtccctgcgcaacaccaccatgccgtggctgaagaaggagcgccatgacctcctcggctcgccctttggaggcagcgagatacagagccgggcacatctccaagccacctgcagaatcacctctcgccgtcaccgccgcctccgagccatggtgctgcgaagaacagcgcgcgagctggatgtcctgcatctgacgatgatgatccatttggatcaaaatctagcacagtgaagagcctatagatgaatgaatatgattaagaagacaattaggtggtgtttggatccagggatttaactttagtccctatatttaaacactaatttatagtattaaatatagactacttataaaactaattacataaatgaaagctaattcacgagacaatttttttaagcctaattaatccataattagagaatgtttactgtagcatcacatagtctaatcatggattaattaggctcaatagattcgtctcgcgaattagtccaagattatggatgggttttattaatagtctacgtttaatatttataattaatttccaaacatccgatgtgatagggacttaaaagtttaatcccatctatacagggccttatacggccacctcgcctttgctgcttaaatttgcactgattagtctcgcacatacggccaatcatgtcatcgtcattctatcaccatatgcacgatacgggccatacggcgtgtgcgcgggaaaaattgactgttgaattgagattttctttcaaccattttagtgaaaaattacagctattgacttgagaaacgtccaagtgtcttctggctagcttcacaagatgatgggctagctggtataggttcgcagccttacctcttctatttatttgaatattcgtgttttttgctattgactttgcccagagggacattcaaaacaatgaatagtacatgaatgcgaccgatcaaggctggtagaggccgcaagaaattatgaaaaatccgatgcagtatttaaatatcctcgttttgaagtagatagagtgtataagattcatttagcacgatgacagaaagaaaaggaaaaaataaacagtgaagtgctttttgtttcttaaacttgtttttgttatcaagtagatctccatacactctaaatgttgattctggtaattttatcaagtgtatctttttgatccaaaattatgacgactcctccaaaatcctacatggctgccacctccttttctttttcttcttgtttttcctttcctttctcttttcttcttccttcgtctcatccgtccatccgcatcccgccaacaatgcctcccgtaccaccatcaccttcacctctctcccaccagccaagacgacttcgacccgttcctagcctacctgaccttgggcggcgccatcctatagacaaagcatgtcgcccctctccccgtagtccatcacccttatatcctcatcgcctgcctcccacttcccgttggcggtcacctttctccccatctgtcgggtcccaaaactaatgattcggaaaccgacatgtttaactgtatcaagccctggatcagtaggttgatacagcttcgacaatctggatcgtctttgcatacgtttagacatagctttgaaggagataatattacataaagtaatagggtatttacgagattgtggctaactattacagcagaagctttagaatgacctaactctgttgttttactatagacttaaaccatttaaattacctagacttgaagattaagttaaaagagaactaacttatgtgattgaactcctgacttcggcaagaacatcaaatggactctgaaaaaggtggttgaagcaagggtgagtacaagtaacgccccgattttcgttcgggtttaaaaataaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaacaaaataaacttccccttcctccctttcgggctcggcccaaaatcctctctccttcccctcccgcggcccggcttgcctcccctttttggcgcaagtctgcttttcctccctcccggcctcccctctcactcaggccgacaggtgggacccatggaccccacctgtcatccccaacctccggccagctccaaccgccgcccacgccgcccactccctccgccgatcccgcacctcccctcgtcccaaccggcgtggacccgagaccccttccacctcgcgaccacatcccgccccactccccctctctccccgcgggaatcaacgccacgccgagccgccacacccccacgacgccgccccacttcccctcgaaatccgccgctccccggccctctcctcgcccccttgagctataaaatcaatccccgtggactcctcttcctttttccccgttttcccgagtcccccacgccctctaccgagctctccacgccgatccccttcgccgccgctcgccggcgatctccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgctgcgttagtcgtcgccgcacctcgccgcttgcgccgtcggcaacgccgtgccaagctctaccccggcctccgctccgtttccccattccaccaccgcaaccacccttccaccgtgcatcccgagccacctccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccggtgagctggctcccgctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcatgcgtggactcggtccacggtgcgcccgccacccgtgagtcaccgtcaggtggggcccgcttgccggcgccacctctcccccgtcggatgacgtcataattgatttaaattgcgcaataaatcggtaataattctagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcgttttgcgtgccagcgtgtagtttccgtcgtttcggaagtccgcggtcgcgaggaaaagagttcagaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgcgccatgtttacttgatatctgttctttgtcaaccttgggtaataaattgactagcttgtgttacttatgtgacctagctagaactatatgcttagccatgcttaattaccactagctcagtcgatgggataattgcagtattagacattctagtatcttgttgagctgcgtgctcgagacatctggccatgttttatggtcgtaattatccaactaaaatgcgactgaatggtgggctgtggatgcatggttttgcgagtcgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagatttaatattactttaattactcaacagttttactgttttgctcaataaaatgttttacaaccgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccgtaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaacaataaaagtctactcacaacataacagtaggcaagtggtttagtaccttatctttagcaacccctctcttccacctttcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctctttgtaaatcagagaagtgttggctatatttgaaggacaacagttcaactgatcccagccacgcggaagtaagactactccctgtaaggggggtaggtctcggagaagagttttgcctcacttcgtcgctgttttagttgaaggttcaaccagtgccgcaatcagggtagcacttgaagaagcaagttgcaaggtatcagaagaattaagccgatccccgggcaaccgattgaattctaaggtacacccatgaggccagttcaaccgcttagcttagacaggtcaagcaggtttcctggatttacttgtcatttgagttgggaccagtccaagcggacatagggtaaatgatttacaaatgccagattcaattttcatcctcttatagccagcgtggtgaattctcaggttaccaaaattgccaacctcaacagttcagtccaagataagtaagtttcaggagtatccgcagttctggcctaggtcagttcaagcagaaccagtcggtccagttttggcaaagcaaaggaacagaaaggtcgaatccagccagtgcaatcgtgcaggtttgatcaaccagtcaatcaatcagttcgaagcagaatgtggcagttcaatgtgcagatcagtcagaccgcccaccagcaccggctttctttctagccatcccagaatctcgggacgagattcctgtaaggggggtagatttgtaacgccccgattttcgttcgggtttaaaaatcaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaaca

SEQ ID NO: 64436 - DNA, 5033 bp, Oryza sativa
ggagcgacgcacgcatgctcgccggtagacaagggagctcgcctagccgtccgccgcccttctagctcgctggcgggagaggagggagctcggcatggctctagcgcggcgtaggcggcgggaggacgacaagcgcggtgtagaggcgctcggagatgccgtcctggcgcgcgtggaggtcggcggcggcgacacagatggtctggtggtcggcggaggtcccggcgcgcgcgttggtcggcggcggcgacacggatggcggcgtcgatggcgtcttccagggcgctgccgcgctgctcgccttcacgcggaccggcggcgctccggtcggggggcagcgccgaccacgcccaccgctgccgccggagctcgcctgctccactgctcacccgcgccgtcctctgcccgggaagaagagagagaagggagagggaagaagagaggagtgaggctgacatttggggcccatatggcaccaccattttaaaattatttctttttgcagctgacatgtggggccacacttttttttattttgctgagatatagttgccacgtgagcgccacgtcaagctacgtgggacggagacctagtcaaacaagccacgtatgcgccacgtcagctaaaaccgccttcaaaaccaccgaaggaccttgtttgcccggtttccgtaagttgggggacgggtcatgcccgattttacggtcaaggggacgaaaatcggactgggcgacaaatagagggacccaaagtgaacttattccatatccaaatccaaaacttcacttatttgtgtggcccaataggaccgattttgctcggaggatagtatggctttgggtgggccggattcagcccaattaatggctcattcgccgggaagaaaagctgggcttccttttcctgagaagaagaaaaaatgcagaggaaaatttctccttagcgacgacgaggcggcgggcggccactctccagtgtcatttgcccgcctcacctgcactctctccatctctctcctccggcgaaggcgcggcgcggcggcgttctccccccgcctcgcctcctcctcctcgcgcgcgcggccgcggcgagccaggctcggaggcggcggcgttgacgggacgggctcctctcctctcctccccgaccacaccctaccttcgcccccgcgctgcctcctcgcgcgcacggccgggagacaagccaggggcgacgcggccggcctcgctccgctcggctccatctcggttccagtcgaattggaggtatccattctccctctctcagtctctctcctgctgcctcgcgccacctcatgagccggcgtccgcctctgatgctgcggattctgaaatttttggtttacactggtgtccaattcttcaatctcaagttggggtttaatacccgaccacccaaacctagaccgaagggtagatgcaggatcgtactagagattgttgagttgctgcagaatttaacttctggataggtaggtagtttgtgcagtttggaagaggggatggacatttttgggcatgggttacgttagttgtttgtcctagggggaaactgatcgtttgttgggttcgtggtggctactccatcaatgtaagtggaaggatactgtggcttcttacttctattatgttcatggtgcctgctcatttgatctgacatcatgttcacttcttcaagcaacctatctaagtgtacatttgaagtttctggaagaaacttctgatcttgtctactgtttttcttggataagtttcgctgccaacagttgctgattgtactattcccccagaatgcttaaatgcagacaataaaacggttgccaaaaagtgtccatagctcgttgcgctcaagcattgttctatttgacctatcaagggttgttgaggagctggtatataatagcattgacgcaaatgcgagcaaggtattactttcacatacaaaaaggcaaactattatgcatgcagtatcttcagtgacataagttttctttttgattcatttcagattgacatctcagtgaatgccagagcatgttatgttaaagtggaagatgatggtatgcctttatagctttgtaccttatgttttaaatttcttactgctggtatttgcttttagaatagtgtttcctgttgcaactattgcaggctgtggtattactcgtgacgaactggttcttgtaggagaaaaatatggtaagttaaaacttctactattatttatacattttcgtttactccctatactcaaaactgctgtttttgtcatattaaacaatgagggtgcattgttgcaagctccttcacttgttgaagcaggccttatggatgcttatctgatttctctaatgtcagaatagaattattatcttacagaaaagaaaaggtgaatacatgatttgcttagaattagatagtaataatggaaacagtatcattctgtgatatttgacatcgattattgatattgaaagcagatgtgtttattactattttttatcatcagatgtttttattgttattcgtatagattgatggttggtaaatgaaatcactgtgttgtttttgctgctgatgtcacccagtgatgctttatgcaaatcatcattaggtgcataaggatttcaagacaatatatctttgatttctcacttatgggtcatgagaagttagttgcattaatacctgttggcaggtgtgaatttactattttgtttattatgcttattcaccgtttctttgcaaccaaatatattttgatgtgctgtcctcagggtaaaaaagaattaattgtcagtgggtaggattatagaaacccctttatttaaacttttgtatcttgttagattcattcttttttaagacgtgttaaatgtatatccaccaccttaattacagtaaccattcactcttgttttcaatgcgctaataatgtataactcttttattccataacagcaacatccaagtttcataatgtcatggttgatggggaacctagttccagaagttttggattaaatggcgaagcactcgcatcactatctgatatctctgttgttgaagtcaggacaaaagctcgcgggcgaccaaattcatattgcaagataataaaggtagtttacacacttaaccttttaaaagctcagcataatcttgatacatacatccatagcgtatctgaattcttctggcaaatatacagggatccaaatgctcacacctgggaatagatgagcagagggaagttgttggaaccacaggtacatttttactctacatttaaagatcaagaaaataaaattttactctagtcgtgtattcatgtgtggtatatttacattttttgccatgttatataagctacgtatcgtaatgtttttcatttttgtgtagttattgttcgcgagcttttttacaatcaacctgtacgcaggaaacaaatgcaatctaggtaaatcatgttatctttttcatctgtacatgtttcttacaattcacaattttgttggaaagaagatttgattgtctttctcaacattatgtttttgtagttacaaaagagaactacatcttgtgaagaagtctgttctgcgagttgcactcattcatccacaagtttcactcagactttttgatattgagaggtagtctattgtgctacactagccatttttattttaccaataccgcgtgagaaagtgtatctattgacatatcttttttatgtatgtagtgaagatgagttgctatacacgattccttcatcctcccccttgcctcttgtatcaaacattttggggaaaaatgtctccagctgtcttcatgagatagctacctctgacaagcattttgctctttcagggcacatctccagaccaacagatgtgttctgtaataaggtaacatttatcatataagttgtgggttgttgaacaaaagtttggcaacatgtattcagcaaagtgtgtttttcctctgtaggatttccagtacttgtgtatcctacaatccagttcttcactgtctatttccatagtttcacataccatttttctgaaagcttgagttgggagatatccttgactttccaaagatatcaactcaagattcgtcagtaaaagcccaatccacaatatgctcaataacctggcatctagttttcaatcttctgcaaggaatgaggaaattgatgttcggagtaagaagaggcagaagaatgaagtctaccctgcatatctgctaaacttgtgctgtcctagatcaagctatgatctacattttgagccttcacagactattgtggaattcaaggtgatccattacacatttatgctttttaattccccttctttttctggtaaagcttcatatgtaaacaactgaccggataaaagtggtttgggcttttttttttttttgggggggggggcatgttgatttgtaccttcatttctatttattttaaaagcaaattttctttcttatagcttgacattcatttcccattcttttttatggtttttctactctttaggattggcaaactgtcatgtatttctttgaacgaactatcacagactattggaagaagcatgcacctcaactgccagaaggttagaaaaatatttacttccgtaatgatgtcttccctgaacaattttgaagtctagaagctgttgattgaatgattttcttattgttatccttttctattgtagtgaaagctattggcaatgatacctgtgtgcctttggaaagagatggtcagtgatttagtgtacacgattctcttcctcttttgattcgtctgccttgtgagctttgtgcacgtgttgtttttgcagtgaaatcaagtcaggaactgttaaggcgtcatggtgtgcagaagaaagaagatgtcgctgaattgtaccaaacagctctgcagaagaatacagtacgagacatgaattttgatacagctgccccagcaggtcctaaaggcaattacctttctttggatatgg

SEQ ID NO: 64437 - DNA, 1875 bp, Oryza sativa
tctccacaatcgtcacccggcctaaagttaaaatcatgactgaacttttgctctcgatcgagtgcccccactaattcgtaactgttgtgtccagcttaattgttttgctcaaaacctgataaaattatatataatgcgacgagtacactttgaaaatatccctttttcttttctttttttttgcatgagatgcgtacaccaaattaagagtgtgtttagttcctgaaaaaagttgaaagtttggggaaagttgggagtttggaaaaaaggttaaaagtttatgtgtgtaggaaagttttggatgtgatgtgatgtgatgggaagttgaaagtttagggtagttgggggtaaactaaacacgccctaaattattaatgtgtgcaatctctacaggactagttcgctcggtcgcgccggccggaccacgtgatctcacaaaatctatgcacgaccccatcatgattatgagcttattagctagctaataaagcttggaggatgatgcaaaaagccgatctatcgggtctttacctagctaaggtagtgactcacgatcgagagctcatggctgcacatgggtcgtcacacagctctccattcatcgatcaccatccttcaattcattcctttctccgaaagcaacccatccatcgattttcccaaaagtccaatccggccgtttccatgatgcattaacttaaatgcaagcatcctgcgagatgagcgttgcttaattatttggatttcttgtggtcgaaacttttttagctgcagtggcggaactgagggggctggcaggggccatggcccctcccaataaaaacaaaattttttattatccccatatatcataggagattcagtgaacaaacaacagagcttttcactttgtgtatatctttgatccaagtgattcattcagttcattcaacattgataaagtgtgctctctagcttcaaagttctatcctgctgattttttagaacaagaggaagccaatttgagatgtcaattacgtcactatgaacttgatgtacccaccaatcctaaattttaaaatctgacatctgttgctgatctttgtcgtcgagtttgcaaactattggcttttatgtattgccaatgcatgaaaaaaaaagagaaaatgctaattttttgaactgtcaaaagccggctggcccccctttgattttctgtccagctctgtcactgtttagctgaattcaagttttaaacgcaacatgggtgatctcgtattttacggctaattattttatcagtggtaggtttactcgttgacagagatatttatggtgacttaattaatctcaaaatatatcaagatgtgccggtccaatctctcgaagattttcataggggtaggggtgtatgttgtgtatttatagggataggtatgcatgtatgtgtgtgtatttatagggataagtatccacacatatatgttaataaatatgtttgtactattttgcaaggtgtatatgtgtgtatccctagggataagtgtgcatgcgtatatatgagcaaatacagttgtactatgtttcttaaaagatgcaaacatccttataaactactaactccatctgagaataatctgtacaggagcaggatgtatcatatccagtactaaattaacttattctaagacggagggagtaataatttgtaaataagggtataattaagtgcgctgacacatctaagtatgtattgtctaaacctcttattacgcttccagttttttaggggaaatttgtaaaaacctgctgcaaatatcaccctttgagattccatcctaaaaagatgatttgttgcaaattaatatccccttttcctaagcaaggcaaaaaata

SEQ ID NO: 64438 - DNA, 821 bp, Oryza sativa
ctaatattcatactagctagtgtatatgggtttcatggtttgcgatcaccagaatacacgagcaacggtaatcggtgattagggaggatattgaatcaaggtgaattagggtgacgtcatttgggattttctttaaaaaaattaagataatggaagatgaataatatatctccacggcctcttcacctacgtacccgcatatatatgtatagatcaatcggttttaataatgcaatttcgccggcaatattctaaatattcgtcattaaataacagttaatatgagaccgatacgatcgatctggtattgaaaaagcggtagaaaagtacaacaaaaggacaagaaaaagagcacgattcgaccaggaaatgcaaaggacgggcgtcagcttggtctcttttgttgacctggataattatatattactaatacttacatgtagaagtaattaattaatatcttctttacgcacgttctctgaataaattacttgcacacgtgctctcttctctagaactatatatgtcactgttgatcgatctgtgtctcctagctagttcttggttaacgctgataagatcgatgagatgctaccatagtggaagctgcattgaaatgcatgagctaagctacttgggtcaacagtttcaagtgttcaacacctaccaattttattcaaacgcattcgtcgattttcacggttgcttgcatcggtcgtctgcatgcgtatcctgcggagagcgatgcgaattaaatatcgtcgaagaacaaatatggattagtactgtgctatgttattagcaaatcagggctgcaggaa

SEQ ID NO: 64439 - DNA, 21839 bp, Oryza sativa
  unsure (1)..(21839): unsure at all n locations
tagttttagagtgggctttgatattttattcatgctaatttatcttttaatattggatttaaatcactaaaaaattatataaaatttttatccataaattatcttctagttactaataagcattataactttcaatcatatgtatacgaaataatatgactgatacgacaagggaacgggtaatataagtactactccctcgtctctagagttctccaggaagactaaggctatgttcggcaccccttattcccaacctctctccctggttttccacacgcacgctttttaaactactaaacggtgtgtttttgtatatatatatatatatatatatatatatatatatatatatatatatatatatatatataggaaagttacataaaaaatcgtattaatccatttttcaagttaattttagctaatacttaattaattatgcgataataagctgttccgttttctatgtcgatgggatagactcccaactggcacaaacgagcgcaacctaaggagagatgcgagttaagttagaaataattattatttgttaagatgaaaagctaaggggagaagttaaatgagacataattatgatgaaaaaaaccatagattgagatttgacactacatagaaaaaaccaatctaaatgaagatttgatatcacatagataatagaggtatattttatgacggagaaagcgactgctcgtatttgctacgcacagataaatccgtaagcgcatggataccgttgtatagcactttcccttagagcattccaagggtattaaatgcaagaaatgagtgtgtatatctacaaacaggattctacaaactacaacaatttgatgataagattggctagagataatttctatagattcaactagttatcttaagttaaaggtaaaattctatcgaatgcttcgagcattggccctctcttagtttgtcaaggtgaatcttgccttgagctctataatgcacctgaacatggagggatgcaaaggatgaacaaggttgtcaccacctaccgcctatctcactttcagttaagcgcacaacaaataaggtaactgctaacctacacaccacttattgactactaccctagtctcgcgtaggaacttccttttttatcgagagtcttagcactactatatcactttattataagctaagcgacaaacccgcaccgatgagaatatatctcactcaagtaaactaattaaacaatataagaaatctcgaacacttatttataaagcaagcatccgctgaggtacaagcaaaaagaaggctgacagctctggcgcttcttcggaactccaatggaagaatgctgacaaacctgacactcctccggaagttctcggagagaactctcatactttagggcactccttctggaactcccctcattcactcaataatccaacatactaagcaaaacctaaaagtgagttgtactctactttgtgtgttgagctcatcattttatagcttccgtatgatggttggaatgttcgttgttggcggttcacccgaaccaagagttcggttgatccctgggcctcacccctctccaccaactttcttcagcggcttacaggtgggcccttatggcagttgaggattgtttggtcccactttaggtctttttgactgtcaggtgcatcatccaatccgtgtacttgcgtatgattggccggaggtttcttttgtcgcatgacaggtgtattttcatccataaataacctgcatacatatatttaccaaatttagtggaaatggttagttgttagcccctatcactaagttttgatataactttttatattctttttgcaggagttgatagttaaagtttgcacttaatgaccatcaacaacaactattgtagatctattggagacaaaaggaaaaaaaagtattactccctccaattccataattcttgatgttttagatgagattgatatcaaacttttataattttaactatcaatagtttaaaaaatatttaatttaaagacactagaacaacttatatagacttgtcttacaaagtatcataacaaaaggaaaaatatatgtatttattagatatattataattaaaaaatatagtaaaaatatattttgaagtcaatgccattattcaaagggtaaattggaaccatgccattataattttgcaaagtttgagatatgacatcgatatctcaataacatatatggcccacatgagtcaatggcatgtaggtcaggatgacatatctcaaattttacaaaacgagtagtagattttgtagtatgttgaatgatgtatacgggcgccgtccagttagttgcacttaattgtcaattaagctggggttgggagggatgtataccttaatcattggacttaattgtgaatgttgcctttgatggtaggccgaaccatcgatagctacgagtttggtcgctggtaatgtaggagtagtttgtttgttcggctcgatcgatcggcgcgctgtttactcatactctctcttctttgtttcgaaatgtttgactttattaactttttagcacatatttaaccgtttgtcttatttaaaaaatttaagtaattattaattctttttctatcatttgattcattgttaaatatatttttatgtaggcatataattttacatatttcataaaagtttttaataagacgaacggtcaaatatgtgctaaaaagtcaatggtgttaaacatttcgaaacgaagggaatatatcataataacgaataaagcccttgtgttcaagtatataatctaaatatatgcagccaggtgatgaagcaatcagcaggaataaattaaggatattctcgatggagccaaagatggaaaagatagaaaatatactccgatatatctagatcgaaagtaatcaatcaatatatacagtcaatggagtcgagtggtagctgtgtattgttaattgcctgcctgccttggttttaacgatattacctcccataataggtgatgttttgactttttatttacaacgtttgaccattcgttttatttgaaaaattaatataaatttaaaaaaaagtcatatgtaaagtacttttgattataaagcaaatgaccaaataaataaataataattccaaattttttgaataagacgaatgatcaaacatcgacaaacaaaaactcaaaaaaacaagtaatatgagacggaggtagaactaaatagagtattatatatctgcgccgtgcgggtggtttattcttctataagactgtgtgtttgatggtggggttggaaacccatctcttatacacgaaaaacggaacggtttagtagtacataattaattaattattaattatttttttaaaaagatcattatgattttttaaacaactttcgtatatattttttttaaaagaaaacggacagtttatcagttttaaacatactatatacgcacgcagtatgtacgcacttgtgaatactgtagtaatatatcatggtatttgtcgacggtggacagccgtaaaccggatataaaggtattggggtacgttggtaccaagatctacgtagtacgacttcaaggaaacatgaaacaaagattatactggttcaggccccttaataggtaatagttctaatccagttggtatgggattatatggtgagaaccacaaattacaaaggaaataatagaactcgatgataccgacgagatcgtagtcgagttggttcgactagatcacccggcgacttggctcttgtagactctggcttcgtaggctgtagttattgtcttggctatgagattctatgccttaggtcctcacgggggtcccttttatatcacaggtcaggtggtcttcaagtaggactcggagatatcggaccctgcacgatacaatgacaacctagtcctatacgggtaggaactcttccactggtgaacttcgtgatgaatttccttagcgtatacagagaacgtccgtacacgcgcagatgtaccatatgtaccatatgtcgtacagcgtacatccaagggtagagggtataccttatccgtaaccctaacagtattgataatcagtagccctgataattaagataagataggactggactaattaatcactactgctagctgggtaggtactgtatttgcaagagcaaaataatacagcatgcagttattttgtgtacagtaataaaaagaagagaaataattgagtagagcagtagtatgcaggtagtaggttggtaggtggcgtggatgaaccgtatactcctagaaataattgagcacgtttgtctacacaaacgcaacgcaagagactagggaagcaaagtacttgatgcatacgatctcaactcgactagtatgtatcatgtatgtacgtacgtatgtactgtattcattagggtgggactgtatactatagttattattactagtattgttgacaaaaacaattcctaagttttgttctaagaagaagagcaacaaacgtaagtctataggagtactagatctttgcatatagtacccaataaatagagggagagagagtgcgggccaaactcccaactcccaagttgcaatcgagaataaataaaaatcccaatcccctccttctcttcttcttcctccctgttcccttttcgattcgattggattggattgttttgctggctcgctctctctctctctctcgtggtgtggtgtggacaagaaaggaaggaaagatggagggcggcgtagggggggaggtggaccacctcgccggcgagagggccaccgcgcagttcgacgttgaacacatgaaggttgcctgggctggctcccgccacgccgtcgatgtcgccgaccgcatggcgcgcctcgtcgcttccgaccccgtaacaataactttctccctctttctttctttctttgcacagatagatagatagattatcaacttcggctccccggatctctgattaaattacctgtatgatgctcttcttctcttcccccaatccttctttccttgttcttcaacaaccacaccacgccggcccgattttaccccacgataataatttcatatattatttttagtttactagcagcagccagcaggagtatttagttgatactgtttcgctgacttgtttgctaccctaattattattattaaggagtattttttttgctagatgcgatgcgatgcgatgcttattccactgctcctgctctttcttccacacatatctcctcttttactattattagtattgtcactagtaatattatttatattctgctatagtgattttctcctcagatcagatctaccaaaaccttgtacccacacaaatatcttctactctcttttttttctgatactaaacattataatatagctagctgcgctacaagatcgatagaaatttctcagcaccatacattatgaatcatctccatatatgatgtatcagtaataacagtaacaatgtaccaattgctacgtgtttttctgtagcctcctctttgctaacaaatgctaaaatgctataaacaaaacaatccattacgctcacaatggtttccttacatttttgactcctttccaatctaggtgttccgcaaggataacaggactatgctccccaggaaggagctgttcaaggacacactcagaaaggcagcccatgcgtggaagcgtatcgtcgagctccgtcttacaggtcaggtcccaatcccgtgatgcttcttcttcttttattaacaactgatcttcctactcttaactcatgtaatggtgttgttgtccattaacagaagaggaggcaaatttgctaaggctatacgtggaccagcctggttatgttgatctgcactgggtactaatatcgaccatattatcttcactatctactccaatatacagcactgaagctgctcaattttatccacaagctcgattaattaatagggaacaatactttgtgcaaaattttattttgcagggcatgtttgttcctgctataaaaggccaagggactgaagagcagcagaagaagtggctacctctggcctacaggttccaaataattggatgctatgctcagactgaacttggtcatggttccaatgttcagggccttgaaacaaccgccacatttgacccaaagactgatgagtttgttatacacagcccgacactgacctctagcaaggtaatactcctatctactcttcctctcttatctattaagatgctacatttcttctttaatttggaatttcttcaatatcttgttgcatggttcatgattttatccccatgtgcagtggtggcctggtggcttgggaaaagcttccactcatgcagttgtgtatgctcgtctgataactgaaggaaaggactacggcatacatggtagagtctcttgtattttgaaggtgacttttaagcagtatctttctttttgcgactcatgactatctatatatcaggtttcattgtgcaactacgaagcctagaggaccactctccccttcccggtgttactcttggtgatatcggcggaaaatttggtagtggtgcatacaacagtatggataatggagttctgcgatttgaccatgtgcgcatcccaagggatcaaatgttgatgaggtttgtccattgggttatcatgttttgttcgggcacttgtcaaatacattctgataccttgatgtaaccattctcaagcacacccatgctactcgtgtaggctttcacaagttacgaaagagggaaaatatgtgcactcagatgtcccaaaacagctgctttatgggacaatggtttttgttcgtcaaacaattgttgcagatgcttctaaggctttatcacgtgctacttgcattgctgtaagatacagcgctattcgaaagcagtttggccctcaaactggtggccctgagactcaggtactatgtcagatttgaatttttttttgtattaccacttattaatttgtttttatgctcttgaaacatttcctgtgacatgtattccttttgcttttactggaaaaaccattgtctgagttaatatttgtactttgttcatctaaaagaattaaattgataaacgagtttaactttttgctaccaatgacaagtggctaatggtctataatggttacaggtcctcaattacaagactcagcaaagcagactctttcctttgctggcttcagcttatgcatttaggtttgtgggtgagtggctgaagtggctgtacacggatgtcacacataaactggaagccaaggatttctcaacacttcaagaggcccatgcctgtactgctgggttgaaggctgtgacaacatctgcgacagctgtgtgtacaattatttaattcagtaccacttttaatggttatacttgctgactggtcatactaagcctgcaaattcatacttttgctttatcagtacacatccttaaaatgaataatggtcagatcgcatcaatgagtttacacgcatagctggtccaacagtctagccagtttatataacgagtgaattacacaattttcattgttctcaaacctgtttttttttaatgcaggatggaattgaagaatgccgaaaactctgtggtggacatggttacctgaacagcagcgggcttcctgaattgtttgctatctatgttcctgcttgcacttatgaaggagacaatgttgttttgctattgcaggttagtatgctattgttgttttgttctgtggatactaataactctcctacctgcttgtggttgtgtggatggcctagcttgttgggccgaatcataggtccagtccttcaagtttcctcagttttggtcaatttacagtcataacctttggtgctctctgcaggttgcaaggtttctaatgaagactgtatcccagttagcttctggaaaacagcctgttggtacaacggcttacatgggcaacatacagtacttgatgcaatgcaaatgtggtgtaaatacaggtatatagttgtatcttctggcaggctcctgttttagacagctgtatgccagtcatcactgtacgttatgtatatatatgcccattgctgggaagccattgatgttgagatgaatgccatagtgattcatttttccatgattatcgacagctgaagattggctaaatcctgctgccatacgagaggtatttgaagctcgggctctcaggatggcggtgaattgtgcccagaacataaacaaggcgccaagccaagaagaaggttggtattgcgccatatgattattaatcgagaataaaatatagaacagaaaccatagtgcatttgcatgtagtttcgtattaatttccgtggtctattataagaaattgcatagatgatgatggtgtgcgttgctgaatatgcagggttttatgagctatcccctgatctgcttgaggtggcggtggcccatatccagttgataattgtaaccaagtgagtattgcctaggatgaaagaaatctgaagtatggcttcatttatattttattggcatttatttatttcggtgtgttatggtacgtataatggttaggttcatagagaaattagagcaggacatccctggtgagggagtgaaggagcaactgtgcatcctttgcaatgtgtacgcgctgtatcttgttcacaagcatctgggtgacttcctgtcgacggggagcatcacagcaaggcagggagcgctggcaaacgagcagctgggaaagctgtatgcgcaggtatggtgtcctccgtcgatgtcaatgtcaaaagtggatgagaaactgagaaatgagacaaatgcaaatgcaggtgcggccgaacgcggtggcgctggtggacgcgttcaactacaccgaccactacctggggtcggtgctggggcgctacgacggcaatgtttacccggcgctgtacgaggaggcgtggaaggaccccctcaacgacacggatgtgccggacggttaccaggagcacctccgccctctgctcaagcagcagctcaagctctccaggctatgatcatccatccatcatcctccctttcttgctctatcaatcatatcatactgcatacgatttgagtagtagtaaaataacaccagcatatgcaaggtgctggctggctgctagtattttctttttctttataatttatttatttggggagagctggtattgtcttatttatttgggaagagctggtattgtatgtctggtgatttggtatagctgtaactgtgaacttcaccacatctcccccttctcaagggcatatgcattctactcctatggctgtgtttagttccttccaaagttgaaaatttgggttgaaattggtacgatgtgactgaaaagttatgtgtgtatgataggttgatgcgatggaaaaagttggaagtttggatctaaacacagcttatatgtatattgtgagattgtccgtgcggcgcttctagtgtgaaatatcctcccttgtcgagcatattaacattgcatgtactgagatacctcagtgtccctgaatgctgacacaacttgaacccaacgttcgtgctgcgatgattcagaaaaaaacacaaaagcacatactcctaaggttgtacagaacttatatagaatccaatgtcaggttcatcctacattcatataggcaagttatattactagtacattcagtcaaaaaaatattactagtacatgatgaacaattccaaccgattatttgtttattgacgtctttgattattttggtatttcaacttctgtatatgtttgtgcaaattcacacaattaatacacttatgattgttctgaaattttaatcactgcaacgcggtgaattagactgtagggcaactgttcttttcggcgacttggtcagattattacgtggaatactttccacttgctctacgcctttgaaaatacgttcgttctctcaaaacacctttttttttctaccacgatgtttagactaacccatttcacattgatctacatatatatgtttcgtggactatgtgcctataaattcatatggatgttagtgaatctaaatgaacaatggagatgtctagcaacgtgaaacggatagagtattttgttaagtttattttttaaagtagtagtacttaatttatccctatacaatcgagtagataaatccgtgttttcaaatgggaagacaaaaaaaatgttttcggcaccattttcaaggcatgtattccatgtttttttagaaaggggaaaactcaaattattagggcaatataaaaacttaaaatacataaaagatactagcgtttttcattctctattgaaaccttggggcaaaatagaattttgttattaaaaccttggagcaaaatactaagatagtccaataagaaaagctttaaaataaataaatgaatgaatataatcatcatcatcatcttcccgcttatcctgtcgtggattggagtccgtccaggtccaggtccagtgtagtcgtagccatggcgggtttggctccccctcccctcctcctcctccccctctcctcctcactctctcctgccgccgcctcccaccacccaacctcccccccttctcgcacacgccgacgacgccgcctgctatccgccgtggcgtctgccgacggtgatgctccctccccagtctctgtctccgcctccgccgccaccaaggggccttcctcctcctccgtgctcaccttccagcaggccatccagcgcctccaggactactgggcctcagtggggtgtgccgtcatgcagtgcagcaatacagaggttggagcagggaccatgaatcccttgacattcctcagggttttaggccccgagccatggaacgttgcgtaagtagaagacttcccttccttgtattctggactactcctccatttctcactgtattattcttctagttatgtggagccaagtataagacccgacgacagccgctatggggacaatcctaataggcttcagcgtcatactcaatttcaggtaaatgtttctaccataccatatccatcctatatatttagctcattgctgctgccttcctccgttatttaatctttcttttccgataggtaattttgaagcctgaccctggaaattcacaagacctctttctgcacagcctttcagcactaggtatttcactactgctttctcttttttttcatcataaaatgcacgccgatattcttctgtttctaccttctcatttatttatttcctttcctaatacattgttgtgaatacaaaatgttgtatataaatgtttgcatcacaggtatcaatgtccgtgaacatgacatccgttttgttgaagacaactgggagagtccagtgaagttcctcctcttttactctttccttcttaaaatatcaaccaatgcaatcattgaaccaaagtgtatctggttacaaaaagccggatcgttatttcaatataatgatctttcctttaaaaaagtctatctggttaagtcatcataattgcaactgaatatctctaattcattaccttgttcatgtttcttcccattgatggacaggttcttggtgcgtggggattaggctgggaggtttggatggatggcatggaaataacacagttcacatattttcagcaggtacaggcgttagctaaaacaattcacatatttttagtgcattatgttgactgctttggcatcacagtatttttttgacacttgatgtgtgtattatccccttctaatccttggaaaattttaagacagtttttcttaatgctaattactgtagtcaggaagccttccattgctgcctgtttctgttgagataacatatggacttgaacgcatcctcatgtctcttcaggtgagcctagtagtgttgttatctaccttagtagttttttatgagttagaagatgagcaaacgattaacaaactacctattgattttgttgattgtgtatattgcaccctttatgttcagagtctcgtataaatcttagtggactttcttttgcgaatattttctaccctactggatcatataccctttgaaagagctgaccttactttgatttagatgttttgacagggtgtagatcatttcaagaatatacaatacactaaaggaattacatatggagaactattccttgagaatgagtatgtatcttcttgaaagttctaggagctttgtgtaccttttcttcttctttagcatcttgcctgcaatgtgccatttctttcccatcctctttttactacattaagtagaacaatttcgtgatatatttctgttgtcttttattgattataaataattatatgcttaggctcaatactatatatctggtttgttgattcaggaaagagatgagtgcatattatttggagcatgcaaatgttgataacattcaaaagcattttgatgattttgaagaagaggctcgctctttattatcactttggcttcctattcctgcgtatgtttgattgatgcactcatttcttggctttcatgttttatttgttaagaattgacaagctgaccttcgattggcaatggattaggtacgatcatgttctgaaggcctctcatgcttttaatattttagattctagaggctttgttggtgtaaccgagcgtgcaagatattttggtcgcatgcggaggtgtggacctacataccttgatttttttccctatgccttttctcatcatggaatcctggttttgttgacttgatttatttatttaccagttattagctttacttttttcagttgttcttgtttctagcttctacgtaaagttaagatgtaattctcatactgtcgatgctcttgagcagtcttgctcgccagtgtgctcagctttgggtgaaaacaagagagaacctcggttatcctttgggcacttatcaagagtctaatcttatctatcctcatgtctctgaaaagcctagtagaaaggtatttcatttacatgaccatgtactattacttgtgttattttaatatttgaacccaatgggtgtggatggcttatgtcataacttctgcaaaagcacacccatttttacttatctttggtgctttttgtttagggagttgtcggacagccacgagcatttgttcttgaaataggaacagaagagttgccacctcatgatgtgatagaagcaaccaaacaggtaaaccaaacttcctccttcacccttataagatgagaagaattttgaacctaacattggcaaaatgatgtcaccttttggtcatatttgtttttttatggaatttatacttcaattctaggtggaatgacttttgcttttttcacctttgaatctttgacatcctccagctggagaaatctttaattcaaatattggagaaacgaagactgagccatgggaaagtacgctcttatgggacaccaaggagattagcggtatcagtttaacctttgttgtctcacatgagttttttttttcctagcgaagtctcacatttgtttctatactatcgcaagcttcctcatatattcttgccagttatgcatctcttgtgtctaggtgtgtgtttggaaaagctggccagtcctaacattccggaggcctggtgcagaacaacaaactgtaataatagtctaccaagtgcaaaacacatgatggagagatatctaatattaatcagtaggttccctataggtttgttagtaggaatggtagataaaactgtctgaaaatacaaaaaagaaatcacataatgatgcaccatatttaattgaagatatatcttggtaatgcgtcttttatgcttggtaactgacaattcttttaacatgctttactctggtctgaatctataagaagaccttctttgatttgtaggttgttgttgaaaatcttaatatgaagcaaatggaggaagagattgaactacgtggtccacctgttgcaaaggcatttgaccaagaaggaagacccactaaggttagctatccaaaaaggagctggactttcctctgctcttctgctattgcttatttttagggctttccatatcacttatgaagaaaatggtaaggtacttcaagtatgcagaaagtcatgctgaaagtaacatctattccattaaattacaaaaactgcacactgtttattatttttctccgttcttattaatgctgttgaagggcttttgtttctttgattttcttccttctattctcatgacaggctcttgatatttttttgtggaataattttctactcttattcaggctgctgaaggattttgtcgaaagaataatgtcctgatagatagtctatatagaagaactgatggtacgcgacatggttccctagaatttgtattgcccacttccatctcaatgtgttttgtcatcactgctacagtgcgtgttggttactcaatggtgatctgataccatctccatttcttgttacaatttgttgttcgaatcattatgtggagtcccatgtagaaacgaatccacccttataattaatgatatgaaggtctcccattgttctacagtcccatgtagattggccttccttgggtcaatctcctttgcttgctgcaccagtcgtgtgcagcttgttcctgtcacatgtgcatatgctgcactggcctctcttgcatatcttattctggtatttgatttaattagctagatatggaagatatactcatatgcatgggtgatggcctatatatgtaggcggtatgttcaatcgatactggcatgattaaaaacatgtgttaagaaacgacctatggtgggcgggccctcgtgtacgggttaggggcctcaaagcacgggttaaggcccgaacgatggggggcaggtctgcgtgtcaaggggccagggtttgtggcatttcttgaccggcttttgctgaggtttcttcttagcgcaatgccgtgggggtggtctttcccccgtcagtcgagttctttcttttttttaattatttatgctgtcaataagattcaattctcaattgcttatgctgcataaaccaactgacagctaaatactgggttttattttggttatattaatccgaaccaccgctacagaacataggccaaatgaaatcatgttagttgttagcctgttacagccaatttatcatttactagatgtctaacatatgttcttattgtttcataaagaggtctaaattgtgaatacacattttcaggtaaaacagaatatatctacgctcgggtcaaagagtctgcacgttttgctgatgaggttttttttcctttcctttatgtactcttgaaagccattgcatcagacaattgctggaagcaggacctttgctattgcttgatgacttcatgaactgcattttcaaaatacaaaaggtgtcccttttaagttactggggttcagggaatagactttttgctcgacaaatcaacccagtcgcattatgtttagtactagctctttgagccagatggacagtcatcaagattaagcatacttactccataacatactattcaattcaagctccacaactcataataggcatgcttctaatgcttgaaaggacgatatcttctaattggatactgataggtgatgattaggcaccatttagatagatcttgcactcaacaccccaagacatccagtacctagcaagtatcaactaaatgcattctgcataactgcatagttatatattcgtagtttctttactgctaaaattgtgcaagtttcttatgttatttaggcctcactttcattttttctagacttgttcaatagttgtagcatgtgaattgcaggtactaactgaagatctaccgactattatatctggtatttcatttcccaagtctatgcgctggaactccaatgtaagtgttatttaactcatcttctttacagatggtaattcaaatgtttactttgcagctgcttgaactccatgttatcattattgtgctttgagggatcatagccatctataaatgctctaatgccatagcagacagttaaaccggttgattacttgattatgtgttagtgtctctatttctgcaaatagaagcaaaatccgatcatctgtttgctgtttttagcatcattttatcactggagatgtctgttttattccaactgagggtgaatcacttgcagattgtgtttagcaggccaatacgctggatctttgcccttcatggggatctcattgtgccattttgctttgctggcatatcaaggtaatattttactacataataggtaatgcacttcagtttctgtttacataatgatacgcaaaacttcccggaggaagaaaaattctagattgcactcgagccaatttctgggcttctcttttaagatcttgggaaactagaataattgacttatcacaactacagtgatactatccattgccataatgtgtacaatattttgtagaaatgaaaacattacttgctataacaattttttttagcttaacatgtccacttatttatagtcatttccttgagaaatattgtttctcacagttataattattaacatgagttgcaatggcacagtgggaatcagtcgtgtggccttcgtaactcctccttggctaactttaggtaccaaatgtgttgtggtagctagctggttctgcgcaaccacaacaaaatggactttcttgcattattgttttcattatcttcatgttcttcgggccagattgatatccactatataaaaaaatcttcaatttcttcattctgattttcttatctaagagtattgctgcataaattgaaaaattgaaagtattttgcatcaagcagttcggaaaggcctttgatccagattaactcaaacatccagtaggaagatgctaggacatatttgtttctatctattcttatatcctgtctnatctagggaatagtctgaacattctccaaattcaggtgaaagctgcagaattatatttacacaccctggagaaagctgggatcctgattgatatgcaggtgagatgggcacacataatcttttcatgtgctatgtcatgttttgacttttcataggcttcgtagctgtaagctccatttcatgtactatttattccacacaagaatattggtgccaactcttatagcctgcatgaaacagggaaaatgctgcatgagtccattaatggtttttagttgctcagtattccaggtcctactgtaccttatgatgtatatgataccccactgcaggagcgcaaacaacgaatcttgcatgactctagtatattggctgagggtgttggcggtgatatcattgcacctgatagcttggtgcaggaggttgatgctcttctgctcctcagttaacttttcttgtacatacgtttttcttgatgaaattcaacttatttcaagatatattttaaaccatacgatgcaggttatcaatcttgtggaggcgccgatgcccattattggtcgatacgatgtttccttcttagcacttccaaaggatgtattaataacggtatatgcacagcttttgattggtgatgtgtagaagccatactaaattctgttaatttttttgattcagacaccaaaatgacaagtccattaacatagttcatttgttggaagttaaatttattaactgagagaacatctcatattatgtatgtttatgcaggttatgcagaaacaccagaaatatttccctgtaacctccaagaccatgggcaatctgctaccatgtttcataactgtgagatgatttttcccgttgtgtatttgtcttcttcgtcttcttgttcctttttaatttagtgtttgctgttaggttgccaatggtgccattaaggaagaagtagtccgcaaagggaatgaagctgtactcaggttatgaatgttttagcaatgctactgtgtaaaatttatagctggagctttgactggaagacataattctagataatggatagaagtagccatagtttgattaccagcattatgtttgcatcgtcttttcttccctctgcctttttttttattccgcaagagagctgtagtcaactgtagattttttttttgcgaggaaccgtagattctgaattggtatataaatacagggcacggtatgaggatgctaaattcttttataagatggatacgcagaagaaactttctgaattccgagatcagctcagcagcattctctttcatgtaagtacggtgtaccaaaattctcttagtttcttgtatatgtttacgtacataacatctgcatcatgttgaacaggaaagacttggtaccatgcttgacaaaatgaaacgtgttgagaacactgttgcagaagtggccctccttctcggaattaatgagaaaatgatcccagcaatcaaagatgcagctgcattggctatgtcagatcttgccactaatattgttactgaatttacttcacttgctggaattatggcacggcattatgctttgagagatggcctttcagaacaggtttctgactttgttttgtggtgaaaattttgttgttaaacttcagtgtgaaagttgtggccatttgtgcacatttggttgagtagttttcatgtcagattgcagaagccctatttgagataacacttccaaggttctctggtgatgtgttcccaaaaacagatcctggcatagtccttgcagtcactgacaggtatttcttgcatacgtagctttcatgttcaatttataatagtctgcaccttaaaatacaggctgggaattcaaagagccatatttttaggattctgtgccactgtattatttctgtacagttggtatagaggagagctgctccgatttctgttctcttggactggggattacagtgggtgggcagaacagtagggactatgcagctatttagttagttcacatagttgaaagtacaacttcttaccagctttatttaccagcaatgccaggataaaacaaacaaaatggtattgcaatgcaaacacattgtggaaactgagagcttcccagatttatgattgcttttgttttttccatgtgaaccacacaaattgtagatgctttaatatttttcttatttgtaattcagattggatagtctagtgggtctgtttggagctggatgccaaccaagttctacaaatgatccatttgggctaaggagaatttcctatggattggtaagtgaagttgagaatctacaaacaccatcatattatgaaatattcttataatatttttcatctaggttcaaatattggttgagaacaagaagaactttgacctcacgaaggccttgaccttagtggcagaggagcagccaataacaatagatagtggtgttatagatgaggtgagcacaaatatcaaataatcctgatgttaatctttgttgattatatggtttgtgtcaactctaattaatttctcaggtagtacaatttgtcacgcggagattggagcaacttttggtacgtatttccttgaacagtaataatagtctgagttacatataatgcttttattccccaagactccatccttttggaatctaccaaggattagagtagaagcttacctacactggaagagcaagtatcttttcccgtacagactggttttagtgacgttttctccctcgtacacaagaaattccgaagataaatatgcatactatcattgcttcatgtttatccatgtagcttattcagcatagtaccgagcatggattttgttgccatctctgcttctgttttcacttctgatcctttttttttatcaaatacaagtcaacaattgtcagtgaaatccatttcctgtaactgatggtttttcgtcaatttatcaggtggatgaaggaattaattgcgagatagtccgttcagtgcttatagagcgtgcaaactgcccttatctagcatcacaaacagcaattgaagtaagattcttcaattcttctgaatcctctgtatgttggatatggttttcaaatattacgtatttataatcaggaacgatatactatggttgtacagtgttaaattatatctgcttggtactttgctgaatgaatggaagtatgatttgtttttttttaatggtcttgatgtgtggaccttgcagatggaagcattttcaagaactgaagatttcccaaaaattgtcgaagcgtactcaaggcccgcgagaataatacgtggaaaagaaattgggtctgctttagaggtaacggctgctttgtacaaagaataaacaagtaccatgatgatatatctttcagattctgattacagctttgaattatgaactaagcttttggacagtagtatgtaccgctaaccagtaaccaagcctattgcaagcagagtttgattgttccttgccgcaatgttaatctttcctcgctgtgaatttatatgcaggttgatgcaagtgtatttgagaaagacgaagaaagagctttgtggagtgcctacttggaggttgcggataagattcatcctggtacacaatcttatccaaagtgaaaaataatccgagatccactgtttcttctgttgatccttttttctctcgtgtgaaatatatgtgctttgcatcgtctattctttcgggcgtgctgtatattctgtttacttgtatccacattccaccctgtaggtgttgacataaaagcctttgcggacgcttctctggaactgctgcaacccctagaagatttctttacaaatgtttttgtcatggcggtgagcttaattttcgagtactaagcatctacttagccatttattactaaatgatttagactttggtaatggtgtatgctttgctatgtggttggtgatacaggaagacgagagagttcgtaacaatcggcttgcactgctaacgaaggttgcgagtctgccaaagggaattgccgacctgtcagttttaccagggttttagccattttttgttgctcttctagttttatctgtaccatgcttgtacattcataccgactacagttttgcagccaagaaaagagcgtgatccctatatatataatgtataggtagctagcataaattgtcctcaactttgttgtccattgctatgttaaacatatgtttttgttttcaaaccattttggaaatcaaatgccataacttgtatcagactatataccaactcaagcggtatcttgcataaattccattctattccctttccctttgttgtttcatccagatcgtttccaggcttttcagttcttccaatttctgaagtacccacgaccaaagagaattaaacaatgagataatttggttctgatgaactggcgattagagttgttcgaagcacaatcatccttataaattacttctactacaatgtacatcaggagaagaattgattaacagctatatgccgctctagaaaaaaaagaaaagaaaagaagacgaagcaagtagctaccatcagatcagtaaatacactcaattttgtcgagatacaacacaagtctccgaaaactgccaatcaattacctccacttaagaggtgtatgcaatacatctgtgcattgtaacatactgatataaaaacaagatatcctatatcttctcttctcttctcttctcttctcaccctagagagatccactacacctcaacgat

SEQ ID NO: 64440 - DNA, 1564 bp, Oryza sativa
ggagtgctctgtgattatcgaagaactgaaagcaacatctttatgtttccaggtaccatcgaaatgctacaatttccagatcttattcttactgttatctaagccattggtttactgatgaaagctccattaataaaccattagtagtgtctaatcaaggtttttctttgtttttttttcctggcagtgtgctcatggacgtccgaccaccgtgccgattgtgaacgtcgcatctctccgcggcgagttggcgaggctcggagcggtgaacggaaggcaagaagagacctggcatggtctctcgcaccatggacccagccttgaacgtgctcgaacgcgcctcagagaactgagaaagctacgtggtggcctgtagctgtacaacagtacaagatgtaggatcatatagagggtaaatagtccaaaagaaaaggagaagtgttgcatagtgcttcaataggaagcggcttgtagtttgcagagatagatatgccattggttcacgaagaagaggtaaaatggccatgagccgtgttgtacacttgtaaaccattgtgatttgtgaaggccattctcaccctgtaaatatatgacaatatttttcgcagttttcagagcaaaagccaagtccggctctctttttttttttttacaaagcaaaaggtaataagcttagcagcttgggctcctttgaaacacatgaattttaaatgaactaacttgatttctacaaaatttatcttacaaagtccgccttaacaaggtttttgcctttctttccagatgatgaccaaagtagaagagacagtggtagcccaactcctcaatcctcaatctaaagttgggccttgcttatgtgggccagcctatgatcccaagccaattcagcccatgatgagaggacggcctctctcgtgaaccgtgcaatgtactcctacggtacagcgttggcgcgcggctgcggctttcggagttccatttccccccccaaatcctcccgcccaaatctcggtcagtctctctctctctctccaattccccatctctctctcctccacctcgccgccgatgggcgccgccacggcggacgaagacttcgccaccccgccgccgccggcgcgggcgcccggcggcagggtgtaccaggtgggcggcgtgccggtggagttcccgtacaagccgtacgggacgcagctcgccttcatgggccgcgtcatcgccacgctggaccgcgcgcggcggcagggccgctcccacgcgctcctcgagtcgcccaccggcaccggcaagtcgctctccctcctctgctccgcgctcgcctggcagcgccactacccgctgcgtgccccgcccgccgccgcccccgacccgttcctccacggcggcggcttcgtccccgacgacacccagaagcaggcgacgcccggtacgcccccccgcgcctctcctctccgctcgtgtcgcttttttgcggcggttcttggagccgcagatctgcaaccattcttgctcatttcgctctgcccgttcttgatgtttaggcgtcccggagaaggcgaccagg

SEQ ID NO: 64441 - DNA, 20578 bp, Oryza sativa
aagacgttgctgtggtctcatcagtgcgagagcaaggcaagtcatgcaatacaattgatcatattgtacccaatttacaaatatcccgcatttctattaaatattgcattgttttacaatatcatgtgggatgggtcctattactcagccatatattgtttaccttatgccattgataacgtgggtattaaaatgactagatgttggtttaggagatgcttagccatgcttagttcaactagtgcacaaagagggatcacattaaagcatagacttgattattggcatagctttgatttagtgccatcgtaatggtgttggttaattaaaatacacgtcatggtgggctgtgggtgcatggtcttgctagtcgcacccatggcatttaaggaccggttcgcgggatgccctggaagaactgaccgtacttaccacaagccagcgtgggcaacggctgggcttgtagtgtagcttttctctagccgacgtacccaggcgagggtgggcgtgatggagttgggtcggccggggtgtccggttgatcggcttccggattcactgcggcacgaaaggggggctgcccgttgcctgttggggacgagggcgaaccctaaggtgttgtgcgatcggttagagggggttatgcgaagggtcctgtcacggcctctttccggtatgtcgtggtggcatgtcggcgcacgggaacgtgtcgtggggctatgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccactccagagttgaagtccttctcagttgaagatgtctcgaagaggttggtttcgtcgctgccgtcaaggattgcctgtggaatggagtcaccgctgcaggagtcaagtcttcaggcttagctcgcttttatctttttccgctgcatttgtaatcttttctatttttgtaagacgtggatctgtatgtcaacaattgtcgtttgtgtaccctggctggtcctggacaggggtttaatgcacattcagcttagaaattctggttcgtgaatttctgggcgtgacaatcggctgcgccaagccggtctccgcccctcctccaaacgctgtcgcgccggccagatacagtcgtctcctactccctcggctagccgtccgaggccgccatgcatcctcccacctcagccacggtggtcaccaccgtgcctcctcccaccgcagccacggtcgtcaccttgcctccacattcacggccgccgcaagccggccgccatcgccgctgctgtctccagccgccgacaccgccaacgtggctgctgcctcgtcgccctccgccaccactgcctctgcagtcctccgctgccgccatcgcggccgtggaccaccgccgccgccgtcgccgccatcagggccgtggacctccgccgctgccgtcgcccccgggaggaccagaaccggcctcacccccgggccttcgccgccgttgccacatccgtcctcggtggcgcgcatccgtcacctcctttcggccgccgtcgccgcgaggctcgctgttcgctcggcccctggacgtggggaggccggatctgccgccgggggaggcggatccacctccagcgtgcccgaattcgccgcggtgacccccggcgccgcttcccgtgccgctgatcgccgctcgccattgctcggcccctggacacggagaggccagatctgctgccgagggagacagatccgccacgccgaccccccggtgccacctcccacgccgtggaccgccgctcccgagcagccctggtgtccccgccgctggcttcctcgaggaggggagagggccccgccgccgctgtccttgaggccggccggctttgccaacgcgccgctcgggcggcgcgaggcagaggagaggaggagggagggggcggcggaggaggatgaggtgccgcccatggacgggagcgacgcggacgaagaatttttggccaggagccgaactgatgtgctgatgattgttaagtggtaactatggcaatgcatgcgtttatccaaccatttgccatcaatgtagttcttactatcgaatattttgtggttgatctatgaaatcatcagtgtactcatgactgcaaagtgcaaaccacgtccaaacacctttgtacgctgttgtacatcaaacctctataatattcaaatccaaacgaaagctactcttgtttgtaactacacacaagatgattgtggaggtgcatccttgataatttctcctgagtatgcatgacagatggttagtttttgctgcaaaaaaatctctttgcttctatatattaattacttcctccgtaaaaaaacgaatctataattagatgtgccataacatagtacgataaatttggacagagatatgtgtccaaattaatagtgctaggaggttggttttttatgagacggtcataataaactactcctgcacaaatccttctattattaatgagtactcccaactaaaatatcactcatatctcattgatatatgagcttagtttcatatcacaatcatcaattgttcgacaatcttctcacatcgaaataatacaccacaaccagaacgacaaatgctgtgatatttataattataaccgagaagataagcaagctgtatagggagtcgccgaggaacggatatcgcctcttgatggcgtgagcatggcgaccacgccacacgaacctccaaaccgcgcgatacgtcgtcgctgcaggatcaatccacttctcgatccacaaaatcaaggcgttgaagcacacatagatgaccaagaacatggtgatcaagaccgtcctcgagctcgaggttgcgatgacgacggcatggatggcggagaagaaggccaggatcaggctgacgagcgagacccagatgcactgcagcgtcaccacgaagctcttccacgagacggcgaggtgcgccgccgccgccgtcttcccgtatacgagcaggatgacggcgaccactgacgtggtgatggcgaaggtgtcgaggaccatgaagtatttgaacgagatgttgtccctgaggttggccgtgccgtcgtccccgtacccgccgggcatgttgaacccgacggcgaagacggcggcggcaatgagaacagccaccaatgcgaggctgtcggatgtcttctcgataccactcgccatgtcatggccgctcgacggcttcagatggtcgttcctttgtggctgggcctgtgctccgaatgtgaccaatgtcacaacaaagcttaattacctacattacattcacaatgaaaatataggatgcaagtcacatatacagtgtaaaaaacctaatgtagtaataaaggcgtgaaaaataatctcagacatccattctgactatacggtaacagggttttcaattttgatattggccattttggttctcctaaaatttcagtatcttcagcacttcttggaccgatttttttttaaataaattaacataattaactgaatttgactaaattttgaccaaattcgtaaaaatttgagaaaaccgaaaatttttggccaagatagtcacttgcggggggtccgaaatttcaaaccaaaattgcaatcaatataagtttctaggtttatatatgtacactctagattactactacctccgtttcaggttataagactttctagtattgttcacattcatatatatgttaataaatgtagacatgcattgtccacattcatataatgaatctagacaactagattcattaacatatatatgaatatggacaatgctagaaagtcttataatctgaaacggaggaagtaacgagtaactaataacatagtaaatgggcatgcttggtttatggttgctcaccatattgaacaaactgtttgattctgaggcgagatcaagcggcgtgtgtccatcgtcattcaagacatcagtttgcacattcccctcccggagcagggcctccacaatgtcaggcgcgccggcgaccacggcgaggtggagcggcgtgttcccgccggcgtcctgcgcattcacgaggccacccatcattatggggttcttgatgtctagggacaccaccgacgagcgcctctccctggccgcggcgtgcaggaaggtctcgcagcggccgtcgcgcagctcggcggtgtctgggtagaaccctgtcagctcctcgacgatgccgccgtggcccagccgagccgcgacgtggagagcggagaggccatctgagtccttcatgtacgccgtgccaggtggcgccgtggccaggattgcacgtacgattttacggttgccgtcggacaccgtgaaatggagcggagtgctgccattgcagtcgacttggacggccaattctggcttccattgtagtagaaggtgaaccatctctgcgcaatttaatcaattgataagttaagttgggcaacacattctcgtgtttgcgctcaaaaccttagaaatcgacggttcaacgtgtaggatcgaatcacaagaactaagccaaccagaggggggtgaatggttggtatacccaaaaaccgaaaacttttagcggaaataaaagttaccctcgaaatcgatggagatcggtctgaccgagattgatctgccggtctgaccgagtggatgccgccggtctgaccgcccgtatgccgctggtctgaccgccggtatgtcaccggttggaccgccgaaactcggtgaaacacaaatcgaagaactcttaaagtggatgacaactttattacttctctctgtgtttacaaagtgcaccaacagcactccttacaaaaatttcgactaaactcgaaaccctaactcaaaactcaactcaattactctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcataccaaatttggactccttccaaattcgactccgcatcccatacgcacacaataactctatcgtatgccatatggaatctccatcaaccacatgcatcaactctagcctaagtatcccgcatgatctctgaccaccacggacgtcgtcttatccccaagccgactcccggtccatcactgcaaatactctcccgagacatcgagtcacctacacatgaaacaaacaaagaaaccatatttcgagaccaagctatctccaacttgactcattagcagcaaacaatagtattacatacgcatagtatccatctagaagtcataatcatggaataaactcggatatccaaataaacaacctgaaaccgaaaccgacacagtgtcggccggtcagaccgcggactgcgccggtctgaccggcagcacaagcccggtctggccggtcccacataaaatcacagcagtacctgtatattcacctgtgaaatccaatcatctccaaaaccactttgtgaataaattccaaatatcaaaaccaataatctccaatgcccaattgttcatcacagaatatgaatcaaaaacacctttgattttacacaacggattgatagcatactcagggttcaaaatttcagttttgctattcctatcggggacattgataggaccgaaatttccaaaactgcagaaattttggtccaaaataattttatttttaacaaaatttggtcagatttgagttatttttgttaaattcaaaaatagaagaaaaagtgaaaaaaaatgggtgaaacaatttgtatctatcccctgaaattttgaaccgtgatcatacgtaagcttcggaagacggcggcatgtagaggattctgcgagcttggcccggcggatgaagcatcttcgaaggtgataatgattgctctgacagctgccaccgacagatacagaaggaaggagagggggagagaagatgtcaccgtcaccgccgctccccacagggaaaagagagagaagggaggaacaggcccggccctggggcagggcgagcagtgcaagcgccctgggccccgccaagtcaggggccccctgaccaggtatacgtaagtaggtttgctattgccatcgtacaattcgttgatttccagtggatcgcatcgtctgctttgcaatccaacaacagcgtaaaaacacaagccccttaatttattgaggcccatacgcgtagctatagaaggcagagcagtcatttgattggtcaagcaagcctataggctgatggccaaggtgattatcatttatcaacaattttagtgctactactccttaatgaagggatcactgatattgatttttttgaaaggatcactgatattgattttgaacccataaatactagatttgtaaaaattactccatcgggccatacatatttaaaattctaaccatcaaattaatctatattggaaaatcttcataaaatatgataagtttaagatactatgattaaatttttttatgcaaatatgtttttcttatgctactctaaaataaagttttcttcaattctggcacctaatacaattaaaaaaaacgaactcaatatagggccctaatttttgtgtcgccctaggcccctaaaatattaggaccggcccttgggaggaagaagaaggggaggataggaaaggataatatgtaggctccacatataagtggatctcataatattttttcgtgtgaatgataaatggctcccatatatttttttttatttatgcctgtaatacgaatagaattggatgatatgggcaacgacgtacgtgatatccacattgactctgtgagtttcattcgcttggtatccacatcacacggactctctttcgtagttcgctcacgagtcgtgactttgcaatgaatgttacgcgtgacgggaatcggatgcagacgaagtaccatagttttaacaaaaacatcttcaatttttaaatcgcaggcgagggcgacatagtcccaatcagacatacgacaagggcgcaaatcgtgtgtgcgagggtgttgcggtctcaatcgcggcggcgtgtaaaggcacatgtggaaaatggactcaggcttgggcccgatccctgcgtgcgacaaggggtgtgtgaaaaggtgaggtcccaattaattcgcgcgcgtctcggataagagggacactctggcgtaagaaaaaataaaaagatttgacagaacaggaaattaaaaacgattcaaacacggatgacgcaccaaaattctgacggaaacatcttcaatttttataatagtagagatagagataatgctacataagcaccatgtcgtcaacgaaaccgctctcaaaaatgtcaagagagttaaattacaccgattttaatacttgggggttaaaatatcgggtaatatggttcaagcatgtaaatcagataccactagttaagtgagtcaaagtgaatttattcctcttcataatgcttggtgtcctctctctggtcttctggagagagggcatgtctgattacggtgggctctcggaccttgaccagcgttcagccagactgtcatgcgtcgtcgctcacggagctccactgtgcatggtaggggtgagcgttcggtctaaccgaaaatttttttcgtctcggttttcagtctttaaaaagtgaagaccaaatttcaacacaaaaatattatgaccaacaaattcggtctcggtcttgatcccgaccgaaattcaacgacatttttatatatgcaaagaaataacggacattttcaacacaaataatcacaaaaaaaaatttgtaagcatgtatgagtaaaggctcttattagattgtatgcgtagaagaagtagggaagtgtaagttaaagtttaatgctattgaacttagtggattgtaggttgcatttatatatttatttttattaatttggtcttttcggtctatttgattaaccgaggagactacgaattgactgaacaaaattcggtctttcagtacctaagaccgaatttctcggtctcaatcttggtcttttcagttcggtctttttctgcccacccctagtgctcgagggcccggcttgagcaggatgtttgggtgacccatgtaacaatagatattataattttttcgtattttttaaactttttgattttaaaaataattcctcccaaaacttatttctaaatttttatagcttttgttttcagaagttatctgaatagatatcttgatagtttcactgttttccattttcatggatacttaccctcgtgtttttttttaaaaaaaaaagtcggaatcagtttttgttttcaaaaattatctgactgatactatttgtttcggaatggaggaaactatccgaactgattttataacttagttatcaggtacgggaatatatttttgagattatataaataaaggtgagtttctttgcaaattgtataaactgaaagcaacctgggagtgcctgagagaggacggagctccaccatcaatagggggagctgcgatgcatttcttgcttgcacagagaagctgcattcaggaacaaaaatacagcagcaggaagaagcggaatcccgcaaatctgtacacagctcgtgcgcgtggattttgaaggagtttatgcgcgtggatttcgtatgagctctggtcggctctgttctatttctttaactccatacttgcttgttgtttgttagcacgtttttcaaactgttaaatgatactccctccatattttaatgtatgacgccggggactttttaaccaacgtttgaccactcgtcttattcaaaaatttcatgcaaatataaaaatacttatgtcatgcttaaagaacatttgatgataaatcaagtcataataaaataaattataattacataaattttttgaataagacgaaaggtcaaacgtttgtcaaaaagtcaacagcgtcatacattaaaatacggaaggagtatatctttaaaaaaagattttatatagaagttgttttaaaaaaaacaaataaatctatttttaaaatttataatagttaatatttaattaattatatgctaataagctttttttgttttgcgtgtaaccaaaatttatctccatatgtggagatagaacagatgaatattggcatcacaagtcactgaattcaaatattcgagtggcataataaccaaaagcttaatttgaccatatgccatattcagatgagcgctataggatatgccatcatctagaatcaaaaagaataaaaagctcaggtttaattaattagtttggtaaaaaaaatactaacctctattttttattgataactttgactaaaaagttatttactttcctattttacccctacaagtaatttaatcgtatgtctatcttcataatctagaaacttttatctattacctccacccaaaaatatagcacaatataattaaaagggatatagcttagtactacgatcctacagttagagattgttgtggcatgggaagagtaaaaggccacgatttagctgacatgcgagacccatatacaatgtaacgccgccatgaagctcttccacaagccggcggagcgagacgccttatggtagacaagtaagatcacagtaaccattagtgctgttacaacaatgttgtcacagaacatgaagtatttgaatgaggatgcgtcttcgaggttcgtccgccattgttcggtacccactgggcacgttgagcatcatcattcgccattggcatcatcgcgccactgccaccatcgcacgtcgctgtgaagaacaacgtacgagctggatatcttgtatctgaggatgctttatttaatcaaaatctagtgcgtaaagagaggatataatctttggactgattatattgattgtataatgtagaagtaaactgaattagtttgagctccactttgcttgttgccttgatgctgctatatgggtatagctaggtgttgttgctgccgctcaagtggtcttagcaatacattagggatttatggtgtcataataattggctaattgtatttgatttctacttttattatgtgtaagctcaacgcctttctcctactccattttaacacaatttcgcagcagggtcacattaaaatttaaaagtgaccatggataaacaatggtgtcaattagaagtagacgattataacagacataactctaataatatatgatctactaattcaatatatttctaaaattattattcagttatccaccattcgtattgtttgctcaacgtttctaaaaacatattttctaaaaaaactttcctctatgaaccacttgttctaacatttttcttcatgtgaaaacaagatgagagcgcacatccaaaaaaaattatcaagtttttagtttatgcacgacaatatgatgtctatgaagttagagatatttttgggtccgtagaaaatgagctagtttcacttagtctttaagttccgagaaatgacgtgtttggctacaatgctagcatgatcctagcttgacttggcaagactaatcgtttggtatcgccataaaatcctagctcccagaagcgaactagcccaaatgggccagaaaaaggctagctcatcagggagagccaaatctgctcgcttccgacgacaaactaatcgcgcgaaaaattgatgatacacacaaaacgatttctcctaaacctaccaacaatcggcccatatcccatatctcatcgtactcttcctcaattcttgactaaactctcaggttagccaatagtaataaataaaacatgaagttgtttctcgaataatgaactataactcttttttagataattctttttgcacattatctctgttgtttaacgaaaacactcgtatatatagtcttacgttacttgcggaaaaattacaagccactaattttaactaaagagagcaaacgaaccaaatgcagagatacaagtaagcaatgagttgatttgcctttgccgagttaggctagttaggaaaagaaactaaaagtgcaccatagttactgctagagatgctacggcagggacgaaaattcaaaacaaaggcaaaaggcaaaaacagtttaaaactcgaactacggaaatagattccgaatttatccttgttttcctctttgagggaaagagttcattcagtacactgattcactcactcccgagtcccgacctccctcgcacgtgcttccctgcgtcgaccccgtcccgacccgtccccctcactcgccgccgccgccgccgccgccgacgccgacgccgaggacgacgacgacgatgccgcggaaggcctcgtcgacctcaggtacgcacctccaaccctcgccgaactccaattcccctaagcaagcgctaattccccgaaccctaactcccagattcgcgcctgaaatggcggaagtggaagcggaaccccaccgcgtccccgtcgccgtccaaccgctcgtcggccgccgccgccgcggcggaccactccgacgactccgactccgccgccgttaacgaggacgacgactccgcggtccccgaggacgccgacgacgaaaccctagccggggcggaggaccccgtgctcgacctccgcgaggcggaggtgctcccttcggcggagcccgtctcggcgttccccgtcgccacccgacgcgtcgtcaaccggccgcacccgtccgtcctcgccgtcatcgcggccgagcgatccgcgtgcgcgggtgagggttccgccgcggtggcggcggcgccggtgctggagaacatctcgtacgggcagcagcaggtgctctccggggtgctccctgaccacgcttcgctcgcgacggacactgacaagccgtctacctatgtgtgcacgccgccgaatcttatggaggggcatggcgtgaccaagcagttccagggtcgcctacatgtcgtgcccaagcactcaggtccgcctgctctttgcaaccaaaaacctgaatgtctgagctataatgcggcactaacttgtttgcgatttgtagattggttctccccagggatcgtgcacaggctggaaaggcaggtggtgccacagttcttttcagggaagtcgccgggcaacactccagagaagtacatgctattgaggaataaggttattgcaaaatatttagagaacccaagcaagaggcttgcttttgcagagtgccaggggcttgttgcgaacacagctgaattatatgatctcagtaggattgttaggttcttagacacttggggaatcatcaattaccttgcgtctgggtcggtgcaccggggtctaaggatggcaacctcccttctaagggaggagccaaccggggagttgcaactattgactgcgccactgaaatcaattgatggcctaattttgtttgatcgaccgaaatgtaacctccaagcagaggacatttcttcattggcatcaaattcggaggttgtggattttgatgctggacttgcagaattggatggaaagattagggagcgattgtcagagagttcttgcagttattgcttacagcctttgaccagcttgcactatcagtcactaaaggaggtgagcatctttgtaattttcgtttagatgttctctccccatttttcatgtgcaggaaacccttctatatcttagtgttgttgcttacattttgtttgacacctaaaagatgaataatacaaaaactgggaaacgatatcacagtaagctgagcagtagtctagcaagttatgacacacgcttttgctgagaattgacatactagattctgttgttgaaatttaatatctgtctgtctgtgtttgccaacccaatgaatacttgctctgtgttttgcatcataatcctgctcctcactgctctgtgtttgccaacccaacgaatactctacatatgttgcgtcatgctctgttctgctaaaacatggaaactgcatttttaatttgagaaaagaaaaacatttagaacacagaatcttacactcttactagtcagcctaagcaatttatggtctttccatacaagtgatcaacccaaacattatattgtgctgaaagcttctgaacagaattggttattaaatgatcagtgttcctgcatagaaaaaaatcacaatacaagatacagtcaacaacaatattaacttaaagaattaatagaaagtttatatggttgttcatgccacttttcagtgagtgataagagtaatgtggcaattgattggatggcaggccgtagtgatactgtgaactgtcataagaaaaaaccctgcaaaatttagttgaaataagaagacacatacaatctgtagtattcttttgaattaaaatacatataatttgtagtatcaaactgtattgaagtgagatgattcatgtaaacttgacaaatattgaattatttattggaagtacaacataaagggcaacataaagatcctaagatgcctatacaataacatgttagaatgcagctgggatagggataaaagttactaccaagagatttgggatgtacatctggacaagagcatttaggtggatgtttactgcagccacctccctgctgctggtcaatgggtgcctagaatgtacggattggagaaggatgcacacctgtgcaccatgcttatacttaccagctccttggttgccgtgcggtttactgctgcaaggaggccaacaatcaaattcaaaattaaggagagcagaaatgatgcagatgaaacaataatgttagacactcaaaatgtgttggataagaagggccacaaagcgtgcatccatgacagctactgtcctccattgaagtatcccttgatgcagcctgccaccacaaactccataacagctttgaaagttctgcttggaattttcagggtgaagatagcaaataagacaactgctccttcatatattagtagatattattgatggtatcatatatttgtggtgtagcaatgactagaaccctgtttgtagctgaacttaactttaagttatgggataggtgagtttcacactttcacttcaaattgcagtttgtgctattttgtcaactatgcataaattgattacagtagtactctattttctttgttgaaggaagataaactggtaggtctattttgcctgtgcaatattaatgcatcatgctggttcccactcttttctttgtgggggatgagaagcaaacaatgacaatcttcttgttggttgagcaggcagatatcgctctatgctctgattgcttccatgatgcgagatatattactgggcattcaagcttagattttcagaggattgatggggataacgatagatcagaaaatgatggggatagttggactgatcaagaaacgttattgctgttggagggcatagagaagtacaatgacaactggaataacattgcagagcatgttggaacaaagtcaaaagcacaatgtatttaccattttattcgtcttcctgttgaagatggtttgttagagaatattgaggtgccagatgcatctgtgccatttagagcagaaaccaatggatacccacatttagattgcaatggcagtacttcaggtatttttacatatttacactgatagttcctctgttatcagttctcgaaatttgttttctcacaaattttagattataataactagcatttttaacattgattaccatgtttttccataggaaatctacctcaaaaaattccacctgataaccagcttccgttcattaattcttctaatccggtgatgtcactggtaagcagttgttcactaaacctgtttagagaatgagtggacaatttttcggttttcaacagtgagttgtgtcatttagatttggatgacaagaatgcatggtactccctccgtttcatattataagtcgttttgactttagtcaaagtcaaactactttaagtttgactaagtttgtagattgatatagtataacatttacaacaccaaattagttttattaaatttataattgaatatattttcataatatatttgtgttgggttgaaaatatcactatttttttctataaacttggtcaaacttgaagcagtttgactttgaccaaagtcaagacgacttataaatctgaaacgcagggagtactattttttatgttagctcatagaatttgtgtttatctccacttctttaattctatttgacagtgacattttcttactgaagttatatttgcatagctctgcttggcactcctttggattataatccgaagctgattttgaatttgggactttgattttaggcttaattatgttcaataagcttggttgctgtaacaacagaaagtgttgaagttaaataagccaatgatgttacttccaaaaacaatttgtatttgaatgccaatttgatagttagtagtagctgcctttattcctttaatttggaggtggaggtctaagctgaactatcttggaactcgattttgaaaatcatagcttataattgttgattgattatccagacgtagcagttgattttctctaggctgaaagttaaatgcctgtacacattattttcagcagttgattaccagctcaaagcctcaaaacaccatatgcactatagagctgacaaaatagtaatggaagtgcactacgagtgattttagtattaaatgtaatcagttggaggtttagtaattaggatgttagagcaatgacatagtagaaagccccttataacccctcatttttattattcttttttgctcgtatcccttctaatcctcagactgatctgaggttcatttcaaccttagtgccttccaatttttgtgcctgctccagacttagcattcctttacaaaatgtatgctggcacatatacagcgagccactgaatgcttaagtttgagtaaagtgcatgggtgatccttaaacttgtaggggtgtgtcatttaagtccctaaactctaaaactacatatccaagtcccaaaacttgtcatagtgtatcatctaggttccaaatcgccatggtccttaaggatcctacgtggcgctgatgtggcatgccacacagacatgacgtgatatcattttgattgacaaatgggatccatttaaaaattttcctttttcttgttctcctattttttcctttcttctcctttctctgtgacccgagcagaagaaaggaaaaaaaaatgaatgagaagaaaacaaaaaagaaaaagaaaagaagaaaaaagagaggaaaaggacacatcatgttcatgtggtatgccacatcagcgccacgtaggattctagaggggctgtgttgaattgggacctagatgatacactttgacgagttttgggacttggatctacattttgagagtttggagatctagatgacacaaccctacaagtttaaggaccgcctatgcactttactctttaagttttatagagatctatacttataacttgattggcgcaggccacaagttctgaagtgaattcttattagttcaaatgcttcctcttgttctgcctgccttggtgttattaatcaagatggttttgtccgtcatattatctcaagtgtatgtgttatcttccttgctgaatttgacctgactatgacactgtttctagtatagagtgcttagtaacacgagaaataacatcagtattatcctgaattacttttcatattgttccctgattaattttaatttgaaattattgcaatcacacaaatcctgtgcttcactgcttcaacgtaaactagttctcatgatgtttgaaccaaacatatataggcttcttagccttctgtatatgtctggcattgtgtgtcttactgtttggagatactgtgcaggttgggtttttggcttctgctatgggaccaagagttgcagcatcatgtgcaagtgctgctttatcagttttgacagtagatgatgattccaggttagccatcttccctgaaatgttttattttagtagcatgattaaatcatttaacacttcagtcaggattttagaaaaaggttacataaattgaatactagatcttatctggtacaactacaagctaccagcaataaccatctttgagttctgtttgagtttattttatcaaacagcatatgagtactagataaatgaataagattagtccagaaatatcgcaccaatacttgtagctacagtactactgatacggctacccagatagtaaccaggtggttactactgatctttatccctcattgagattgcggaacttatccacctgatgttaaaattggacctttggtttgtttcatttggtcgttaggttggtttgcagtctcctttggacttattatggtagatgtaggttttgacttaccttttgctgaacactgaagggtgaattcagaaggcatttgctctgattctaggggccaaggtccgcatccgaattttcgtgatcataatggtggtaatgacttcatatttattctccactatgataatcagttttctgcgcaatctcatgtactcatgcaagatattagtgttaaggaaaccatcctatccttaaataggtgtatcttcatccatctctccagaaaaggtgaagcatgctgccatgtgtggtttgtcggcagcagctacgaaggctaaactttttgcagatcaagaggaacgtgaaatccaaagactaactgctactgtaataaaccatcaggttagtgtgaacgttgccatcttgtttacatttgggccttgtttttctcattattgctgtcaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaaagaaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccaaatttttgaattcaaatttcgatttgtaaatttgtcgcggttttgcgcggttaccgcggttaccgccggtaaccgccgtaccgccgggtggcggtaaccgggcccccggcggtttttgaaaccctggctgtcacatctgagggtgtgttcgccgttgcatggaaaacggagcagtccattagcgcgtgattaattaagtattagctattttttttcaaaaatggattaatttgatttttttaagcaactttcgtatagaaactttttgcaaaaaacacaccgtttagcagtttgaaaagcgtgcgcgtggaaaacgagggagagtggttggggaaaagggcatccgaacactgcctgaatgtctgagtgtgcaaactcctacttaagaaaaatgcactattgcatagccccactttatggcttattttgtacttggtcccttaaaatatgagttctagaaagagtttgaaaatggcagtgtaaagttggtgtctgtgtacacgatttcctttcctagtctaatttgatggtgaaaggtgtttctcatacattctgattaggttttggaaacttatataactcaattgcctataataccaggtaggcatgtctccaatgatagtgttgtggtgaatgataagtatagctggtgaggactgagtctataactggctgaactaattgtgtcgtcagtcttatgtataattgccagtaagtaggatcaataaaattcaaaactgtaattcatctaggaagcaagttaggaaactgtaattgatctatgtttgatctgccgttggtcatagtcactagctttttttaccaagttgcattgtcgtcattgataatatttgtttgcaacaacaattaacttgcagttaaaaaggttggaactgaagctgaagcagtttgccgaagtcgagaccttgcttttgaaagaatgcgagcaagtggagagaataaggcagaggattgcatctgaccgtgtccgaatcgtgtccacccgcttggcctcgcctggaaatagcctacctgggggtagtactagcaccatgtcatccaatccaatgagtatgagccccagaccgatgggcgtgccaggctcgatgcctcaatccagtatgccagcaccatttgccaataacatgcaggggcatggtcacccccagatggcattcttacaacagcagcagcggcagcagatgctgtcatttggacctcgtctgccgctgtcggccatccaaacccagccatccccacagacgtcaaacatcatgttcaacccaggcatgcccaattctgtaacccctaatcatcatcaactgttgaggtcgtcttctggaaacaattcaagtgtaggataggagaaagaaaaaagggagattcataagattccaaccagtgtagcttcctcagttgtagctttatatgattcataaacatctcattgttattcatttgtacaatatgttccattggtcgtataatttatgatcacttaggttctcattttatgtatttatgatcacttgggttctcattttatagcctcaaaagtgttgttacggatgtctcacgatatatcgtttgaatctggtgaaattgcaatatttgcgctttaaatatcacatagcaaacataaagccctctttggcacaactcgagatccaagatttaatggagctgggtatttctaggagttgggtatttatagctccataaatccatggatatagatctatgatcacgcggataatatttgattcaatcaatttgttcttattttaggtaaaatttaaaattttaaaccactataatttaacatataaacattaaatatactgtaaatctaatatttggagctatgccaaatagcatttagagctgtaggttggttagaactacagatttagcgttggtcgaaactacagattttgaaattttacgctaaatctgtagaatgctaacgttatcacaaagctatagatttagcgtgaaatttctcataaaactacagatt

SEQ ID NO: 64442 - DNA, 1503 bp, Oryza sativa
cgagcgtgcgttgcttttcggctctcgcttgattcctcgcgtggtcgtgtgccgcccgcccgataccacccacaggcagccagagtgtgttgttgtgttgtgtcccatgcatccatgatcggtatggacaggcaggaaagcaggggttggacgacaagggtgattggagacaatgtgtgcgtcgatttccacgttgattaaggccttgttcactttgttatcaatttcgcagtgcgagcttgcgatcgacctcaggatactcaaaagtttaaaagtttttcaccatataaacttttgaatgatatattggtaatcccaaataaaaaagagaacgcagtcaacagtaagacgtccatggtaacttcgtcaatctcaagatatgctaatccaaccttctgaaaaatgctcatatggtataggaaaaataaagatagtcttcattgtccatgctagcccacgaaaccataatctctacgcccttaaatatcagggtagtagtgtggcgttttcccctttcttggtgttttcccctctctctccccactcaaccaacgctccctcctctctcccccctcaaccaatcgacgcgctctcctccttctaccgcggcgcggaaggtacgaagcggtagcaaagccaagcgaagcaacaacagaatattaatttgtcccgcacctcaaacaaaatactgtctagcttctagattttctgtatatatttaaatatgtacttactacatatatactccctccttccctaaatatttgacgccgttgacttttttaaacatgtttgaccgtgttcaaaaacttttatgaatgtgtaaaactatatgtatacataaaactatatttaacaataaatcaaatgatagaaaaagaattaataattatttaattttttttaataagatgaacggtcaaacatttttttttaaagtcaacggcgtcaaatattttggaaaacattttgggatggagggagtatacacataccggccggtagtctaacgtgttgggtagagatcgatataacatgaagcataataaccaagctgcacgtgaacacacacgcgaattgttgatcgaatgctgtcaacaattatatccgtgtgcgcgcgtcttaatctgtcctgaacccgatactgcggatgcgtgtatgtacgtgtacagaccacataatgcgaaaaaaaataaaatacatcctttttattatcaccaattttacatgaatatatatatatatatatatatatatatatatatatatatatatatatatatatatatatatatatatatatatatatatatattctataaatattaaaatattagaataatatttggtcaaaggccgttaaaaccgtttcagatgcttatttagttgtttaattggtatacaaaactaagggtgtgtcggcaccccttttcccaacccctctctcgttttctacacacacgttttttaaactgtttaacggtgcgtttttttgcaaaaagt

SEQ ID NO: 64443 - DNA, 1670 bp, Oryza sativa
tcaaggcttccacatgtcttgcaaggaggctaggacgagcaggagaagggtgtccactgtacaggttgatcgatcgatcgatcagagatcaacatgttgatcgatcaccctgccctcgcgggagcccgggtcatagcggttccagaggcgcttggttcacgcacagctcgctggtttgttttaatctcaaccaaatcaacggcttggaatataggactcaccgagttaaaggaaaattaagggatagattttattaacgccacgtgtcagcttaagagcgttttgaggattgccacatggcagcgttggagtgttttaaggaagtttaatggacttttagtatataatagatagatagatagatagatagaagatagatagatagataatagaagataatagatgcctgcgggcttatgatgtaataattagcactagactctcgtgtatgtgcatttggtatttcaggtatgaactcgtgtataccagactacttgatcttgggaaatggtattgtttacacgaatgattcctgttatcaaaacgggggtccatatattggaagagcgtgtgtagctaaataatcatccatagctatctttattaaaaattgaaaattactctactagtgaatagttgcatttatcttatccaatgataaccattttccattttttttttctggcggcttccaccagggttgtgtgggggagagggcggcaacgtgtgcggtgaagcggagcgaggctatagagatgatgtggtggcgtgcaggcgtggagacgacgtgacacgcagctgtggatgagccgaccaacatggccggcggtggcaggacgacggcgcggtgacagccgggcggcaataggacgacaatgggcacacaacaagaagaaggccggcagcgtgggaggtcggtgtgggcaacagcagggaggcacgagacattatgaaatcaccttcgatccaatacccttcaatgtgaatattatgaaattctactccacgaaaactccccaaaaaaaattggcactcaaatacagctccaagagtcaagaatccaaactgaaatatcatccatttaattcctcactttttataccaaaaaacacattttttttcctttattgcttcatgttttttgagttaaagataagcaacctgagcagaggagaggagctttgatcgaaatgcatctttacaggggtagcccggcccgataaggctttgttgggccgggccagtaaggagattactctcaccggcccagcaagcgaaatgcttccggtccaagtccaacacgcacccacctcaccctttgctgcggtctctctctctctctctcggcttcttcctccttgcgcgcagcctcgattctcgacttttcttgctgtggggagaagaatcgcgattgcgcgaggggatttcttgctgctcggagatgccgcggattccgctgatcaagttccccaagaggaatctcaagatcccatccccacccccaccaggtgctgctctctttcttcttccccccaattccaatcctttctttcttgtttttttttttttctgttctaggtttatagtgggggcatgatgtgtcgttcgggatctaaatccctttgattttcttcttcctgcagcggcgcaacctgcagatcagcacgcgt

SEQ ID NO: 64444 - DNA, 2110 bp, Oryza sativa
gtagagcttggccggggtggagttggagggggagaagaagcccatggcgaaggcgccgccgtcggagacgacggtggcatcagaggttagcggcttaccggggacaagccggtcgtcggatgaacacggcggcggcaggaggaggaggacgacgacgctgatgatgacgtaggtgaaagcatctgatggatccatgaaaattggtctctttcttgctatttgtgagccaatgttgctcagaaatcttctcaagacatctgcttgctttagaaattgacggggaaatcaaaatatacaagcacgtaaaactaatcggtgtgcattcacgctatttatactcattgcttcaattaattgaaaatactcagtgtttgactcttttcagtcttcaaggtacagctttgacaacacaattatttattcgaatacggttaaaaattctaaagccgattattggctattggtcaccgaagagtatttttgacgacattcagcattgacgcatcagcttagctttgacaacataaggattatctattcaacatgctgtggcggttattggtcatctcaagccgattcgcgttgtgaaaccggttagaaactcgagaagtaaaaaaaatcaacatttcggcaaatttatcaagttttaccggctttcgtggcggtaattgtgataaccgacaaaaccgcctagcaaacggtgttcgcctggcaagtatgtatttgagaccttgatgtgtcctctcattttttccatctaactggctgttttggtccaaaacttcgacaaatttgccgtggattgcttcaaatcaaaccaacttgcgtccttatcctgaaagcttcaataaagacagctaaaaaaaagaccaaaaatacttcgccgctgctactttacgatattaataacacacagggtcagaaaccagtatttgactacagaggggatgcagtatctgtgtgcttggcataaaatttgaagctaattttgattattcttagcaattattggaaataaaacatgggcaagctagggcaacgaagttgacggagaagcctttgaaaattaaattctaaaattcggctggtgggtttcaacaacaatttcttcggaatcagtaattaataaaatcttagtgggctatcagagagagtggttatgctagcagccaagcaaatagctctattccattatccatttatcctactggtagttgcgttgtatcatatcttaactagtgaaaatactttctcatgatgaaaaaagaaagagccacgtcataccataaatattggtcataggattggctataaaaaaagagaataaatctcagccggggttgcaaggaagttactagatcccaagaccacttacgaacctgccgatctgtcacaccaatggcccattttcatttttaaccctataattatttctctttagatgtatctatactaatataaaaagaagttgtcctcctccaatgctacaggtcaaatcatccaaattgatctgaaccgtccatccgcgcgcaagttttctccaccgcacgatttcaccgccgaggattccacgcgcgaagacatcgttcctcctccacccgcggccgcgaagaccgcgcttcttctcctcgctcgctcctcctcctccccgcgtcctcgccggagctcctccccgctgccgccacttcgccgcatcctcgccggagccgacctcagccccttccgccgccaccgacaccggcgtgcactccaccgatggccggcaccgaggttggccctcttccccatttgccacttcatcatcatcagcatatcgccagtattggccccattgttgaaagcctagagtacgagtaagtccctaaatcctgttctttccttaatcttctccatacgtgtggaaattttgatctctatgtctgatgatcttcgttcttgagcattggtggttgcatttggtagatgaaaacacgatctgaaaacgagtaagttcccttccacctccaccgctgccaccgtcggagccgatgtcttccccagccaccgccgaagctgtggtcttccccatccggcgccgccgaactccaccgaccccgcatgccaccctgct

SEQ ID NO: 64445 - DNA, 1628 bp, Oryza sativa
gactgcagtaggggatgctccggccccctttgccccccctgctgcgtccgtccctttgctcgtgtagatgtggtttcacgatagatctgagcttagtccggagtaatgttttgtggcttatggttcaaacggaagatattcttgtgttgattcttgtttgccatctagaacatacattatatgggattcggaaacactggacagagatgaatttccaataatttaatgaagaaggtttttttaatcttttgtcatgactatccagttatgccattcagatgcaacacggctgctggttaatttgatctgttcagctaattgtttactagtgacattttttctgcggacagttgttttattgacctatttactacatttgttaacattacattgatttctgcatttcttttattggaccaaatttctcaaaactacaattactttggcaaaactaatacaaaagtacaggtttaaactgctgtgtgcctgtatcgcagaactaaatattcccaattgaatttatcaaaaaaccaggtttaagacaatattaaaaaattacagtttaagtcacaatatatcaaaacattaggtttagcactgactctttccaaaaactatatattataaaagttccacaaggataatgtttttagagcagaatctctaaaatctgtatttttgtgataaatctgtgctaattaagtcttgtggtaacttcgatgttagatgtgtagttttatgttactatggcttaaatatgtagttttgtgatattttgtcatagcatttacagatatatgacatttacttttatgttcgtagacctggatgtgctgaggtagaataattagaaacctccaccacctacatatgcaccccaccaccaccaccttcttcaattctctatggcacgctttctcgtttggagaccatgccttgctggctgatttggctactcttttcttttccagagcctgtcaaccacaccaatttttatttttctcattttcgcaggatagaatattatgcttcttctatactgtgatagtgtgatgtttcctcagtgtatgattgccaaatgtcatttggatagctgtgctgttgtcccatggacaatacaggtgctggtgcattgggatcgacgaatttctgtccacaagctattcattttagttcaactttacctttttctatgtttgttattttgcttggatatgaacaacatatattgatttactgaatggaaatattctactgatcggtcgtttcataattctgatggaaaaatgtgttcataacattttcaggagttaaatcagaggcaccatcttcttccggggagattaaaaattaccgctttagatcagatgtgccttccccaccttcttatacggctgttggagggccagcttcactccttcctaaacgcaagccactgtcagaggaagaaattgaggctatcatggtatgtacttgttcttaagtatgtcatttgcaaatgcttgcaaacaaactttataacttggacaacttatttgtgcaaacatcaaaattttctcatgtgaaagtgacatcagtagatttctcatgaaaagtgctttcatgcactatatttatgatttttccat

SEQ ID NO: 64446 - DNA, 563 bp, Oryza sativa
tcagcgtcctcccccgcgagcggcgacgggggctctcccaccactggcagcgcggctgcgtcctccctcaccaccggcagcgcggctgcgtccttccccaccaccggcgcgcggcggcgtcctcccctaccaccggtggcagggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactattaaaacgaatagaaatcgaattttttgccgcgcttttttccgccctttttattttttttttgttcgttttttactttttactaaccttttttttttgccacggaatcgaacagacctctgtagatgtgaattttttaagtagggacaggagtagagatac

SEQ ID NO: 64447 - DNA, 4445 bp, Oryza sativa
caaaagtgataaaggaagtgtatacatcactatccacacattcaaccctcgaagcctgaaactttagctccaatcccgaatacttcttgaaaaataatagaaccaaggatctcattgatgtatgaggcaatatgagtcgcaattagtggtatcgacgcgttggcacctagttacacgataagccctcaaagcaagttcttgaaatagtgtgcaaggtgacatgagtctcttcggctcttgaatcatgcagaacattcatatgtttgtctattaaccatttcacacagccaaatatcaccatcaatatcattcatgctatcccctcaaagtaggatgtagcaattttcactcacatccattttcctcttgattcctcttctcttagggcgacactaatttccatttccatcgaataatgacaaaataaaatgaaacagataacattatttccaaacaaaattctttttctcttttttttctcctccctctctttggcactctctatataagctttcatgctggttatgacatgtctcctatttctatttgattgcatgcatccttaaggctcttctccactatctcatctagttgtttagcggtatttgctctccgtcatgctaatgtttcagctttaagactcttagaaaaagttgtatttgcattattttctgcttgcaagacttgctcagtattcacttgttgcttaatgttagcaaatagcaaccctcttccttgcttccgtagcttagcatatgtgtttgaagttcttacccctcgatcaatcaaagagccatatttgctacagctagcactattactcacacatgaatactagcagctaggtcatgtgtgtatgctccgtaatatatattatctatgtcttataggagtaagtaataattattatttttttaatgatattacatttatatgagtaaataatacttacatgcatatgcattaaacagtgaatcacaactcacttgaataatatatatagtgcactacgatcactggattaataacaagtgttgatatctaatttacccataaaaatatttatatgacttatatcattcaatattattaatccttatagcattatagattaagtttagcaaaaatatctttcgtattaaatactatatatacacttgtttaatatctttcgtattaaaagtatttatatgacttatattgtttaatgcataaattaggtatcaacacttgttattaacccagtttctagtcctttttgaaattgagtttttacatttctttagagaggtatttaagggtattgtttttcttatagagaaatcgattttttaagggaggagaggatacaaaaatttgttttttcgaaagctgtaataaaaaagtataacaaaaatcaaaagttattttctgagtatgaccaaaaattgcttaatttcagcgcaaatggttatgggttcaggggttgatgcggagtggatactatgtgcttcgacaggaatcctcgagcctctgaagtttgaaccatgaacgtaatccattaataaaactaggaaagaagccgcgcatatgcacgggtatcttgttcattgtctgtaaaaagagtgctaaaagaaatgatatgtcatattgtaagtactatagattatcttataataaaaagagagaagaaatatctacgtagcaaaatagaccatatactgtaatacactaacaataagaatgtctcttggattcaactaaaaatcactttatcccaactatacataatcttgtctattatcaccactacttattatcatcatcttcaaagctaggtcaatggaactgcacttataccacctaaataagcctaatacatcattaatacactaaaaaggtcatccacgctacatatctaagtgttcatatctcacttatttccaagtcatcctcgctacatatctaagtgtttgtgtcttatttcttttcacatcatacccgccatagacctaagtgttcatctctcacttatttctaaatctatttatgactgagaatactacttctaccatataataagataacaccgttagaattagacatgaatacccctctagtgggtgaagccgaccgtagccaccaagtctttcttctctattgccttgaaacatggttcttgcattaggttatattttaaaacatgtaacttagctttgtttttatcctatatttctagaaaatatataataattagtagcaagtataaacatcatgaacatattttgcttctaattttaattctacagttttaacaacttataggtacaacttttgaatttataaaggtgagatggagtattcataaaacacatatttctttccctctaatataccaccttcatcaacttgttagcgtatattactatgatgcggtgtttcttactcagtatcccacaaaaataaatctaaaaacacaccaaaaggatattttaaaggtacaatgttgatacaactttttaagtatttgattaattgcttaaaaaaatctcacgttctaaataatctctaagtagtatacaaatgctaaaaaaagttttataggctaaattagcaagtgtgccaatagacacgctgattttctagtgtgttctataacacaatacattggcccagtttagttcacgaaaagaaaatttttgggtgtcacatcagatgtttcaccggacgccgaagggggtttttggacacgaataaaaaaactaatttcataactagctggaaaccgcgagatgaatcctttgaacctagttgttgttagcatatgtgggttattgtagcacttatggctaatcatggactaattaggcttaaaagattcgtctcgcgatttacatgcaaactgtgcacgtgtgggttactgtagcacttatgactattcatggactaattaggctaaaaaaattcgtctcgcaatttacatgcatgtgttcaaaatgtgatgtttttgagaatttttttttaaaaactaagggggtgtttggaataaaaaatttagtccctctctccaaaaaataagggggtgtttgggaactagggactaaatttattccctctcacaaaagcataagtcattatggtagggacttatgtttttgtaagagggattaaagtttagccccactttagtccctccaaccaaacaccacctaagtctctaccctaagactaaagtttagtccctctctcccaaacacctcctaaaccaggcctaagagcaggtacagtagtaggctataagccagctgtaaacatattttaagaaaataaatgaggagagagaagagcaacgggctacaaatttatagccagctgtagcacggactccaagacaccgtgtgtgtatgacaggtgggaccatgtattaatagtgtagtatgtaactattgtatgaatgagctattagattgactatagatgaattgaagctagtagttggctacgctattaaacttgctctaatcctcatcatagtaaaaagtttgggataaacagagagtagcgcccccaccaatgacacgtgggccccgcggagaacacccaccaacatccgtgaaacttccgagaaataccaaaaatacccctccaagaagcacagggggaaagcacaccgcccgaactccgcctccgccccgcggccggacaaaaaatccggaaccccacccgtagaggcaatgacatgtgggccccacgtgaacccagaccgcctctctcaggacacagcaaccgcgggctagcgtacgcgccgcgtacaagagggaggcggtagccgcgtcgcgcgccgcgcggccaatgggaggcgagctcccggatcggtgacgtggcgagaaaatgttttcagatcccgcgcaaactcgcccaccgcccccgcctttaaaggcggcgcccttctccttcccctttcctctccaaatccaatccacccgcatcgcatcccacccacgaacgcttcgccgcttgataaaccaaattccccaccgccgcttcgttctcgccgatccggaggtaaatccatggctggctgcctcgaaatgctgctcgaatctccgcgtgttgggttgtttgtgttggttcgggagtgtgtgttgggttttgggttgttgtgttggttctgatcggttttgttcttactcggtagggctcgagatgaaggcgaggtcgaggtccagcaatggcgactccaggtgagttttgttggtggttttgtgcttgtgctcgcgggtggtttcggttcgttttggttgggttgggttttgatttggggttttttgtggtgtttcgtgaaggctctcggtgaggaagaccaaggcggagaaggacccgaacaagccgaagaggccaccgagcgcgttcttcgtgttcatgtgagtcttagatccgtgggtttttgtgttagtggttctccg

SEQ ID NO: 64448 - DNA, 2374 bp, Oryza sativa
gtttaatctgcacccatgtgtgagtttaagttattgaagtgcatccattatccactggggaactcttggacaatttacaaacatagatcttatcttcaaactaaaccccgtcactgtcagtaatcctccgctcatatcatttatagattggatttgatgtgttttgcacttgttgacaggagtcagaggcttagtgtactcaccaatgtatcccaaaatatttctcatatttgtttcatcaatgcattgttctccatgatggcattcaaagttttctcatcaactgtatattcacataagcctcctctaacaggagtttcaatctaaggctttggttcttttctgcagcatctcatgcatcatcctcttgcacaaatgctacatcatgcgttcatcatcactttgagtattatcacctcaaatgctctctaccttcctttgacacacctctgtaatacatgcataatatttcacactattatgctgtatatgtagttatatatatatatttttctgtagctttgatgcatgtaattttgaatagcgttgttaaggatccatcattcaactcttcaatattgttatcctgtacaattattttgtattttggttctgctgcttgttctacagctttacgaactatgttctattctaacaggacaattttgttatttgtatttttttttttgcagcaaggtggtatctactgatattgcatccgatgaataagataccaaaccttttaaatggggtcactagagccatgtcgatatggaccttttcgttgtactccctttttggtgtcaggaagcagctgccctgatactcctttttttgagtattgccaaaatgaccaattcgtgaaaactgaacatgcaatgcatcggttgtttgccaaaatacattgatcatggagttatgccatgcaactcaactaattgtcttattccattgctccaaatgttctgagacatttgtgctcatccatgctgcttcagcaattaatgctttcatcaaaatatcgtgtatctgccagttggacgaaatgatgctcctatattaacgatagataatttataagcacacaaaatctcattgattagacaggctttgatgtgcttctctttttcgctggtgggggccttcgctgtcccagtgccgtgtaagtaagtaatcccatgtgatggacatatgaatagctctcattaatagttctgataattctttgtttgcacgtttttccttctttttttccccctgttggtatggtgtaatggtctccacatggtcacatgctctgttggaacttggaaggatttaggtgactatcggttttctatttgtttccgtagattctaactcgaaggtccatttgaaacaagaaaaacacatgatttgtggtatgcatgatgcgtgcatgaaattcaatgttacaggaattgttcacttgggttgctcgtgtgcataatagggaggtacatggatttggagagttgcatgaaggatttccatgagattgtgctttgcccccatgttaatgccagttataagagtggggatagttgtatggcagtaattctggattagttgggaatgagcatttgaacaattacatatgttacacttggacgaagagattagcactcttaggggcttatgtcttccccaagttattttttccaattacaaggaagatgcacacacactatatggattgggtagtggcagctccaggaattttcgttgcgtggttctatctcatactttgaaattgcgtaatatcaaaattgcatctattttatcaaaaatcttcggaggatttgaaagatgggatactcctatgccaaaatggatgatgatcaaaggaccatcctaaaaatacctctagaataggcactgggattgagactgataaaagttactcccaccgtttccaaatgtttgacgccgttgactttttatcacatatttgaccgttcgtcttattcaaaaaatttaagtaattattaattcttttcctatcatttgatttattgttaaatatatttttatataggcatataattttacatatctcacaaaagtttttgaataagacgaacggtcaaacatgtgctaaaaagtcaacagtgtcaaacatttcgaaatggagagagtattatgtaagagaatccccctccacactatacatatgtttgcgaatagatctttgaccttactagaactttttggtggggttccaaccaggcataataacttgtaattgatgtaatttgattccataaatctttttcgaacaaaaatatgcttggtttccaaggagacattctccacttccaatcgtcgttgttaaaaagaggggagggggtgcagg

SEQ ID NO: 64449 - DNA, 3516 bp, Oryza sativa
tggtgacatttctagtctaatgttgggaatgaaaagattttattttgttctcaaattttaatcatgcaatggtttaagttgatcatcacctaaattaaaacggaaatttttggctctcgaaatttggagaagttaacctctaactattttgacaagaaattttaagtcctaaaatttcgggtatgttacagtctatcccccttaaaataaatctcgtccccgagatttgggtagggttggcttaagttatgactatctccagaggattgacattgacagcagataataatttcttttaagttgtatgacagacttgctaccataaaacatttggaaacttttatttcgcgggtgagtggcaagttctactcagttgtgggtttatggaagcttagatagttagttaaattgacactagagaagttagttccaacaagataaatgttggttcatattaacaggagcttataaccagatttctaacttagatgaacttatgtttacagattttccaaagttctggacagcaagcacagaggtttctaaattaaggacaaacgagttcttagttactattacatccatccaacaagttcttacataaatggagtacatggcagccatattacatatattacataccacgattttcttccaaaatgggccaccacatacctagactattccttaagcttgtccttaagtcatactaccgtggcagtagaggttagataggactattgattaatctctcatcctcagcttgaagactcgaccataccattgaacatactctggcggtccatacggtccagtggttccaagtggaggataagcagtcctaacatcgacgcgcgaaggtgggcttctttcaatatacattccaacaggtggtggtatatcttctgctggtgcaagcatggcatcctcaccaaacatgaactccggtgtataatgtccctggcgataccttggcataatgattctttctaaactggctaccctggtgcggacgcgttgcagctcagcaaaggttgagcgataaagcatatctagtgagcgcacaaagtttgcaagttggaggtatggggtatgtagtcctacacctatttcagctaaccctgggtaggtagtgtgttgagctccctcagttaaggatggaacgtagcagtaaaattcttctatctcaggtagctcatagcgaaggcggatgatagcaacataagcacagttttgcaaagcggacttaatatcccacccataaccagtatattgaaggtctttctctagtggagttctaccccgaatgcttacacgaaccatgactgcggtttgggatgttccaatgggtttcttgaggatatgatactcaggtggataggtgaatcgggcgtactgaagcataagccatagcacatgctgagttgagttccaggtgaacccacggcaatagcagtacggtgtgtacatggtaggcatctataagaataaaatttagaacacggattagccaaaaacctctaaaattaacacttacaaattaaaggttttccttactgttattattaaggtcgacacacatttttttaacaacctatggttatatagacctctaatcattaattctggtcatattaacggtacagggcttactagaatgggatttctattttaggtctaagaagaattatgcaaggttaaaaattttatctttggttttgatacaaatatggcttactatcccccttaaaataaaataatttttttttgcactaggtttttttttttttaacaaatttcagaaggtaggagctaatctgacatgagtgctaggtgctggaattcatcactttactgtcttaatcaaatttttaggtctagctctaaagatacaaaaattttgacaaaaatcagagagatagatgggttagattaggagctaccctgaaggaatcatgactttatcatttgtagtttaggctacacaaatttgtgaaactgacaacctacagatttcaggacagaactatacagaattatatgaatttttatgccatgatgcaatgactcaaaaattcaaccaaaattcgtggagcctacaggttatgtatgaaaactactgtaaaaagatgcatatttaatcaattatggtttgggctacatgaaaaaaaatgaatgcagctactacaaatttccacaatatgattatgctaactatctagattgtttcactatgatgcacgggtctaaaaattatgccaaaattcatgatgcttactgggttagtctacatgatgcatgtaaaaaattctcaggtttatcacctacggtttagtctagacaaaaataacaagcagactgactcaagattccagaaaaaaaaaagaacaaccggcacaaaatgaaactttaatcaagttttaggttgtataaattttatcaccttttagtcgtattatgttagggtggtccagaggctagatgaattttgggtggtccatctaagcaaacaatctagagggttaagcacagcaaattctattctatacccaactacacattttaggccataccggtgaaattttgaaatatcgggagaggaaagtacaaaatcccaccaaattcatttttggttcagagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggatgctt

SEQ ID NO: 64450 - DNA, 2219 bp, Oryza sativa
agattggcaaggctggtggtgacaagtggaagtccatgactgatgctgtgagtgtctcacttccccttatttgaactgttccatgtgcatttgcgctaattggtcgcgaattgaggagttgctcggtttctctgatgccgtgtctcgttctagatccgtttactcttgtgatgccagtgttgtccatgtctctgtattgctcgtatggatctaattgttgctgaggattaattttagcctgcttacttgtatcactgttgctggttcaacttcaaatatgtgggggaaaatgcacttaaatttgtttgctcatgggtaaattcagattaggggttatgtcgtagttgctgtgccttgtaaggtcggtcatacatgttcaccaagttgaaattgctcctcgttccaatcctacaaatagatctgtaaattactgccctaccttacttggttaatgttaagtcagaatgttcaccgcgaagtcaaattctagtaaaattttgtggccatatgtactcaaccgcgatgtttaggcttgtatttggaacagtggtttcatcatttgtgctgatttgttgtctctgtcgtttgttgtgaatgctctgttagtgtttcagtccaccttgtgctttgtttagctcttacatttgaggtgttgaaacgatgcaggacaaggctcctttcgtgaccaaggctgagaagctcaaggctgagtacaccaagaagattgacgcctacaacaacaagcaggtaatccccctctccacaactctgcacctgcaactgtcatgacacattgaaactgatctgttgtgcgtttctcgttgcaggcaggaggcccggctacctcaggcgactctgacaagtccaagtccgaggtgaacgacgaggacgagggcagcgtaagacctccctccaatccgcaacaccgtgtctccattaactcataaatcttcttgtgtgacctcactgactgttttgtgtttgtgtatgtgcagggtgacgagtgatcgatggagggctgcaggtagtagggaaagttctcgagtcggcctaaccaaagtggacgttgctggttgctgctccttgctagtgttcggatgttgctgcctttagcttttagtcttagaggtctcctcctgtagcttagctctcatgtggtgtcctcgctctcttcggcacttgaccaccatcttgtcgtctgttttgtctcactgtctgtaatctaagtgagtactcgtatctgttgctgttttaaatctcagatctcagtagatggtgccatctgtgttagttgctgaagaggaaaaggaaaaaaatataacaagtctcttgcatcctgtttaatgatgcatccggatctgtcagttcgtttacttgctttgcattgtgatgcctcgcttctgaaatgtttctccatgcgcttttgctgtgagcctgtgtgcagttctctgcattggtttgggtaaggttcagtactacaagttgctgaatgtttgtggtgcatctagtaacctgtgtggtacagtaactgccactgctcgatcttgtgatgtacagtaataacttgatggatagtagttatgtcttgtttagccgcgattgttggaactgtctgagaagtggctggcaagttgcattctgttttgggtatctcatatctgcatgcttgtgatgatcttctggttggttcgttggatgtgaagctcccggcatgtggtggtattgtacacgttctgtcaggattggagccgaacagcagcttggtggttggaaaggttcttttctcagttttgttgttactcccattagggcatccacaatgttgatttttaaccggtaagaagtattaaatgctctcttcctatccggtaggaagcattgtaagagtggcaaagagttaaaacccagccatacatctactcactgatgtactgtagtgatgattcgaatgcatggaaattgcggagagtggaatatatcttgtgatttctactgtagtaacttgccacgcaatgtccacaacttctgattcttccagtgtcaggtgaggattttgttggatccggacctgctttcaagagatattattttttgacagttttggttagtatttatgacactcgaagtgcgtgagctgcttccgtagcatagtggtagtgcgttcgcttcgtaagcgaaaggtcgcgagttcgatcctcgccgggagctcgatccctttc

SEQ ID NO: 64451 - DNA, 1618 bp, Oryza sativa
gtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctctccacctataaatacccctcctctcattcattccctcacacacctcaagaagaagatcaagagctctctcaagtattgtttagtagttctacagatagtggagtaggaaatagaattgtcttcatagtcctcgagttttcaggagatttcgggtatggctttaatagctttcctctcttcttttgtgagacttattaaattaatagaatattcttctttatacaagttcggtattttattccattcatattacttgagtgctgactttactttatactcgtgtaacaagctttccagataggtgtattgatgtgggtttagtgtccgattattcggttgctctaggtcggttgcaaggatgtagagtagtattttactaatgtaagcgcggtgcttaaattattaggtaccactaattggggttatatactgcggatgagaggtgggccgctgatggttacagctaagtacgggtattcctccgcgccagtatataatcctaagttaattacttggggagggtactcctccgtatttagccctggttgtatggtcatgacgggctagggtggcttctcgaaacaccaagaggacactgggtacggggtattggttgcatgactgtataatagcaagtatagactaaagatgtatgtatactagaagtacaggaatgatacttttcttattctttcaccacttagcttagactatattttagagtgagtatttcttagttctttcttctgtgtgtcaccctaccctttgaactgagttaacccctgcatagactttgatgtatataagtaacatataaactattaccatagtactctcttatcatatcttcccttgggataaaataaatacgataccttggaatactcccgggtgaaatgctacaatggtatatccgtgcgcttgcggatcacatctgtaaccataatataccatgagtatttctagtgctattgctggaaattatatttccagtagtgccactaagaaataccaaacaagcatttctggcgccgttgccggggaagataaatgattaagagttcactacttgctaataattttatatttacctctatataagtcactgtcctttgtaggcaaaccttgtttgttttctcttttatgtaaaacagggtagtacaggactggttatgatctgccaaccaaattcatatctagagtcactggtgaagtgaagccgacctcgtgtcgttcatcctcaaggttactctatcggcaaccagaccagtcaatttcgcgccacaagaattgcatgatacggctgagaagaccctttgcaagtttgctgctccctctgttggataacatgctacatggaacccacgtcagatgggagatggtgctttgatctgaaaatctgcttagtcaagatggcgcaggcttgcacattctgtggcaagcctaaggaggatgccagtggttatttacagc

SEQ ID NO: 64452 - DNA, 1276 bp, Oryza sativa
atcacgccatgaagggagactacggggaaagagaactctcggaaggaaagcaataatgacggtagacaacaatttattccgtaaagcccatttcacggttctgcaacaatcttcattggtagctccgtacatcgaggagcacttggctctagttcgcgctagaaacatcggtaagtccgatgcatggattacacggcatcacattgatactttccccgcgtggctacgacaacatctcatgggtaacgagacgatcaaccaacaactggccttcctagcgaggggaccatctggctcgatcgtgatattccaaggatatgagatcaatgggtacacattctacacgagagcccaagacatgaagagcacgaaccaaaacaatgctgttcgtaatgatgccatgggacacgatgaaaaaactggcacgtattacggtgccatcgatgacatatgggaacttgactatggtcctctcaaggtccctctgtttcggtgccaatgggttggcttgactggtggaggcgtaacgattgatgacaatgggataacaacagttgaccttaacaaggttggatactcggacgaaccttttgtccttgccaatgatgtaacgcaagtcttttacgtgaaggacatgtctagcaaaggaaagaagggcagagggcctgatgagccgaagcgtcacgtggttctcccaggcaaaagaaaaatcgtcggagttgaggacaagactgacgaggcagttggatgggcaaccccctttcacggtgacgattgaccctagcatcctcctttcaaatgaagacaccccttactcacgtagcgatcacaaggagggaacaatagtgagaagaaagtacgtgcggtcaaccgtcaccgccgatgtattgccgtaattattgtgtacacgatgtaaactattttggatgaattgattatccaaataaatcaattgttgtatggcatatgttaattacgtacgattattagaattcttaacaattttaaatcatgcatatgctagttatatgcgataaatagaatttttaaaagttttaaatcatgcatgtggcatttacatatgttaattagaatttttaacaatttaatatcatgcatatgctaattatatatgattattagaatttttattaattttacatcatgcatgtggtatgtacatatgtaaagtttaatttttaacaatttaatatcatgcatatgctaattatatatgattattagaatttttattaattttaaatcatgcatgtgt

SEQ ID NO: 64453 - DNA, 4947 bp, Oryza sativa
aaagttaatttaagcacaccgccacactgatgcatgattatatctgtacctatatatctagctttctgagaaattatgatgtagattcatgtgcaatcttttggcaatcaattggtccatttggtttgagcaaatcaagcataaggttaattctttaacacactagtgtcataatggtgttctattagttaggaaagagagataagttaataagagagaattaaagaagacggccagccgggtaggaaggggaggatgcgagtatgatgatggattcagcgtggaataaagtggaaagcaggcgacaccgacatgcatggccttgagagggaagaggctggagatcgagaagaagctcttggctttgctttgtctctgcgctttaatgtctcatgatcaatgcactgccctattcagatcagtgtctgctcatctcagtattaaagggaggattagttgtaactcaccaaagaacgcagcattactagtgctccttagacctggcctggctttgtgtttttcacaggccagtaagctagactacagatttgtctcatgcatttggagtagatcataaagcaaagggatacatgtcacataactagtagtagtaatacactattacatcacttggaagttagtacttctactgcagaacagatgcaaaaaagttaaattttactccctcccagaaattttctttgtcaagggcgaaagaaagggatcaaattctcaaagccctagctactatacccaacctagcttattatagctgaccaattagcagttttccaagcaattaatctagtagtagctgtctagctaggatcgttgccctatatcacagtatgatcatgaccgtgactgatcattgatcatgatgagtgaaatagtcatcaaagagatataagtcaatttagcaaatatatttacatggtagatcgatctatatacacatgtagtagctaaaaactaagatgatagaatatagatagatagatagatatataccttgatgggcatggtgtcctcgcagtccttgtcgtcgaggcggtactcgtgcatgacccagtcggtgcggacgccctgcggcgcgcggccgcggtagtagaccagcgtcttcttcatcccgatggcgcgccccccgtgctggtgcaccacccgccgtctttccccgtcgacttccagtaccccgccctcgtcgccctgttcgtcctgaacccgttcggatacttccgatcccgaggcccgaagaaataccactccggatccctactcggcaagaacgatttctctgcaaataattccatccatatcatcatcatcatcatcatcatcgacatctcatgtcatcgatcatattaatcagcatgtgttcaattgttcatcatcaggattgattatatatatatatatatatatatatatatatatatatatatatatgcaggcatgcatgatcacttaccagcgagctcccatggctcgcacttgtagaggtcgacttcagggatgatgtcgagctcgatcttgagaccgtggatcttcctcttgaggtagtagttcaccaactcctcgtccgtcgggtggaaccggaaccccggagggagccccaccggcgccatcaacgtcgatgtcggtggccgccgatatgacgacggcggcctctccggctgctggccggcctcctcctcctcctccggcgccggcagctttgcccaaagacaccttgcttcttctgcgctgctgctgaggcctttcccagctgctgctgccaccacccttataagtaggtttttcaaggcagctaatgctggggtaggaggcacagtagtagggacaccggtcgacatagtcatccctcccacaagattttggtcgatcggatggccacctttggctcctcttttgcagattccctgatcaccctcacaagaagcttgaaccttttccatctctctctctcactcactactagtctactactactctagctagcttctctctctctccaaccccttgtttgatcaaaatatgtgtctacgactacctctgatcgactatagtgaaccaatgggggttaaatatactggcctccctggctatgtatagatactatgtaatctagatcttatcttgggtttatgagctatcaatggctctatctctaagagttaaaagcacttctaccaatgtgctatgcttgcgcggtttttgcggatatatggaggttgtacgagatatctataaagtgtaacgcatatatcccatggatatcaaaatttagatatcatttatgatcaccattattttgtatcttgatatagatgtacatatagcttgaagattttataccgattaaatattagtgtcacattttttgtacgtatgttgtagaaactgtggatggtttgacgcttaaaataggacattggagtgtttcattgcccaatatacgaagcataacacatgcatatatgttgattttcaaatttggatatgatttatgctctagtattaactgaaacacatttattttttatatactagaaaaatgcccgtgcgttgcaacgggtgaaggctattttaatcttattgttgttcactgaaattcaccgtgagaatacacttagctatatatttttctagaagatcatatcaagttagcatgcgagtctttttaaagagatttcttatatgactccttttgtattttcaaaagcaaacaaacttaaaacccgactcaaatacggatatgtatttccaaaagcaaacgaacttaaaaaccgactcatatacagatgacgtaccaaagtatcggtaaaaacaccttcactatttataatagcagagatatacaactatgattgtgtgcagaaaatgtaaaaggtaagtagtgatgaatttgataaggattgagcaattcatttttttttcttttggagagttgaagatgaatcataccaattatcaataagaaaacttttagtgtcaataaaataaaattcttctgatctaagtttgactattaatttctatatggtagtattttttgaaaaaaaactgaaaatctaaacatatgatttttcatatatctggctagcttaaataatcaaaagttttaaatatgtctttttatgggaatgttgacttaatatgcaagtacaaagttagccaggatagttagttgataaagaagcgggggcttgcaaagaatatagtaagttggtaaaattatgtacgttcatcagggctgcttagcttggtgggctgctcgtgtgacatggtgtctggcccaggtggcccagttggatgtttgcatacacctgcatgactgcatctggagatggattgaaccaagagagcgccacaccaacgcaccctgcgagtcgagtccgttggagactaaccacatgagactaaccgcgtgacattgaaaagaaaatcggatagggagaagaaagcgacgtacgaaactattaggcaaaaacatcttaaacttttataataggtaaagatatagtgaaataaataaaccatatttttcaaaaaatatcaatctttgttaattttttgacaaaaaaaaatcttggttaattatgctacattgtttaactcattggtatttcacaatcaccaccaagcatgcatatatagtatcgtaatgataccagaaggttgcatagaagtatttgatattggactgctagcttcttccatgtttgctaagcgtttgtaaaatttatgcactgcatgacaaaaagcaaaagagaaactaaagaaagaaaggaaatagtaaagaacagtggggaaaaaaatatctttagatgtgtcttgagggagaagaggatacagaagagctttgctgtcatagtccttgctttggtgtgcgccatgcatatatgcatcagcttttccttttactccataagttttcttcacctttcaatcgaccgtgccatgtacaaatgccagtgatgatcgatcagagaaaggagattatgcccacagaaaacgaaaatgcacaggtttgatctatttagaaagaacgaatcaaccgtgtcttcaatcaacgaagcacatcctggacgagatggtgagctgtgtgaggtagatcgacttagcaactagtgtagttacaaatttcctgtgtacaaatctccagtggaacacccattacttgaggtcatattagacttgacaaaaaaaattcagctacaccgcgtactttttctacatattagtctttttcacaaaatattttacaaatagaaccttcataaaacttattttaaaaaatagaccataattcggcaccaagattattaacgcggaagttaaatgtctcggcactgaaactgaatggagcaagaggtgggtgcttgctgctgaccctcttccacttacgaacaactttcctctctctgacgcctccctacccaatcataatccaattgatttgctattaaaaaaaataacaaatcaacatataaggattcatttcctgcattttatttttattgttagtaggacgaggtgtggttcctcccttctctcccacactatacgttgatttggtgtcaaataaaagcgaaaaaactcgataaagtcacatcttctagtttatttatccctcccattttttttaaaaaaaaacttttaaaacttagaatctaggatgagggtgtgggaggtcgagtgttaaacgttagtgccatcgagactacaaggtgttgagatgtctaacgttggcaccaaagacatactctcatcatatcataaaaaacagatatagaataggatgtgacacatcctaatactatgaatctaggcactattcgttcagattcgtagtacaatggtatgccgcattatgttttaggttttcttataggatagagggagtacctaacaaattaaagtacaaacgcagacaagtgctaacac

SEQ ID NO: 64454 - DNA, 1477 bp, Oryza sativa
tcgtgtgcgaatatgggcattaatggtcaaaagttcccgccgggaatcgggaagtgagtttttgccacgaacgcacccaatacactccaaaatgtccaaaaatggcgtttttgaactttttgattccggtcaaaaacatcgcaccctcgtgtgccaatgttggcattaattgacaaaagttcgccgcgcaaatcacgaagtgagtttttgccacgaacgcacccaatacactccaatatgtccaaaaatcatgttttggcgttttttgaacattttgattctggtcaaaaacatcgcacccccgtgtgccaatattggcattaattgacaaaagttcgccgcgcgaatcacgaagtgagtttttgccacgaacgcacccaatacactccaatatgtccaaaaatcatgttttggcgttttttgaactttttgattccggtcaaaaacatcgcaccctcgtgtgccaatattggcattaattgacaaaagttcgccgcgcgaatcacgaagtgagtttttgccacgaacgcacccaatacactccaatatgtccaaaaatcatgttttggtgctttttgaacattttcattccggtcaaaaacatcgcacccgtgtgggccaaaatatgccaatattgacattatttgacaaaagttagccacgcgaatcacgaaatgtgtttttgccacgaaccacccgatacactccaatatgtccaaaaatcatgttttggctttttttgaactttttgattccagtaaaaaacatcgcaccctcgtgtgccaatattggcattaattgacaaaagttcaccgtgcgaatcacgaagtgagtttttgccacgaacgcacgcaatacactccaatatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccttatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgca

SEQ ID NO: 64455 - DNA, 4495 bp, Oryza sativa
aatggcagaacagtttcagagcttcaagggagatctgtacgagaaatacaccctgaaggggcagacactgaacatcgacacattcccgaagctaagggatcattgggacgagttcgttgcatataagacaggtcaacaaggcagacgatgatggaaagaaacaaagaaaatgccgccaagaagaagtaccatcaccacttggggtcaggcagctatagcatcgcgatgcctgttgattcaaagatcgaacacgccggcctgggagatctgcttagcttctgtgcaggtccaaagattgatgagatgcaggcatgccagtcagtttgatcttacaactgacaagatatgcaaatagtagatcaaaacagccgatcggctgacaagccgatggagtagttccagccgatagccgataatagccgatgccgataccagccgatagtgatagggtttaagcaatcggctatatgtccaatgtaaataatgatatgaaggcaatcggctgatgatgatgtaataaaataacaatataatcaagtagaaaccaatcagctagaaacaaaatataataagcactgatctgaggtttaaagcatacatcggctgcaggtccgatgtcatgaaatccacaagattagattaaacagtgaaacatttgttgtcatcggctaaatccaacttatatgtatgtgcaatccttatgagccaatgcaatgtctagataactcaaaagctgaaaccccgatgaaacccttattggcaatcaagaagcaggctagagattatggttctaagcacaacttagtagatcaaacttaactaatgcagcactaagtataaaaagaaacataatatctagacaatcaagccgttgtctgagttttcagggtggtagatgtctaagctaatctaatctagcaacgcgatttagccgataccggcagaaaccctaaaacgagaagcagccgatagagctaaatcgatatgctaagactagattaacagagacatatgataaataggtaggcaaatatatcatccaaaccagagcaatccaagaggtcgattgtactgatgcagccttgaacgacgccaatgtaaatgggaaaattgctggccgatggaacattggacttaccccttcgccggagatcgaaaatcgatgcagccccgcgtcaggtgccaagtcccgccggacgataaaataaagtagaaaaggtaaaaggtggcgatgcgtcgaattgtattgatcgtgaggatagattacatagaccccgggtgtacatatttatacccatgggttgatacaagtccttgttggacaagaaagaaactaacctaaagataaaaggaaaaatataaagtccttatcggacactaaacacactttcctaaaaataaaaggaaactaacaaactattcctaattaatagataaaatgccatgccgcatcctctttaaactcggtcacttagggataagcttcctttaatagattgatttccttaactgaatatagcaggaatccgactattggcgacttgataactcccatcggctgattccgagatactgcagccgataatgattctaagccgacgacgtctttgccgattaccaaatttcactgttaacaatgccgaagtgggaggagatggaggcaagcttgcttgagaggggtatcgaaccggccaccgctaaatggccggatcaatcggagttctggtactatgctcatggtggaacgctcaacccagttgatggctcccaggtcttcagcgatcagatatgcgaggctgcgcgtcgactaacggacgcagtggaagcctcttctcagggcacgttccgacccgacagagagaaggacgagctgtcactcgcgctgcagactcccgagcatccaggacgaacacgagggaaatgggtgattccttggaagattggattcaaggaggacatccacacgtacaggagtcggatgaggagcaagagagataccgaggcgaagattacagatcttgagtacagggtatcgagctacgagctcagcatgcaagaggaggtggcaaggaaggttgatgaacgcatggccgcacatcggtcccatgatccccagccgtacattcctccgcaatggtgagcccttcaggcaatggtagcagctgctcctcaacggggcaggtaggatcacagagcatggacgccatgcaaacctaggacgaaaccacctgccccgttgatgacatcgctcagcggacaccatgtgagctgcatattccattaagaacttatcaataaaggtaagctcgtagtttatagattttagacttgtccattcctcaagttgctgcttatatatgttgattactaataaataacctctcaccacgtgaaggtggcgtcgggcatggccatccgaacggacccttcagggacttaccactacaggccgattccagcaggatactccaaggtcaaagttgagttggtggaaggcgcgtacgaggacgtcgagttggactaccctggaggagacggtgagacgcatctacgagacacaagccacaccattatactatggcgcaagcggtacatcatcctccctaggcgacaagcggcgtctcgtgcaccatctcctccggttccgccatctcctcctcaggctcttgcaccgtctcctcctcgtgctccagcaccgtctccacctcaggctcctgcaccgactcctcctcaggctcctacaccgactcctccgcaagctcttcgtccggcaccttccaagtcaagggccccccaagctccaccgcctgcccccacaagggcaccgaagaaggcgaaagttgacgctgcaaaaaacaaggacccggggtatgattgcacgcaagaggagcttgacgcttatgtggcatcagaagtcaggagacaattgaagcctcgaagtccagaaaagaagattcttatagacccgagtgttagtaacttcttcaggggtatgtctgcacctcccaaggaggccataaagctatcggactatgagcgaacacttaagaaagcatcttctggaaagtccaaaccagtccctcagcttggagagcaaccaaaccaggagatcgagccgttggtgaccggtgaagattttggaatacaagaatttattaatgacaccgggctaactacggatcaattgctacgaggtgcaccaatcgaaaaggcggaagtgaaatacatgtacgaactcggtaaaccgcttgttaagcctgagcagctgcagtccctacccacacaaatgtacaaattccatcaactgtacatggagatgagcgccaccggtagagagatgatcggagcgtggatcagggacacggacttcttgtaaggagatgatattctctggatcaatttcaagggtatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcggaaagtaaacgtcgcaatgctcgaccaatatccgcaagccacagaggacaatctcgtccatctcctgaaggcgcagcattacaagacgttcatactattgccgtacaacacagagttagtttttactatcttcctatgacggagcgcggggctcctcaccgggagaccgcacgggcccccctttgccggttcggccgggggctcagggtgagatcccaagctctctgtgtatgtggaaagatcgcgacctatcgaaagagcatgaagcacaagcgacgtatacaggttcgggccgctgagaagcgtaacaccctactcctgtgttttggtggatctgtgtatcaaggagctacaaagtgtgagccaacctctcccttttcttctagctactgaatttggaaaaagtcatcctctttctctatgggcaaggtcctccttttatacttcaaggggataccacatgcacccctctctttccaaactggacttttcttctcttcataaatggacggagatttgcatcgttgctgtccgagtcgccttctgatgggacggcccacaactacctccacttccgccgggagcagacgcgtcgtggaattgtggccgcctgccgacgacatgaccggagtcagaccagtcacgtcggtcattcttgttcaccacgtgtcagcttagcaatctgcacgttggccctccttcacacaacattttgcctgtaatggttaggatgaagcctggcatatatctgatcaggactaacgtgccatctctgggaggtaacacgctagctccagctggggacgagcgcctagaagccctcgtcctgacgggacggggcgaggcgtgcgtcagaccgcctg

SEQ ID NO: 64456 - DNA, 15674 bp, Oryza sativa
tgcagatcgcttcttcgtgacagtagagtcagctgtctttgtttggtcatctgaaggactgagataccgtatttcagaaaaatacaagtattgctgcttaactcattaaaaatgaggtgaagatgttgatgagactaataacaacatacgtggtggtgtctgagtagactttttcaacattctcatgaccaaagccggagagtgttgtattgacacccaatgttcttactcttggcggttttgtatgatccttaggcattgcaatatctcgccagtcatctatctgtacaaaatggaaatgcatcaaacagaatgcagaaataaagtcctaataagcgtatccgtacatgatcaccatatcatttcttttctggatgaaaattgatcagtgcattgtttaaaaaatttagttatttagcaaatttagtcatatcaaagaagcacggtagtccaattaaataaagcgatgctttggccaccaaccaattaagtgtaagtgcaaatatcggaacctttatttacgtttctatggctacagtggacaacaatgccagtcctggatattgcatgagatcatcacattttcatcaatgtctggatattgtgggcaagattctggtggcaagggaataggagcgagaggcatgaagccaagatcctggagacctggaccatggcgcttgggcaccattgtgcaggaggaagacaggaggtacacggaagttcgcagagaagcagggggtagggtaactattctagtttgccttcaagtagcgatagtcccatccttaagtaggaggattgcctaacaacttctgcagattaaacgaaagaataatttgcgaacaaaaagtaaagataaatcagtctcacaatccatgtcctgatcctactggtctggaaccaggtggctgcggccactggaggcatcaacagtactggaggtccaccataaaaaatgaatagggtgatgattgactgactaattattttctaaaatgaactctgattcaaattgatcaattaatgcatgctagaggaattgggaaacatgatttttggcttcagaagatatgcatcattccataacatatagatcaaattggaaggggggaagttaacattaagaacctacaacttgaaggagagcgtccaagagcccaggaactttagcaagaggtgttgtatcccgccggagatcatccttctccttaaatgagagtactgtaagggcgttcaatgcccatagtatctcactcttcaacccactttgcaatgcaagaacaattcttttattgttctgatctgaaaagtccacaaagaaacataaactctccttcttagtaaccatgtcgacagtacatgttaagtgtgcagaaaaaaggagtgcctgtgcatttcaagctcatgacacatatgtgaggtagcatctctattgaatgagccaatatgaacagggaaaaaaatctaggtaaagaaaatatacaggccatcgcttttacatctgaaatgatgaagacaactacaccacgattgtttgtccccattgtttccaatgttcgtcatagactcatatgattactagtgtactacccataaatcacgccgttcttgacggccaatttgacgaccagtcccatctagctaagcaaagccttattcaatactaaaaacattggtcctctatttccctgttaggtcagcagtccaataagcaaatcctcgatgcaaggtatattcagcgtcccaatttcaatttcaacaccaggcacataatcatcagaccaaaaaccctaatcccccttcccgcaacaaagtcgtctccgaagacacgcaggaagaactaatccaaaagctgtgccctagacatcatcacaaggtcgttgcggacttgcaggcgaagaagaagctcactcaccggagagtgctgtgaggacttggagggacggcccaaccagcgcggccggcgccgccgcgtcgccgattgcagccgccgcggccgcggccgccgccccgctgccggtggtgcttccgaaggggcgcccgcgcttcgccggcgtggagccgccgcccccgccggacttgcccgccggggcggacctcacgtgggacatgatgagggttcagcagctgaaccccaaattattttgggaacaagaatggtgtcagcaaagagaaaaaggtttccagatctagaagagaaggtgtgggtaatgaaagatagagagagaggatgagcgtatggggttctcaccggcgaggctgcggcggaagcagcaggacggcggcgcgccgctgctcgccggatggagataggggcgctgctcggcgcaggcggcgggcgaactcgcgtcgcgaggagagcctcgaggccgccgagggaggagacggggagatcgactagggagtgagaaactcagcaggcataggccaattcttctgggccatgcgcatcatgggctttctaggcccaggtatcaggtccactacagcccagttgaaacaaatcagagtaaaggtcctctctgcacacggaaaagatcctccgacttaatttcctccaactttaaatcactgacatgcgatccgttgaatagagagtccacctatcaatgaaccatgtcagagggaagtaaatctgaagatctcaaatcccgattgactgaccacggctcagaacaacacaatttgaaatactacattatagtaaattatctacacgattacatctatatatatatatattaaaattttaatataaataaacttaacgtatgctagattaagggatctaatcaatacaatagaacaatattttttagaaaaaaatattattagaggcatgaagctaataatccagtataataatctaatgaagcaggggcttaactgttcttatgctttatttagcgctgctccaaattttacatctatgcaactctagatcattgatttctaagtttagtgatactttgactatttaaatcttgaatttagagttatgtcaagcaaaaccttaagtacgcttcgaattgaagcgtttaccaggatcaaccatgagaaaataaaagtagagaaggcgtggatggtcagaaacgagaggatcgatcatccacattatgcatatggatctagtggtggagacaactctcaagtaggttaggcaaccgccaaagcttcatagttgacgtctctactaccaactaccgttaatatatatataaattagtggcttcactgtcagtatctctccaccaccaactaccgttaatatgtataaaaattagttgattactagaaaacaatattaattgtctgtacttgacggtgtcactagctccaccactgtctaggcctagccattcactgtgtgcgaaagggataagatagggaagaagatcactcatactcccaaagcatatggaagtttcaagactaacatataaaatacttcctccgttagaaaatataagatgtgcatgtattttaagaatcaaattccggcatcactaaattcatatgtactatacaggaatctttgaaaaaaaatggtggttgaagtttgatgatagaaacagtgcccaatcaagccacacattatatttttgaatggagggagcagtatacatatagagaaaagagacaattaattgcagcaaaaatataaatgctccttgttgcaagtttttcgcacaaccgcgtgtataagtttttatttttctaaaaaattacccattaccatttatgagcattactaaaatttcacaatgtttagtacaaattcattattttgccacaaaactgtgttaaaatttataatttgactccatcttattttcttttttttctcttgttctggtctcttcactgttctccaccagttcaagctatctgttcactctatttcatacctttttagatttgtcctaaatcaaacttcttaaattttaactaagttgatagtaaaatgtaacaatgtgtacaacaccataacaccataggaaccaccaaattgaaacagttcacaacatatcacgagaaaagaataacaagctgttattgaagaagcaaacgctgacttctaaatgccatttcagcctagatcttttaatacttgatataattaaagataaatggattatttgtttcagataaagtctttggacgtatggaaacgacgatacagccaagacgccaagtattgtcacaataaatcctatcacaatatcatcacactagttgaaattcctcttgttgattttaggtggtcttgaacgacattgttttgtgagtagaagaaagtaacacatgggacgagcggcttaatacaatttaatttgcatcgacatcccttataatttttacatcacaactacaaacatacggcgaaacgacacacgcaccaaaaaaaaaaaaaactgtgtagtagtaaattaacctattaagcagcgcatctataatcgatacacagtgcgtcaccttgcttgcgtgttctacttagattttgtcaatcgcccggcggactatgggagcgattaccagcgatcccacggtcgccaacccgccggtcgttccgacatccaccgcggtcaaaccgacggcgacgccgatcttgagagcaaccttcgcggcgcgtacccccacgctccgtttctcctccccctcctgctgctgcggcggctgcggctgctggtgtgcgccgtccaacacaggcgtgcaccgagggtgcgcgctgaagttgcacggcgcgcaggcgtacatgcggcacccggcgtgggagatcacgtcgcagacgttgcaccaccggctgcccgtcaggcgggtgagcgtgagctcgtgctcgtggcgctcgtgcagggcgaaggacgccgggagggcgaggcagctccggtggacgtggaagtcgcactcgccgtgctcgcagcggtagccgtcgccggtgacgacgcgctcgcacgcggcgcaggggttgcccgaccccgaacccgacccctcgccgtagtggtgctcggttaccaagtgctctgggtggtagaagcagctaacacctgccatctcgtgatatatcgattttgctaggtgctgcgtacgtgtgggctggctggctcgtggttttgtttgatttgatcctagtacttttggctgtccaggtagtagtggtgcatgctctcggagacacgtatgagagtatatatataggacctctttatcactgctcgggatccagagtttgaatattttaagggcttgctcggatcacaggataggaaaaacataggaatagaaaaaacatagaaataatataggattgcatatgcaaaatgtgggattgaaaaacaaaagaatttgatagtacgaagcgttcggaacacaggaatatataaaccacaggaattttccaattaatattaatctcatatattatagtataattaagcaataaaatattagttcccatctagtcactccaacgtgattagcatctatcccatggtagctaatggaaaaaaaatcccatggtagctaatggaaaaaaatgaggtgtgagtggatgttcagaatcctatgaaattcctacgttttcacatgttgctatagtattcctatgaaaatcctgtgcatggttcctatgaaacgaatgcataaacagtgccaaatccaaaggaattgccaatcctacgaaaatcctgtgtaattcctccgttccgaacaagcccttagctccacaaaattatagacgtggatttatgattacgttgataacatttgagtaaattatcttattttctttttgatgaaatttaaaattctaaacaactactccgtagtatatttaacatacataccattaaatctagactttctatgcatcgtttttcagagtgttttttttattaaatcgcaaggcaaccttgaagaacttccctttttgagagaaaccctgtacgtgcagtagaacgtgtcaaaagaaccaacaaactgcagctgcatgcaagcctgcaacgcaagaggcaagcacacggatgctacagtctacacgtaacttaagaacacttgctatctgtcctcgtcaataaattgatgtcaacgaatcgaacagtttaattatcaacaatttgtgtttgcgttgtgcacttgaatttttcttcatattaatttatatgccaatgcgcttaactttttgtgtattcactaaagacttatacatcgaactgcaagcatatgcgtgcgagacttggttcacgtgatcaaccaccagagcaagtttaatagtacagtcaacttagctccaaatcatctatagctaatataatagctaattcatacaatagttgcttactatactattaatacctggtcccacctgtcatacacacattacgttttggagtccgtgttgtagctagctacagatctgtagcccgctgctcttctctcttcatttatttctttaaaatatgtttatagctggcttatagcctgctattgtatctgctctcatactctggagtaggggatgtactccctctgtactcgtaaagaaagtcattttggacagcggcacggtctccaaaacacaactttgactttttatttctataaaaatatttattgaaaagtgatatatgtatacttttgtgaaagtatttttcaatacaaatctattcatataatttttacattttcaaactcaacaacttgagagttattcatgatttatattcccaaggtttgacttaaacattatcccaaacgacttcctttacgaatacggagggagtagtaattaaaggtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcttgccccggccccgagggccgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgtgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtactcccccacctcctccacaccaaagtcctaagcagggggaggcgctcgagagggtcgaaaaatccacagcatcaccggtcgcgggtgatgcaagagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctagacgacgtggccaacttggtcatgacggcacagcagcgcctgggtgctggtggacggtccgccaccaccaagacctccggcgccgccactaccggctccgtgtcgtcaaggcggagggcgcggcgagcggcggctgttgcacgccattcggctaccactccctcgtcggcacctccgactcgggaggatcagcatgaagagccggatgcccgcctcgacatcgagcgtaggcgtaatagccggcgtactccccgcgcagcggagggcgcctcttcgtccagagtgtcacctcgacagggacgtgaggaccagccctccgtgcccccggttggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggattgaggccgctgggggtgacgacagggtcatggcgaatttctttcccatggccctgaagggacaggcgcggggttggctaatgaacctgccacccgcatcggtccactcctgggaggatctgtgccaacagttcactatgaactttcaaggcacctatccacgcccaggtgaagaagcggacttgcacgcagtacagcgaggggatgatgagtcacttcgctcgtacattcagcggttctgccaagtccgtaatactataccatgcatccctgcacacgcggtgatctacgcgttcagggggggtgtgcggcacaaccgcatgctcgaaaagatcgcctccaaagagccccagactaccgcggagctctttcagctcgcggaccgagtggctcgtaaggaggaagcgtggacttggaacccctccggttccggtgtggcagcttcggccgcccccgggtccgccgctcagacagggcggcgtgacaggaggagaaagaagaggtcggtccattccggcgacgagggtcatgtcctcgccgtcgagggcgctccgcgggccacccgaaaggggaggcctgcgagcgacaaaaagaaagaggcaggtgctcccagcagggagcgcccagccggcaagtggtgctccgtccacaacacctccctccacgatctcgcggattgccgcgcagtcaaaaatttggctgagcggacgaagaagtgggaggaggacaggaggcaggaacgccgtgagaacaagtccccggcggttctttccggtaatcggcgaagagaggccaagcagaaggcccccgccgaggacatcgatggtgacgatgatgacctaggattccaggagcctggggccaccattgccaccgtcgatgggggagcatgtgctcatgtttctcgccggagcttcaaggctatgaagcgagagcttctggccgcggtccctactcatgaggcaacgcgtcgggcgcggtggtcggaggttgccctcacctttgaccagaccgaccacccaccgtgtgttgcccggggaggacagattgcgatggtggtttcccccaccatctgcaacgtgaagttggggcgtgtcctcatagatggaggaacggccctcaacattctttcccccgcggcctttgatgctatcaaggccccggggatggtgctccagccgtcccaaccgatcatcggtgtgacgccggggcacacatggccattaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccatggcgaccttaaagtcgcgctcgcttgcatggagcagtgcgcggaccacctcgctgctgcgtccaagcccgagggtggtgacgagaggcttggcacctctgcccccaccgccccgaggcagcggattgacacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttttacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgcacggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggccccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcatgatcgagagggtacagggcgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctagtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtctgtatcgagtgatcggcgtcccccggccaggctccgtacggctggccacgggcgacggcactgagctgccaaacccgtggaacatcgaacaccttcgtcgcttctacccctgaggggggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtccccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagaaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtccttaccgctggcgtcgccctcctcgtcggagctgggggcgaacgcgagccgaggggccgacccctcgaagctttggacgatgtggttggcggcatcccggacccgcgcacgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcaaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggtctcgtgcgccgccagcgtcgcctcacggatagcggaggcggcctcgcggtccgccaagctggtcttcacggcgccggcatgatctttcagcgccatggcacgggcttcaaggg

SEQ ID NO: 64457 - DNA, 25336 bp, Oryza sativa
tggttaggtgagccccgccatgctcacctaccccatatacgtggcgcaaaacccacaaggggtcggggcgcttcagccctcggggccgagacgggagcggcccgaccccttggggagacaaagagaagagcggccgtatcaccctcgggcccgaccccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacagttgggcagaaacccaacggccacaaatcacgcacatcggcaatggtaactcggctgtcaataatgagcggtctcttcaagactgccacattactcgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggtgcacctcaccctcaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagtgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagacttcatgaggacccacctgggagtgagatgggactgggctcctgaggacttcaagatattggtccaacgggtgctgaatctcaactccgtggaggcgtccctcattccccaaggaatcctccccctctgcagcgatccagaccgcgcctccatcctatccattatgatggcggtcggggcctcagaggagcgagctccaaagggccacgacggcgcaggcgggagccgcaggggggaatgatctaccccgggagggggtcgtgcttctgggtcccgcgacaggggcccggggagcagccgccctgccgacgcccgggggaagagcaagcagggaggaacacctcccccatctcctccccgagggggcggggcggtgcgcgccagcagcaggcgcccggagggggccgtgccgacatcgcagcccgagggggagcgcgagaagaagcggttccgcaagatgggggagacagaaccatctcggggaaacctcatttcccctccaaagtggtcgtttaaccgaccccctcgcaggttcgtctctcacccatcgcggctgtattcattctctcaacgcgagttttcactcacccatcttgttcgtcttctggtcttttcttttgtttcagcgagatcccgtcgcgtccctcccgccattccaagcccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaaaccgctcgggaggaggccgcccgggcccgccaggccgaggaagccgttcgggaggaggccgcccgagcccgccaggccgaggaagccgctcgggagaaagccggatttcgccaggacgaggcgttggcgacttccgaagcagctcgcgacgaggccgcgggcgcgtcgcttgggcccactccctcgggcgacgctcaggcgacagcttccggggcagctggcgacgaggctgcgggcgcgtcgcttgggcccactccctcgggcgacgctcaggaccaaccgggtccgggggacatccccgagtccggcacttccatcggtggcccgagccgcatggcatcctctccaaggcggctcttccccacgccttctatcgccccactgaacgcagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcagcgtcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgccgaagaagagctcgcgctccgcctccgcgaggacgcgctcaccgagcgggagcgagctctcgagggggccgaggccgcggcgcaacagctggcggacagcctatccctccgcgaggcagcgcaggaggagcaggcgcgccgtaatctgtaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagctgccgaacacaccatcgccgatctgcagggcgcgctggactcgtccgctggggaggtcgaagccctccgcttggcaggcgaggttgggcccggcatgctttgggacgccgtctcccgcctagattgcgccggtcggcaagtgggcctctggagagggcggatcgtaaagtacgccgccaaccagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgacccgggcgcattggattaagcccccagacccccgccattcttcagttttttcttcttttctttcttctaaggccttcgggcctcttttttgtatagatcaacttaatctgtaatcaaaaatgaagaaatttttgtgtcaatttcatcttgctgtgtgtatgagatgaggatgatctgtgccgtggcccttttgtgtcttagcttgattaagggttcgtgcccaggtcctagtcctcaaaaggcgcgggtcggggctagtgcctggggagatccacatgtcgagactggccaggccgggaacgtggtgaccgagggttatgggtgacccgattgtgggcttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgacccccctcaggggtagaagcgacgaaggcgttcgatgttccacgggttaggcagctcagtgccgtcgcccgtggccagccgtatggagcccagccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggacttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaacttaagtgcggagtgcttatcgatcttgacgaccggataagccttgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggactccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggccatcatgttatcccgtctgggcacatgccgaagctcaatcccatcaaaatggcgctccatacgccgtacttggcgtacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtttccactcggagaggtcaacgtgacccccgcactggcgtcctgaagagacagggagccgtcgaactgcattacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcatcccggagggcctcactaacaaagtagacgggccgctgcacctttcggtggggccgatcctcttcgctaggggccgcatccctggggcactcttcgtccaatcagcctcgcggggcgcacttgtcttctgtgctgatgacttcggggtcggaggataacaggggcggccttcccacagtggcttcggggccgtcctgggggtcgggggctcctggcatcgtcggacaagcgggcaaagggccaactccggtcgtcaggggccttggacctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccttgggccaccgttcggctcgggggcctctcctccctgctctctcccgggccaagtctgcacagggtgggggtgcgcggaatgaggattgtcctcatcgcgctccacgaccaacgccgcactaaccacttgcggggtcgccgctaagtagagtagtaagggttcatttggctccggggcgaccagaaccgggggagagctgagatacgccttcaactgagtgagggcacgctcagcttcctccgtccaagtaaacggcccggagcgtttgaggagcttaaataagggtagcgccttctcccccagcctcgatatgaaccgacttagggcggccatgcaaccggcgacgcattgcacatccctaagcttgctgggggggcgcatccgctctatagctcgtatcttctcggggttggcttcgatgcctcgggcagagaccaagaacccgagaagcttgcccgcaggtacaccgaacacgcacttatcggggttcagttttatgcgggcggagcggaggctttcaaaagtttccgctagatccgagagtaaggtttcttggttgcgcgtctttacaaccaagtcatcgacataagcctcaacattacatcctatttggctacccaaagaaattcgagtagtacgttgaaaagtaggacctgcattttttaacccgaagggcattgttgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggataaaggcttgacgttccagggcctgccgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcaccatggacagagatggggccatcggggcccggcatcttcatctggaggtaggcgtagtggaccgccgccatgaactttaccaacgcgggcctccccaagaccgcgttgtagggcagactgaggtccgccacatcaaagttcactcgctccgtgcggaagttgacgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggccgctcctccatcaatgaggacatgccccagcttcacgttgcaaacagtgggggaaaccaccatcgcgatctgtcctccctgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcactgcgccgattgccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctgtctgagcggcggatccggaggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgccccccctgaacgcgtagattaccgcgtgtgcagggatgcatggtatggtgttgcgggcttgacagaaccgctgaatgtacgagcgaagtgtctcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgatacccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaatgagtcgacgaaggagtggtggccgaatggcgaacagcggctgccgctcgccgcgcccttcgtcttgatgacgcggagccggtggtagcagcaccagaggccttggtggcggaggaccgcccaccagcatctagacgctgccgtgcagtcatgaccaatttggccacatcgtccagccaacgttgggctggagactccgggtcatgggcgacgggcgggtgacgtaggagcgcgcccgcagcttggagcgcgccctgggacgtgctgctgtcaccatagacgaggaggcgacgctccccatctcgccgcccttttccacctcctgtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtgaattcgtgtatgaaggaactacaaagtatgagccagcctctccctcgttctgggttcccaatctggaaaagtccaaatcccccctctaagtgggcaaggtcctccttttatatcttaaggggataccacatgcaccatctccccctctctttcttccaatttgacttctcttcattaacagacggagatttgcatcgccgccgtctgaatgaccttctgacgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgctcttcttcatacaatatcttgcctgtaatggttaggatgaagcctggcatacatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcctcaaaactgcaataaatgtggttaggtgagccccgccatactcacctaccccatatacgtggcgcaaaacccacaaggggtcggggcgcttcggccctcggggccgagacgggagcggcccgaccccttggggagacaaagagaagggcggccgtatcaccctcgggcccaacccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaccctccgtcccaaaataagcgtcctaaagttttgcactatttgtgttcaacatttaaccgttcgtcttatttaaaatttttttatgatcagtatttttattgctattatttttaaatgtttcataaatttttaaaataagatggacggtcaaacattggacatgaatatcgacagcaaacaagacggaggtagtacctaattcaagttccctttaccgttttgatgaggcttaccgctatcggttaccacagtaactgcacggtcaccacgaaaactgtgatgctacgaaattcacaatccgtgacctcaaaatgctccggaaaatcatcacagcaatatagtaacgttcaggctagagcgcataaatcgtaacgctggctagactatacaaaggtgcacgagcttgcatataaaccaggtcaggatacaaaatgcccgcgggcataaacatctggaataacaattaggtttgacatggcactaccaaatgtccaaatcaagtaccgaagcaaactaggcgagctgaaagttcactgcggcttgggaacaggttcgagggcttcaatcatcacaacactgtttcccctgataacctgcagaagttactgcattatcagtacttgagtatatattcctaatcgaacatatgtgagatcttctctagacagaattgaactacgggcctgtttagcacagctccagctccagctccactcttcctggagctagagctcagccaaacagttttagctccaccaaagagctctctcacaaaatgtactagagttgggagctgggtttaggcagctccacaactccactccagactcaactcttggagttatatttaggagttggagctgtaccaaacaggccatccctatgaaacaggaatcccaagaaagatctcattccaaagagtttacttaccaccatccctatgtcattcttctcgtttccattgacctccactgtgttgtccacgaccaaattcataaactgatcgaatcctcgaagagtgccaatgacaacacggttcgcattcagcttgactggcaaaattgaaaagagagtgaatgagtacaccatcaaagctgagtaagaacacaaggattagaagttcagcatcactcaagactattattagcaaagactatcaagcagtaacgagataaaattggatcaaattgcaatatttttataatgtataatcttggtgcttctagccaatcttaatccacgtgcagaccaaatgtgagcgtcaccaaactatttaattagcttagcccaaacgactatacacagtcacaactcacacaaatatatcaggtaatggtactgatagcaaccatagttccactataatgcaatattcaaatcaaagggatcaaccagcagcaactgaaacatcaaggatatgatttgatccttgatgaagggacggtagagttgttttcctccctgagttgagggtgagccaaatattaaagggcaactagccaactattacaacatcaaggtagcctatcagtgtaactatgacaaaaggcttcacttggaaaagaatccatagctttccaaagaatgtcatcatttaggcagcctactgatgttgattaatgagaaccatgaaagaagtgtcaagaaaacaggttctactgaacagaacaaagacaacaattggaattatatattctttttagagaacaataggaagtatgaaagaaaaaaaaaagttccaactagtacaaaagactggacatggcatggtgtgcacaaggatctcaacacgccactgataaaattatataaggaaatgaagagtttaaatgccctatcagagtaactatgacaaagaagcttcatttggacaataaatccatagctttcctaagatatcatcatttagggcattcacaaatcacaagcactggcacaaaaatctgcaagctattacagaacatatatctgcaaacaccaacatagttgtgctcaaagataagcaaacctgctgtattcacatatcagatctggttcaaacgaacttccaggtttctaaccaggcttaagatttactaacaggttgagctgaattcttcagccaaaatatttttgatataccaactctactacgacaggaataaacaacatgaaaagcatcaaagatcaatacgacaaaaacaataactcgatatatctccagatgaccataccaaatcaattaccaatacctagtcatatgcttcataacacccctatctcgcaagttgcaacatagagctcttacaacttgcaccacaaatctcagctagggcatgtattaagatgacgaagcgaattggcgataccggaccatacataatcagttaatcacagaatctacacagcgttatcttagaattaacgaggcagctaaaaactttgggttggatgagtgcgcttactttggagcttcttgtccatgtacctgcaacccaccagaacaaaaactcgcatcaaaaatccaaatccaagtagaacaaaccaagcccacaaatcgaactcaagatgaagaaaaaaagcactaagaaattacttcttcagatccggaggctgccccgatcggctcatggcgactccccgacggaagatctagaccttctccgctcaaccaaagccaaatcttcggagtaggcgagagaaaatagccgccgccgccgccgcagagaggagaaccctgaaccctaaaatagcccgagacgggattgctatctccacactataaatagtcgctgacatgtgggcccgcgtctccgctccatcgcgaacacaagaagacgaatagatacagaaatattattaaactcaggggtgtatctgcaaatataccaccagcccagcctggagcacgacgaagcgcggacgaggcgagaactccttggagctctgaactctctatcgcgtgaggaggtcgacggcgagagagatgcgcggcggcggcggcggggatgcgggcaccagctcgaggggcggcggttccggcggggcccccgcgcgtccgcggcggttccctgaggcggcgcagccggagatcatgcgggcggcggagaaggacgacggctacgccgcgcacgtcaccgaggcctgccgcgacgccttccgccacctcttcggtgtgttgctttttctccccccgtctcgtagcttaagattagctccgcgtcgcgcgatttgatggtggtttgggttttggtgatgatgcaggtaccagggtcgccgttgcttatcagaacgaggtgagagcttaaattggctgtgttggcttgtggctctactcgggttatgtgatatttgtcgaattctgccggaaatttaacttatcttatacactgtttgctacatagactggtgatatgagagtgaatgcctgaaatcagatgaattgtttcggtgtttgggtaaagtagttgaaaattttcaactattgtatattgtcgtatgactttggtatgattggcaatgagcatttagtgtattagctttttacaacttcaaatttgattgcacacctataatattacatgctttcaagtttcaaggcttacaagttgggtatgcattactgtactggggattaaacttcaactatcaacggacttttagggctgtttgatttcttcggcgttttaactcatgtagctactttgcatttgaattcaaatagctaatttgttctagtcagtatgaactgacaggttatgttattatatatatctgatttccatgcttggtggtgaaattagtttatttatataaaaaaatgaagatggattgcattgtgttgcatctcagtcatcagattctcagtagcatagaatgtgttgtgctgtgtggcagaagcacaaccttttaaaatatgaactacatcaaattgttctctagatctgtaacatagagaaatagtataaattttgttctctgcatttatttcggtgctaatattcttattgattgtccaaaattacatttctcatgaacatttgcagataaaattgcttggtcagtctctttattacttgctaacaactggttcaggccagcaaacacttggagaagaatactgtgatatatctcaggtcatactgcttttttgtctttaatgcacagtttctactcgcagctatttgatttggtacttggtagtataccattagcttgttgctcatctgttgccttatactttgaggggcacacgttgtaaatttgtctctgtaactgtaggtagtatatactggacatgtgctgttatttcagttttatgtaggagacacaagaaacctttgatggagtaaatatggcctttttgtttaattgaggggtctgtttgcatctgaagtgaaacacaaaactgtttattttttcttaaacatgaaattattaggagtcaaataactggtagatcctattaggaaaatgtaaagggaacacaaaatgtgttggtttcagttattgagatagtcaatttttttattcttgtcgacaagacacaaaaaattgttattagcagaagagtcttcaatgaataatattaatcttaataaggtacagccaaattgtaggcttgaagctgccattcacagaaaacataggagtcaaaattcactctatcatgctgatgttgtccatgttgtaaacaggttgcaacctcgcacggacttccgcctacacctgctagacggattctattcattttgtaccaaactaccgttccctatcttgctgaacgcatcaggtttgacaataatagttttggtcattcattcctatttagatcggctatcttgcccaatgaaactgattgcataatttctgctcactgtgattttaacagctctagaattgttgcacgtggtattgccctcgaggactctcagcttgatgaccattctgaaagtgatagttctagtataggcactgcagcacaaccatccccaattaggaacagtccttcaagaagcttgagtttttctcatttgtcaaggttgagaggcagagtccataccttgtgggaatgggttcttcggaaatggccttcggtatgaaattattctaatttgtgtgtggcatccttttcttatagcagaaaaaactctcttgatttagtaatagggaaatgtttctgtagaattaaggttgtagcaacactatgaaaatgcatttcttgcctaacacctatatgttgttgcctgactctaatatgcatgcagatgctaccatttgctcaagattttatacagttaactatccggacaaaccttatgttcttctattttgaaggtatcttatgttcgatacagcatgtcaaattttgaaatgagtttgaggaccaataaatttttatagggtgacaagtagcaaatgaagagttctgtttcttagtactgctcagtggctgccttaaagtcatggaacctgaacttattatgacgcaattagaaaaattaaattaccagaatacaacttattggtaaataacaacccagtttatcataacatctaacagaacatttccagtgaattgtgcaattcactgtcatgctctgctgcatatgagaactctatcatattctacttaactgaaattgctacatctatttcaattttttattttatttatggtaggatgcaacaccatgattctatcaagccttaattaatgtaatggcttagttagagttgacttatgttcttttttttatcacctcaattgaatctgtagcaactgtttgatatttgattaacatttccaatttcttgtaggattgtattatcatttaccaaagcgagcagctggcattcgttatgtattcattgggaagccattgaatcagaggcccaggtactctctgtttctctgctcatctactgtttatactacatgaaacaaatcatacaaacaatgggctatgaaacaccagtaataaatgagtttgagaatgctgataataagtcttttcatgatctgtagtttttttggacatcttcacatgtattacctccatttgagagcttaaaattctccagcaggtcacatttaactcattggattttgcaggtatcaaatcttgggtatttttctgttaattcagttatgtattcttggtgctgaaagacttcgaagaagtaatttatcaacaatagctagttcgattaaccaaatctcatctggaggctatccttcatcaagaggtggtacactctttttctcaatttatgaaaccagttttggttctatgttaatgctttgtgtttacttgtttcatggatataaataaatgttccaatattacctttgtgaatggcaaaacaggtcgaggtgtccctgttctaaatgaagatggaaatataatcagcgacatccgccatgggaaaactgcagatttggctactagttcagaggtatttttttctagataaattcattgagatgactactattgtgtagcacaaaatgtttagctttgtgttggacgccaacagcttttaagattatcggtatcaagcacttcatgttatgcaacagaattctatttaaaaaagaaagcaacaaagtaaaaaaaatgttacaatttaagattatgattgaactgaaaatgcttttttaccactattcttatattgtttatgttatttgatgtattttgtgtatgaatataattcttctttcatattgtatgtctaatgttcaggcatccagtggtaagagcaaatgcaccctttgtctcagtacccgtcagaatcccactgccacaacctgtggccatgtcttctgctggtaagactcgttttttggcctttacggatgcagcctgaaatttttctctcatgcactcacttgaatggtatggtaattcatgacataacatgcaggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattcaaatgcccctcttagatttggacttaattttttgcccctcttaagagatgccttcttaactatttgccacttttgtccacgtggtatgccaatgtggcaacacagggtagaaatcggtgtgggacccactagtcagcctcttctctatccttcttctttccctctggtccggcgaggagcgtgctctgccacaagccggtgctgctccggtctccatccttgtgcgcggctgctctaatccaccgccgctttgccttcgtcagtgccaccgcttcacctccttcgacagcgccgccgctttgcctcctccaccaccgcgaggagcccgtccgccgccgctacacatcctcctctgccccgaccgttgctctgcctcctccacctccacgaggagcccgtccgcgtcgctatgccagcgccaccgcttcgcctcttccaccaccacgagtaacccgtccgccgccgctacacatcctccttcgctggcgccgccgcttcgtctcgtccacctccgcaaggagcccatccgctgtcgctacgcctcctccgccggcgccgccgctccgcctcctccaccaccacgaggatgtccgccatcgctgcatctcctccgccgccactgctcctttccccaaccacgccgtcatcgcacgccggaccggagggaaagaaggaggagagagaggagaggctgacttatgggtcttacaccaatttctaccctatgttgccacgttggcatgccacgtgggcaaaagtggcaaatagttaagaatgcatctcttaagaggggcaaaaaaaaaagtgcaaatctaatagaggcatttgaataattgtcgaatctaatagtggcaaatagttaaatttgcttatccccgtatccctctgtatcacgttctttgattgcgttgcgtgactggcgtacgagacatttgcttatctcatactccctccgtcctaaaaaaaagacaaaccctggtttccgcgtccaacgtctgaccgttcgtcttatttgaaaaaattataaaaaaaattaaaaagacaattcacgcataaaatattaatcatgttttatcatctaacaacaataaaagtatgaattataaaaaatttcatataaaacggacagtcaaagttggatacggaaacctagaatttgtcttttttgggacagagggagtactctactgtgagttctgcccacacgcagtctgcaattctggcatctctgcagaaacgcaatgcctctcctctcgcctcgtcactttgagctcagtagaattggagtgtggcaaagcaaaagagcgaagccgtttgtcacaagtgccaccaaccctctcgtccggcggctgcccaacagaatccaccatggtttctccatcctttttccattttcaatgcaatccaccttaaatttctctctcccgtaacgccatccataccccggcattgctctgcccgtacacaaactaccacactagtcgcaagttaaaaccactacaaaatccattccaacttgcctcatctctcccacctccatcaccaaaccagcacaggtcgctgtctctctccgaaatatcatttcgttttttaatcatcttttcctcctcttcgctaatcaccatgatttgcctccgagccgccttccccttgacctcctccttctcctcctcccctctccgccgcctcgccctcaagccctcctcctcccgcgccgccgccgccgccgccatgtcgtccgcccccgccaccgccatcgccgcgccggtcgagcacatcgtgctcatcaaggtccgccccgaggcggcggcgtcgggcgccgccgcggcgatggtgtcctcgctgcaggcgctgtccagcgtggtgcccgggctgtcgtacatccacgtcggccccgtgctccgcctccggtcgccggcggcggaggcgctggggccgacccacgtcctccactcccgctacgccaccaagcccgacctggcggcgtacgcggcgcacccggcgcacgtcgccgccgtgcaggggcacgtcctccccaacgcgctcgacaccaccgccatcgactgggtcaacgccgcgctcgcgccgtccccggtcaccccgggctccgccgtgcggctcacgctggcgaaggtgaaggaaggtgtggaggtgccccagctcgtggagaaggtcgccgcggcgacggcggcggcgggcgaggcgaagggcgccagggtgagcttcggggagaacttctcccccgcgcgggctaaggggtaccagttcgggatggtggcggtgttcgacagcgtggaggagctcgacgcggtggagggggacgggaaggtgcaggaggccaaggcggcggtgaggccactgctcgacgaggtgctcgtgctggacttcgtcgtcggacctgccgccgtggaggctccggcgccggccaacctctgagaggtttgccttcggtttggaaactcttagttgccttgttcaatcgatcgagaataatgcaatccttgtgattgggtgtgctgctgctgctgtggcgtgtgattggcaatggcaattgattttggaatgaataagaattgtacctgactacctgaactaggaattaggatggccgctcttgcttggatcgtcgtgtaccaagaaagagcttgctgtcttcagtgttcatcttttcttctcgctctgcaactgcaaatttgtatgtcagataattttaagactcgcaactcggtgctatgcctctcatgcctcccttcccccattaagcatggaggaaccactgacatgccactgcacaatcttttagtatcatgcacccatagaagtattttagtcttgctccaattctgccttgtgaaatcctcataggcatgatttatggaacatgtgcctttgtgattgtagagtattatacgcaataatcgctgttgtcggaatcggatgtccgggttactacattttgagcagttttgatgactttggccatgttaaagttgaggaggtcagtccattcaatagtacagaggacctttttttagtggtaatagtgatcttgctgaacgcatcaggtttgacagtaatagttttggtcattcattcctattgagatcgactatcttgctgaatgaaactgattacataatttctcattgtgattttaacagctctagaattgttgcacgtggtattgccctcgatgactctcagcttgatgaccattctgaaagtgatagttctagtataggcactgcagcacaaccatccccaattaggaacagtccttcaagaagcttgagtttttctcatttgtcaaggttgagaggcagagttcataccttgtgggaatgggttcttcggaaatggccttcggtatgaaattattctaatttgtgtttgccatccttttcttatagcagaaaaactctcttgatttagtcatagggaaatgtttctgtagagttaaggttgtagtaacactatgaaaatgcatttcttgcctaacatctatataatcttatgtttgacacatcatgtaaattttggaatgagtttgaggaccaataagttttgatagatagggtgacgagtaacaaatgaagagttctgtttcttagtactgctcagtggctaaagtcatgaaacctgaacttattgtgaggcaattagaaaaattaaattaccataatacaacttattggtaaataccaacccagtttatcataacatctaacagaacatctccagtgaattgtgcaattcactgtcatatgagaactctatcatactctactcaattgaaattgctacgtccatttcaatcatttatttcatttatggtaggatgcaacaccatgatactatcaagccttaattaattgatggcttagttagagttggtcttatattctttttttatcacctcaattgaatctgtagtaactgtttgatatttgattacacttggacgtttccaatttgttgcaggattgtattatcatttaccaaagcgagcagctggcattcgttatgtattcattgggaagccaatgattcagaggcccaggtactctcctttattttgctcatctaggagtaccttttatactacggccgagtttagttccaaactttttcttcaaacctccaacttttccatcacatcaaaacttttctacacacacaaacttctaacttttctgtcacattgttccaatttcaaccaaacttccaattttggcgtgaacatgaaacatatcatacaaacattagactatgaaacacctgcaataaatgagtttgagaatgcagatgatgagtcttttcatgatctacagttttttttggacatcttcacatgttttacttccctttgggagcttaaaattctccagcagatcatatttaactcatcggattttgcaggtatcaaatcttgggtatttttttgttaattcagttatgtattctcggtgctgaaaggcttcgaagaagtaatttatcaacaattgctagttcgattaatcaaatctcatctggaagctatccttcatcgagaggtggcactttctttttctgaatttatgaaaccggttttggttttatgccaatgctttgtgtttacttgttacatgggtataaaatgttccaatattacctttgtgaatgggaaacaggtcgaggtgtcacatcgaatatttggacacatgcatggagtattaaatatatataaaaaaattaattacacagaatacatgtaaattgcgagacaaatcttttaagtctaattgctccatgatttaacaatatggtgctatagtaaacatttgctaataacggattaattatgtttaataaattcgtctcgtagtttataggcagaacctgtaatttgttttgttattagtcttcatctcatacttcaaatatttgtccgtatattcaatgtgacatgctaaaacttttcacccctaaactacacagggcctttaggctgtgttcgcgggaggatgttcccaaccagccgttagcgcacggaaaacggaacgatctattagcacgtgattaattaagtattagctaatttttttttaaaaaatggatcaatatgattttttaagcaactttcgtataaaaactttttgcaaaaaacataccgtttagcagtttgaaaaacatgcgcgcggaaaacgagggagatgagttgtgaaacttgggtaagaacacacccttaattaatctcgcgttaatagaccgctccgttttccgtgctaactgttccggttgggaactggaaatagcgaacacaatcttagggtgtgtttagttcacgccaaaattgaaagtttggttgaaattggaacaatgtgatagaaaagttgaaagtttatgtgtgtagaaaaattttgatgtgatgaaaaagttaaaagttcgaaggaaaagtttggaactaagtcctcagtagagttggagtgtggcaaagcaaaagaccgaacctgtttgtcacaggtgccaccaaccctctcatccggcggctgcccaacagagaatccagcatggtttctcggtttctccatccttttcccattttgaatgcaatccaccttaaatttctctctcc

SEQ ID NO: 64458 - DNA, 1048 bp, Oryza sativa
cttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagtaagagaagctttggagaagaagtcttaggtgaagtcctggcttataccccagttgagcacctgtgaagatggagacgtaggcccgctagtccgctgctgtttatttttgtttgtcaggcctgaagtgcctttttaataatgtaaatattatcgatataataaagatgtgtcttttatatcatgtttgtgtggtgtaccccggcttttcctgggacggggattaatacactagcgttctggaaaggtattttccgggcgcgacaatatgattgtgatgcatgaatgtaatttatttccaaattatatgtacataatcaaacccactaatttcgatgtaattgctttatttccgtccatactaattaatactttctatgtcttgggtgtatatatatacctgcagcgatggcattctattttttacacactccagtttcatatctctatgccgttacaccgctggacgtcgaccgtatactcgagtcgctaccggcctatcgtataccgagccgttaccgcaaactgagttaagtctactggtcgtgccacagctgtacactagccataaatcgttcgttcgcacgaagtatagtccaaaggctagttcgttcggtcgtcccgagttgctcattattaatagagtcattttaagccaccgattttgttcgccggttcggttgaacgtttgagtggtctcgtatcacggtgggttga

SEQ ID NO: 64459 - DNA, 4062 bp, Oryza sativa
ttgtacgcaactcctggacaaaaccctcacaccaaacaagtactcaggcttgtagcgcggcatctaaagacaagtgaaaggagggagttaagacatttatccaattaatagcacaagtttttggattaatgtgaataaagttggaaaatcaaagtaaaaaggtaagtaaataaagtaaaccaagcttgcaagataagttgaaatagttgaaaacgaggttacaaatttttgtacttttgatcatcaggttttaacagaaataaaagaaagttataaaatcgacatgctaaatttattttattgcagcaggattaaataaaacaatattgtaaaacttttgctggtaaatgagtcattagtacagtaatagatgtacagtactaataacactgaaataaattttgaatgagaaccattaaaagagattatgaagtgcatgtgccattagtttggtttaaaagagaaagggaggagaacagttctacttttccaatatttttagagggcttctatgggtaaccatttggcataacctaaggtcaaggaggctctgataccaacttgtcacgcccggaatttctatccaaaattccaaacgcttacatgtgtgggaaccctcgtctaggaatcagccgaggcacacaataacaaattgataatagagtacaaatattactctaactaataagcgaataaaatgtcattacagaggtagatagttcctctcaatcaataaagatctaagcagcggaaaataagataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgttatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacaattgaccatcgtgagctatcattaaataatagtgaatcataagttatcccaaaagtgtgctaatgtttctaagcatggctaagcaattatatctaatatctagttgaaccaatataaataaagctcaactagtcaaattataataacccaaggtatcaaggaataaagtaatcaagaacaaaagggctatagcaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcggttcacgcgaacggacggccgagatcgacttgatccaaaacggacggccgagatcgatcggtccacgaccggctcatggaagagggcgacgatgacgtcggcgatgacgtcaccaccggcggcggcggctcggcggctcggacggctcggacggcgcacgcttgccagcgaacggcggcacttcggcaagaacggaggacaccaacgggtagcggacggcacggcgaactcaccggcgacccaagcgacggcggaagaccaacggacggcgacggcgacgaggaagaagcgacggcggagatcgggtcgacaacggcgacgatgctccggcggtctccgacggtggcgaaggggcggacgaggacggcgacgacttggcgatcccgacggtggccttcctgagcgatgacgatgaccggaacggcggcggcgcagggctggagcgacggcggcgatggcggctcgaggtctcacgacgctagggcgctaccggtgacgagaggcgaaggcgagggtggcggcgggtagagaagagctcgggggtccttttaaaggggctcggaggcagcggcgaaggcccacgacggccggcgacgagaaggaaagttcgggaaaatcgaatccgaaacaaactcgaatccacgaatttccaaacgattttagccggtgtttccaaaggagaaaaggtagaggaaatcccgaagatcatttcccctcttttgattcggccggagaaggaaaggatcggccgatttggaaagcggcggcggcggcgcggcgctaaggtttcggccggaggaagacgacgactccgacaggcgggccccacctgtcagcgagcgaggacgcgcgcgcgggcggctgcggctgcggactgggccgacttgggccgaggagagagagaagggttttgggccgactttcggcccaaagccaaaagaagacttttcaaaacctttttcaatttaaattattttttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaaacctacccccttaaacagaatctcgtcctcgagattcggaagaactggcgaacagatgcggatgagttgacttcaattcatcttctcgttcccaagttgattcttcttccgagtgattactccattgaactttgcaaaaacggataactcgattcctggttcttctctcatctatttccaagatacggattggtttcttgtcgcgaccgggaaaattgccttttcccgaacgccagtgtattaatccccgtcccaggaaaagccggggtacaccatacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacatcttctctgaagcttctcttactgaaggggggagaaagatagagcaagaatgagtacaaccacagtactcagcaagtca

SEQ ID NO: 64460 - DNA, 3618 bp, Oryza sativa
gggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcagttcacgcgaacggacggccgagatcgacttgatccaaaacggacgaccgagatcgatcggtccacgaccggctcacggaagagggcgacgatgaccaaaacggacgaccgagatcgatcggtccacgaccggctcacggaagagggcgacgatgacgtcggcgatgacgtcaccaccggcggcggcggctcggcggctcggacggctcggacggcgcacgcttgccagtgaacggcggcacttcggcaagaacggtggacaccaacgggtagcggacggcacggcgaactcaccggcgacccaagcgacggcggaagaccaacggacggcgacggcgacgaggaagaagcgacggcggagatcgggtcgacgacggcgacgatgctccggcggtctccgacggtggcgaaggggcggacgaggacgacgacgacttggcgatcccgacggcggccttcccgagcgatgacgatgaccggaacggcggcggcgcacggctggagcgacggcggcgacggcggcactagggcacacggtgctagagctcttccggcgacgagaggcgaaggcgagggtggcgacgggtagaggaggcaccgggggtccttttaaatgggctcggaggcggcggcaaaggcccacggcgacggcaacggcgaaggaaagctcgggtagaacgaatccgagacgaactcgaatccaactctttccaagacgatttggccaaagattccaaaggagaaaaggtagaggagatcccgaggatcatttcccctctatcaattcggccggagaaggaaaggagcggccggattggaaagcggcggcggcggcgcgaaactagggtttcggcccgaggaagacgacgactccgacaggcgggacccacctgtcagcgacagcgagggcgcgcgcgcgagcggctgcggctgcggactgggccggctgggccgaggagagagagaggaggttttgggcgactttcggcccaaagccaaaagaagactttttaaaacctttttccatttaaattatttcttaaatgcaattccatttattaaaaatactttcttagctcaaataaatcccagaaaaatctaggaattatagaattaagcaaagtatttaatgaaattttatctggccccattttatattggaatttattaattaaaattagatcttctcttctaggcttttaaaataaattctaaaaatttcatttaaacaacaatttatatattttgaattttcagggtgtgacaacaatcttctcggagaggtcaccgggcaacttctccacaagccgtctaggaggcggcatcctccaagagtaacaagcaatgacccggcgtgagatgatcaagtgccacactagctctacaatggaagcaaatgcacttgactcttggctaatcaaccctataacactagatggatgaacacaaagctcaagtgagtgtgagagaggtgcaaggggtgtatgcaattgaattgggtgccaagagagtccccttgctgctggtgggagagtatttatactcccacccaccaaaactagccgttgggggcgaaatcccccaactttgtgctctgccggtctgaccggaggtatgtggccggtcatactgtgctactctgcaacggctagaaaactagcagttgtagcgctgtcagagggccccatcggcccggccggtcagaccggagttgattgggcggtcagaccggagtcggctcggtcagaccgccatcggctcggtctgaccgactacggctccgtcggctctgtatcggcagtcccgaggagcaccatttcggcctccagggggccggtctgaccgggcatgtgccgccggtcagaccgacattatgggccggtcagaccgccaacttgtggccggtcagacctgccctggtcaggccgaacccagtgaatgtgtgtgtgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacaccccgatcaattctaaattaaagcactagttttaccgtcttctttctctttgccttgcgccgtcaattttaatccatcgatcgtcatccatgtgcacacatgacgtggacctaacttaaaatattatttcaaagacaacggttagtccacaattagcgcttgtcattaattaccaaaattaacaccgggggcctagatgcttcaatctccccctttttggtaattgatgacaaactccacaaatagatatataatcaaacatagagcacatggacatttattgcattgaaaagcaaaggctccccctaaacatatgcataaaaatcacaaatagcaaatatggagccaatgcacattacaatatcacatttcaacatagcacaacacatatgcaaattatatgtgaacttcacatatgaatcaaccgaatgcataagatggtcacaagtatatcaatgtagcaccaaccatccatcatagcacaagttcacatcaagaccacataaagggttcacaaataaatgcataggctattacaagaccacgaagggtccaaatgacataaagagtttaacaaaacgacaaataacacacaagatagagtaatagcccatacccatacaaaatatagctcaatcctccttaacctattaaatacgagggcactatcctcactactactagtcccaacccaacaaaaaacacacttttctcccccttttggcatcaagcaccaaaaaggtcttcactcttgtggagaaaaaggaggacgcgccgaagtggaaggatgagaagcatcacgatgacgatgatacacgaatgcttgggagctctccaacatttggactcgagagtccaatgtacccactcgagtgtgcaatctccccacggaagcattcaagtctccaacgtccgtgcgcaagccacgaacatcctcatgcaaagcgtcatgcccggtagacaagcgttgaatgctttcacttagggtattaatagccccaagtaccgggttgaagtactcgttgggttgcatcccaaaataggcatactgaggatgaaagaaagcatttggatcatacccatgaagaggcggaggtgcagagcatgagctagctctaggatgagaggagggcgccgtcctatgagcacggggagctccaa

SEQ ID NO: 64461 - DNA, 1756 bp, Oryza sativa
tgtcgaaactagatttcggcaataataaaagggggtggctatcaagctggataagtgtatgggtttggagacaaaggatttatacaggttcaggccttcttataaaagaagtaataccctactcctgtccggggatgaatccgccgagtgtattattgattgtatgattcaagaaaaatcagcatatgcccctaggggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacccagttcgaataccatcgccgtgtagatatgggatacccatgatctccacagtagcccccgagtcctttgcagtcgaccatcgtagccttctcaaagataataatccgagtacttcaagctcttcaagccaaaatctgccgagtggactgtaaagggcgaaaagataaagaatatggtgcatcgaatagatgcacctaattaggtgtagcccccaactatgtgattagttaacaaactaaacatatagttgaatgacaaaataataacgcaattgtgcattatatgacaaaagcatatgcggcgcctaaataggcatgctagccgactgatttatagccacaataaaagaaatccgagtggtttacactctaaaaggttcacgaatgaacacacttgacaggcatccgaataaaaactctaaagattacccatcaagtattatgaagattatggtaataaataagtcgaatagcctaggccatgactatttaccatgaaaacaggcatataacacgccaaggaaatgactatagtaaaaacaagtcattcctagttaacccaaacagcttttgtagcctaaaaaagcctgcaaaaacagcataacgcctttctgtcgggcacctttttaatttgcattgcaataattccaaagaattatatgaccgcataaaaaggatttgatcagcattgggcaacactgttgtgcgcataatatcgccaaagcaaaatatgcctaagtccctaaggaacacaatgggccacgctgttaaaattattgggctgaagtactgttcaggcctaggcccattagcacctccgatacccttaactgaaaaaatccgatatccaagcgacgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggccaatgggcgtcatccgacgtaacagaagagaatcttaaggagatggtggcgcacggcgttctccctgccaaggagatcatcgggtggcgaccagcgcacggtgaggctttcccgtctccggatactcatgagattgtggtcttctcgcatttcttctacggcggttttgctcttccgacctcaaaatttttccgcgggatcttgaatttctatggaatcagcttgcatcacctaaacccgaattccatagtgcatatcgccaatttcgtccatgctt

SEQ ID NO: 64462 - DNA, 1042 bp, Oryza sativa
ccctggatttcaaaatcatgaaggagaggatgtataaatcttctcaaatgcaattgtagtcagctactctcatcagctgccagtagtgccatataatgcgttcaatccgcctccgcaggtatgcatctgaaatcctcaatctatggccaaaacataattttatcttcatgctgagttgactaactatggaagcatcttgtgcaggaatatgcattgatgaagtcagatccaccagtctctcagcgccggtctcctcgccaacacaccgctcagggaggtggaggaccaacgatcagaccagatccgcaacctcagacctccaaattggctggtcaaacaggtcctcgcaaaagaaagctgatacttgatgatgatgaaggcgatgatgataaatctggggataagggctcgcctaataaacccccaaagcgtaccatgcccaggaaaaaactggctggccgtgcaatgccaaagatcagaacatcttccaggtattatacctctcgatatgattccgcttcggcatgtcatgctcatgaaaatgatgctgaatactgaaagaacactttgcaggaaaccatctgatatagatccatctggaaaagaccccgatcctgccatgacagaacaagatatatccaaggaccccgagccgactgctgaaaaccagccgactgctgaaagccagccgactggcgcccatgcttcgggcgatagggccaacccaagtgacctgccgccgactggaaaccagtcggcaacaactgaaacggcaacaactcaagagcccccgactggaaaccagtcggacgcaggccctgatcaagagatccccgaagcagaagcgcagacgacgacttcgcaaggaccagaggctggtaacgactcgatagctgggtcttcaggtaaagaacaaagatccctcacgccagctaggtacatcttcaggttagttgtcttctcaaacaatggcgatttaaataacctcagtgtatccgtctaatgtcttggaaacacatcaggaccatcaggtgatgacgaa

SEQ ID NO: 64463 - DNA, 1390 bp, Oryza sativa
ccagtttaactacaatgtaattacactatcgttacattataagtctctatataagttagatataaagttgcatatattattttaatacttatatgtaagttatattatagttatagtatagatatagtgaaattatgttataattatgctatagttagatttgaaagtttttcctaaaaaacttgtggcaattttttagatagtacctctatatttgagcgccatcaatgcgtagcctcccgtgccagcgcctcgccgccagctagccatcaagtagaagcgcaacatctggtgcactcaactccatccacgtataattgggttagagatggagagggtcagaaagaagagtggatcccctctcccctacgctagcttgctaacgtggtcatcttgtggcggtaaggcaccgcaacaagaagaataacatttggaaagagtctgccatagacctacgccgatggcagcaccgccacctcggttagactacccacgtagtcgccgccttaggccaactgtccgcctcgcccagttgcctcatgttgtcatcgaatctccctgcaacaatgccatgggccacagaccaatagcctacaaaactgccatcccagctggcgtcaccccgtcgttgttgcgctgggcttcggcctcctatcggcctccacctaccgccaccgtggacggcttactcctatgtcgcgtcgggtttatgctgtcgccggcctcggcctcccatcaatctcctactattgtcgtccacatcacgccaaccagggggcgcaccacctcgcctccatggccacactacattgcctcacctcgccttcatgccgcaccccgctccttctggttctagcagcctcacctccatcgctgcaccacgtcacctctccttgcactaatcatttcattgtgctcatgatctagttcatctgagacttaggtggtaaggatactattgaaaataagaaaactattggtgtagattaattgagtattcattattataaacttgaaaattggatttatctgatattttaaagcaacttctatatgaaaagcttccgtacaaaatacattatttaacaacattatttaatattttgaaaagcgtgttaaccaaaaccagctatcttaacttgaaaagaacggggccttggtagagggatccggatcctatcttcttatatagttggtacccactaagaggcatttactcctataaagtaagacatgcaagaagccacatcattaacaattttaagacatcagatcatatgagtacaaagataacaacagttggatcaagaaactacttattcatccaattaaatcatttattattagttatccattcacctccttttgctccatctcatagtcacacgta

SEQ ID NO: 64464 - DNA, 3096 bp, Oryza sativa
attcagtttgagcctttgccttctcacttcttcctctccaccgatcttcaatctcagatttcgtgtgtgtgcgtgagtggttgatttgagtttgtttgagtgcttggtgttgacttcgtgaagatttgttgagcactcgattcatcgccaagaaatctctgtgcatttgttactcttggtggttgaggacacctagatggttaggagtaaacctcgagataccgatttgtttgtggtgtgccgagggagtatgtgaaggtcggatcttacctccgaaagggaagagcgaggatagagttggaaaagacccggcccattatgggctcctcaacaaagtgtagaatccccccaaggatttgatctttggtaacacatcaacttgcaagaatcctgatgatatctttttcttactcctctagctttgctatttggtgccgctagtagtttagtcgttgtttgtgcaaacccattaactacctgttacaccatccctttttgtttgcctttctagcttgctaaaaaatctgagatttttggaatatcccaaaatatttcagaatatcggaaatattccaaaatatccgaaaatattccaaatatccaaaaagtttatcttcttcattgacttacgagttttaaacgcctcttcaacctcccccccccccctccgcaggtgatatcaagatcctttcacttgtgataccacgttctgatacctatggttctcagatgattcctatggggcatcatgtaatacttgtgaggtattgcaacacttgtgatattaggttctaacacctacgttgaagcatcgaggcccccggtgttaattttggtaattaatgacaagcgctaattgtggactaaccgttgtctttgagataatattttaagttaggtccacgtcatgtgtgcacatggatgacgatcgatggattaaaattgacggcgcaaggcaaagagaaagaagacggtaaaactagtgctttaatttagaattgatcagggtgtagggcgatcaaatttgctagtttatttctagtttcgccgtactattaagaggggtaatgacctagcaaagagatgattttaattgccacattaggtcattgcattatcacttgtgctcactttttcatcacacacaaacacattcactgggttcggcctgaccaggggcggtcagaccggccacatagtggcggtctcaccggcgtgccctgcccggtgacctctccgagaagattgtggaggaggcccggtgccggtttgtgagtggtttggagttcaccaccttcggagtgaagaaagaactaacctagtgatcgaggcttgggtagtcctctccatgggccggctcccgccatgcccaccccttgacgaagggggcgtgcggaggctacgtggttgagcggtggagttgggctcgcctcagcggggagtaagaaaccgacgagtttccgaacctcggtgaaaaatctcttgtctccttgtctcatttgattgtcgcatttacttttgtgcaatttacttttctagagacaaacttgagatcatatcaccctaggattgctaaacattgacataggagtgtgagttactttcctagagatataattgagcctctatcaccctaggtttgcaaaacctaacttagttgcatagttagagttgaccctcaccaagcctagcaacttaggttagttttgattaggtgtcatttagttttaaatcgcctattcacccccctctagtcgacatctcgatcttacaagtggtatcagagcttggtctctcctgattgggcttcaccgcctagagagaagatgtcgaacgaggtgaaacacgaagggaaggctcccatgtttaatggcacaaactattccacttggaaaattaaaatgtctactcacctcaaagctatgagcttccatatttggagtattgtggatgtaggctttgcaatcaccggcacgcccttgatggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcacttcctcaagatccaatatgagacattctctatgttgcctcatgagagtgtgaatgacatgtatgggaggctcaatgtcattgtgaatgatctcaaggggcttggggcaaactacaccgatcttgaggttgcccaaaagatgcttagggctctaccagagaagtatgagacccttgtcaccatgctcatcaactccgacatgtcaaggatgacaccggcaagcctcttggggaagatcaacaccaatgacatgtataagttgaagaaaaaggaaatggaggaagcctcaccttccaagaagtgcattactctctaagccgaagttgaagacaagggcaagggcaaggtgaatgaagtcaatgagaacttggaagaagagaatgcccttcttgctagaaggttcaatgatttcttgggaaggagaaaggagagaggaaagggctccaactcaaataggagaagaaatagaagacccaacaagactctctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcgaggaatgggactcaaatgaggagagctcgcctcatccgggtccgaggaagaagatggtgatgatgcaagctccaggaagaagaagatggccgttgttgccatcaaggaggctccatcactcttcgctccactttgtctcatggcaaaaggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaa

SEQ ID NO: 64465 - DNA, 6270 bp, Oryza sativa
ctcgcaaaataattgcaatctgtgcaattagttatttattagccaatatttaatacttcatgtaggtgttcaaacattcaatgtgacaaggtgtaaaatttagggtgggatctaaaagggcccttaattaagcacgcgaaggagatgtagattaaataaatcatcgccaaatgttacatcaagctgatcgtttcttcctctgattttctgtttggtgcctactcctacctgcgtgcttttcccgaatttatagcttgacaaaacatcggaaacgcttgctatcggccatccgatgaaaaccaaaatatcggacacctaaacaatcaacgaatcagatgagctctctccctatacacactcgtaggcacatgcgggcttcctacacacactcacacacacacgcacacctctctcattctctcccctacatgcacaatcatgcattctctctctaatttatgtatgaggctatacttggaaacttcaaaaattttgttctcctaaatcatttacccaatttataatctaattataccgttgtaatcgttccaattaaatctttacaacaagaccacacatgattattttcatattaaatatatatgtgtttgatgtttcatgtgtgagaaacatgtgtttcacggagaattcgacattgttgcatattttatattgttatgttgcaatttttttttaaaaaatgcaaacggtgttgtttggatgtctcaataagtttttttaatgtttcactagtttatgtgtaaatgttgcacgtggtattatttgaacgtttcagtaagtattgtgtgatgttacactagttcattcacaaatgttgcacttgatgttatttgaatgtctcagtaagtatttcgtgatgtctcaatagttataacttgatgttccatgtattatatgagaatatttagttagaaatataattatatattttttattagaaacataagaatgtgagatcttgttttaaagatttaattgtaacaaatatagaggtacaatcaaatctcataaaaagataattagtttatgaagaaaaatagtttaaagttcattaaaaggttgtgtgtgcagctgcttgcgacagtgcatgcggcaggggagtagtgcatggcccataacaacatgcatgtggtagttgtgacttgtgagtgatgttagtaagcagggatgcgggcatccgatgttttgtgtattatcggacgtccgatccgtaggcgtctccacaaaacatcccgcgaattcccgacaacaagatgaatagctataacttccagatggtgtaccatccatctactgtaccgtctagtggcaaaacccctagctagttagcttcaccttaacaaagtttgattttttttatctttggaattcaattttcaaatagttttggggatctactcccatcaccttatgtgaagctctcatttcatgatcactaagaaatgtggaaaatctaattgttatattctgatgaattacatcgaccctctcatgggtgtgtgtgtgtaaataagactacataagagatagaggcttcgagtgcaatataagtaggagtagatttatctctaggattgtatctttatctctaactaactaacatcccccctcagtcgtaacgggagcaaagcgaacgattgcaactggatttgaaatcttctatttcttcattttcttcgactcaccatcatcagttgcatctctgatggacggtcctccacctggtgcatgcgtccccttcggtgtcgtcccttgactctcctctattccctcccgcagtcatagcgggagtgtcatagacgatagcgatgacacggatgctttgactagaatttccgtcaatgatttttgttatagacattcctcgatgtagccgatcatgaagtagccgtggttgtaggtatagccgcaaatagccgaaggcgaaaaaaatatttacgccatggtgtgaagacgagactgcaattgttaacatcttgcaacttgtagatgtcagagaatgccattggagacgtcttgtgaatgtcataggatgtcgttggcaatgaggccaccactttggttggtccttctgcatcgtgtagcggtcatcacaatagcgctgccgagttgacactactacagaaacctttttgcaaacgggccagagcgattctcgcatgcgccaaatcgtctgcgaaaatgtaaatctttgcatgtggccagggcacccgcatgcgaaaatccaattttcacatgcaggcgtttaagccgaccgtatgcaaagagaaaaaatcgcaataaacaataaattccaaaaataaaaaaacgaaaaaaaacctagtgccgccccccgcccgagctcgtctcagccgccgcttccgctcccatcgtcaccgtcgccgccgctatcgcccgagaccgccgctgccaccgccgcccccagatccgccgccgagcgccgagcgccgagctccaccgtagggcggcagatccggccctctcgaggatggcgctgcccgatccaccgccacgtcgccgtgcccgccgccgagcgcagagctccaccgtagggcggcagatccggccctctcgaggacaccgccgcctgatccgctgccgcaaggcgttgccgtgcccgccgcccgccgcctagcaccgagctcctccctagggcggcggatccggccctcccgaggacggcgtcgccggatccgccgccgcaggctatcgccgtgcccgccgtccgccgtcgagcgccgaactcctccctagggcgacgaatccagccctcccgaggacagcgctgccggatccgctgccctcgccgcccgccgacgccatcgccatgcacccattcccgctgtcagcgagaagagaggagagaacaaagagagagaagaggagaggagataaagagagagagagaaataaatggggtggttgttgatggtccttaaatcataatatttgaccgtcaatacctgcatataatgaaataaaacatggtatccaacttagtggtagggattattactaatcaattccactagtgttggtgaaatatgtgtatgcaggtattttaaggataaaacacacctatcatgcgaggaaacacacttccggtcaatcagacgcaagtacacggattgaagggcccacaagtcaggtgaaaccaccatggaacgggtcataactgccataaccgtcaccatggctcaccagtcagtgaccctgccaaaggagaagccaggagatggggcccagggttcggtcgaccaggacaccacaagctcctctcatgtcacgaccggaaatcacccaacaggcgttcctgacgtgcgtgtattattccttgtcccaggaggcaaggtacaccaaaagttgatacaatacagagtttaacaagcggaagcgtatataaaattattacacgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcacgggagtacaagggaattataatataaagggttagggttgcagtaaacagcatttaaagacatttagttgctcaaagctattttgtaaacacgatcctagaactaaacaatgttattaatcaaggccgtgaacccgcacggacctgccttaacccaaggcctacgatgattcagaccgaactggcaacccgaccctgggtcccagctcgtcctaagccaacccaggccaaccattccatatttagttgttgagcaaattttaagaattaaaacactgacttgggtacattgctaggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgagaatatcccaaagtctagagttgtaaaaccacctaaggttacctaattaaagcgaagcatctacctaaaattatactagggataccatgagtagagtgtccactagttgaggttttgtttgctctagggtgaacaagggaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcatgtttattgcgtcagccgagggagcggacgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcacccgagggcggcctcgccggcgcggccgacgggagtggcgcgcacccgcgccccgatggtcgccgccggcgaccaacggcgcggcggagtggcacccgagagagaggaggaaagggggaaggcgaacggcggtcttcggctcaccccaagacggcgaaggcggtggaaacggcggacggagcggaggaagacggcggcgcggctcgggatgacgatggcgacggcgctccggcagtcgacgggcgaagcggagcggcggacggggtcgacggcaacacggcgaagcggacggaggtgtcgccgagtcgggaggaagtccggagcggcggcggcggcggaacggagctcggcggcgacggcggagagagaggagtacggcgcgagcacgaaatcgacggcgagagcgagcggcgagcggcggaaacggaggagcggagctcgggcaacgattttatagcgtcgggaggagagagggcggccgaggaggaaggaaaccggccgcggggatttcggccgccattgattgcgccggcgacgattacgggcttgactcgaacgaatccgagggagagaaagaaggagaagagggggcaacgggagacgggattgcggggcataattcccctctctgtaaggcgcgcggggaaggcgggatccggcgcgatccgcggcggcggcggcgatagggcccgggcgcggcggcgggcgcggcgggagtagggagatgacaggtgggtcccatccgtcagcgagagcggcgggcgggcccgcctgtcagcggcgcgcgcgcgcgcggggagccgatggccggggggagatagagagagagagggagggaatgggccgagccggcccaagaaggaaggggggggagaaaaagaacttcttttagggttttctttttataaaacctttttaactttgtttatttcttttcacttatta

SEQ ID NO: 64466 - DNA, 21068 bp, Oryza sativa
  unsure (1)..(21068): unsure at all n locations
ctttcggttgctcaaatttgtgatcttagcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggcatgaatcaattgagcaaattttcaaaacgtgatctagttatgggcttgaaagatgtgaagtttgagaaagataagctttgtagtgcttgtcaagccggcaagcaagttgcatgttctcatcctactaagagtatcatgtccacatctaaaccattggagctcttgcatatggatttgtttgacccaacaacctataagagcattggtggtaatagtcattgtcttgtgattgttgatgattattctcgctatacttgggtgttctttttgcatgataagtctattgtcgccgaccttttcaaaaagtttgcaaaaagggcccaaaatgaatttagttgcactcttgtgaaaattagaagtaacattggttccgagtttaagaataccaatatcgaggactattgtgatgatcttggtattaaacatgaacttttcgctacctactcacctcaacaaaatggtgtagtggagaggaaaattcgtacattgattgagatggcaaggactatgcttgatgaatatggtgtttccgattccttttgggcggaagccataaacaccgcttgccatgcaaccaataggctttatntgcatcgtgtcttganaaagacttcctatgaggtaattgttgggaggaagcctaatattgcctattttcgagtttttggttgtaaatgttatattcatcgaaagggtgttagactaaccaaatttgaaagtcggtgtgatgaagggtttcttctaggttatgcctcaaaaagcaaggcataccgggtctacaacaagaacaaaggtattgtggaagaaaccgccgatgttcaatttgatgagactaatggctcccaagaggggcacgagaatttggatgatgtaggtgatgaaggcttgatgagagttatgaagaacatgtcaattggagatgtcaagcctattgaagtggaagacaagccatccacctccactcaagatgagcatctacttccgctatgccaagtcaagctcaagttgaagtggaggaggagaaggcacaagaaccacctatgccaccaaggatacacaccgctctttccaaggatcacccaattgaccaagtgttgggtgacattagtaagggtgttcaaactcgatctcgtgtcacttcgatttgtgaacattactcgtttgtttcttgtcttgagcgaaaacatgtagatgaagctctttgtgatccggattggatgaatgctatgcatgaagagctcaaaaactttgcaagaaacaaggtgtggactttggttgaaagacctagagaccacaatgtcatagggacaaagtgggtctttaggaacaaacaagatgagaacgggttggtggtgagaaacaaggcaagattggtggcacaaggtttcacacaagttgaaggtttggactttggtgaaacttttgcccccgtggcaagacttgaggctatttgcatccttcttgcatttgcatcatgctttgatataaaactatttcaaatggatgtgaaaagtgcttttctaaatggtgaaattgccgaacttgtctttgttgaataacctcccggttttgaagatactaaatatcctaaccatgtttacaaactctcaaaagctctttatggtttaagacaagctcctagggcttggtatgaaagattgagagattttcttttgtcaaaggatttcaaaattggaaaagttgacatcactcttttcacaaaaatcattggtgatgatttctttgtgtatcaaatttatgttgatgacatcatattcggttctactaatgaggtattttgcaaggaatttggtgatatgatgtctagggaatttgaaatgtccatgattggagagttgagcttcttccttggacttcaaatcaagcaactcaagaatgggacgttcgtgagccaaaccaagtacatcaaggatctactcaagaggtttggcttggaggatgcgaagcccattaagacacctatggcaaccaacgggcatctcgaccttgatgagggaggtaaaccggtagatttaaagctttatcgttctatgattggtagcttgctttaccttaccgtatctaggccggatatcatgtttagtgtttgcatgtgtgcacggtttcaagccgctcctaaggagtgtcacttagtggccgtgaaaaggattctaagatatttaaagcattcctctactattggcttgtggtacccaaaaggtgctaaatttaagcttgttggctattccgatccggattatgccggttgcaaagtggatagaaagagcacatccagtagttgccaaatgcttggtagatcccttgtgtcatggtcatccaagaaacaaaactccgtagccctctctactgccgagacagaatatgtttcggcgggtagttgttgtgcccaattgctttggatgaaacaaacattgttggactatggcatatccttcaccaaaaccccactcctatgtgacaatgatggtgccataaagatagccaataacccggtccaacattctagaaccaagcatattgacatacgccatcacttcctaagagaccatgttgccaagtgtgacatagtcattagccacataagaaccgaggatcaactagccgacatctttaccaagcctcttgatgaaacccgcttttgcaagttgaggaatgagttaaatatcatagacttctctaatgtggcttgagatggtgcaccatggttgcttcttttccatattgtttatttgctccttttttgctcttatgctttagatttattgccatttggttcttcattgcgaaaatggagcatgtcacattaagggggaggtttgcactcttgcatgtgctccacttccttttatatgtgagcaaatcaactaaaagtgctagtagtgttttcaaaatgcccaagtcaacataagtcaaaatttttgcaaaattaatgtaatttgaaaactatctcttggaaaatgtttcaaaaggttccctatatgttttccaaccttcactttgcaagaaaaatgtttttttaatgaaaatgccattttggccctcttttgaagaaactagaatcttgtttttggccaaaatgaaattcaaccccaaaatgagattgagaaggaatttgagaaaagtttcaaaacaaagttggtagagaagaagatttgaaatgtttttggtattcaaatcatattcaaaatccaaatattttaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaattcaaatttttattgaattttattgtgtgggggtagccgaactatgcaagggcagtgcacagtcggctgggggccaggcggtctgaccagcgctatatgcgcggtctgaccggcctggtggcggcggtctgaccggcctctagggcccggtctgaccggctgcaccctggcggtctgactggccagggatggagggcccaggactttgtcctttcttcctcctcctccttctacccgacccgtcctcatcccatctcatctcttcacttctccaactcgaaatttcttctgctctctcctctcccaaaccctagccacctccctccaccaaatccgtccggttcaaccgtcaaaatcactccggttactccgtaagtgaatcccctcctcttcctctctctattccatggattgatttgagtttttattgagtttgtgatccatggcatggaaccctaggtgaaggaagaggtgttcatcgatttgcaccaatagagggtagtttcttggtgtgattcaactccttcaaccggtaaatccctctccctcttgtgcattgctctcaaatcggtctatttcaatctttagggttaagggtagtttccccattgcttcaatcttgatgaaatagacctacacaatgtcacgtcccaaaacgactctaaaatacatcctctaaattatgccgagaataattaaaattcgtgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaaccctaaaagaagtccttttccccccccttcccctcttgggccggcccggcccaattccctccctctctctcctctcccccgcggcccatcggcctcctccccgcgcgcgcgccgctgacgggcgggcccgcccgccaccctcgctgacgggtggggcccacctgtcatcccctacctcgcgcctcgcccgccgccgcccgtgccctagcgccgccgccgccgcggattccgccgcatcccgccgtccccgcgtgcaataaagtgggggaaatcactccccgtgatcccctctccctttccccccatttttccctccctctctcccttggattcgtttggaaacccctccccaaatcccgccggcgccattgatggagcccgagaacgccacgccggtttccttccttctccggccgccctctctcgccccggccctatttaaactctccccgcgcctcccccgcccgtttccgccccttgccgcaccgtctctccgccggaatcgagctcgcgccgtcgccctctctctcctccgtcgccgacgaccaccggccggccttctcgctcgccgggaccgtctcccgccccggcgtcgcctcctccggcttcgccgcaccgccatcgaccccgtccaccccctcgccgggtccgccgaccgccggaacgccgtcgaccccgtcgacccgagccgcgccgccgccttcctccgctctggctgcctttttcgtcgttgccgtcgacctagggtgagccgtggaccgccgcctcttttcccccttcccttcccctctctcggccgccgctccgccgtgcctatggccgtcgccggcgaccataggggcgcgggcgccgcctcccgccggccgcgccgagtggccgccgtcgggcgcgccgagtggctgccgcgtggggtccagccgtcagccgcccgcgccctcgggtgtggctgacacgtggggcccacggcgccggccggtgcgagcccgggtgcgcccggtccaccgtggaccatgaggctgccgcgtgggccctactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttctgttggtcgtgtagacgctgcagcttcggaagatccgctcttggtggaggttgaagccgacgtttgggaaagcgagcaaggcaagttacatcatccttgaacatattgaaacccagtttataaaattattttcatttaaattattgcattatcgctttacttaaattcccgcgttatcactgttttatctagccatgcctatgtacctttgttatgaccttattattattgttattgatattattaccttgttcaccctagattaaacagaaccccaactagtggacactctactcatggtaccactagtatgattttaggtaaatgcttcgctggttaattaggcaacattaggtggttttacaactctagactttgggaatattctcatcacctggacattacggaatggatggattattttggaattggattcacacctccccctctattcaaaaccctcaaaatggtttttggctgggctcggggtgcatggttttgatagtagcacctcggccatataaggaccggtcttcgggcctctgttgcaaaacactaccgtacttccacatgtctagtgggtaaggcttagattgtggctcagtctggttataaacaaaagtacacggatggagatggacgaagtcgggggtcgatggacatctctagggcaaatgaatgctacacgagctgcggcccagtagtcgagatgtcatggcacaggaccggtgtcctgctgttaggggctcagtcctgcctacctgtcccgggggttccgggcgtaggtggggttgggtcggtactcttttctatggctaggatgggttggaaactatgtcacgtcttccgtccgtataccgtggtggtatgtggcacgtggttacacgtgaggaagatgtgtcttgtgggtaaagatgtacacctctgatcagagtataacctatcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtccgaatcatcgtaggccttgggttaaggcaggttcgtgagggttcacggccttgtttaataatactgtgtagctctaggatcgtctttataaaatggctttgggcaactaagtgacttttaaatgctgctttactgcaaaacttaacccctatgttatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttcctttttttctcctttcccctatgctatttgcaaaagggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttggagaacccgtcgcagaacctaagccaccctctagtgtttcgtttgtcgtgtgtttccttgcttgtgtgtgtagcgcgtggtttgcatcagtggattgtgatgtaaccatgctaggttgtttgcttaatcaacttgcagaataagtgaaacaaagaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgactcaagtaactcaagttttcaactcaatctgccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaaaccaattaaactgtgttgggttaaaaagccaatgagacagtagttggggataggagtttggatacgcctcttacagatcaagataaggattgttggatgaaacccataagggacccgccatgcctctacattgataagttcggatattcctgcaaacagttaagaagatccaggagacatcaatatttgagaacataatagtcgatggttggtaattagtctatcaggtatcagaaaagggtcaaaggtgatatggcagaagaacaatatggatgctccccatctcgaggaagcactaaagatgatcatcggcaattaaaccctagtggcatagatacagatagcaagcaatgtatttccctgaaggtggtcagtgcagcttcttgacaaaccacatcaaggtttcactgaaaggcagcaagccaaaggacctcatcgtccccagaagcgtccgcaatccacattaaagaataccacatgttaaagataagccgaaagatgattgataaaagagattggcaaagatgttctccagcatgaaagaagtaggccggaaggtgattgataaacagaaacatgctctgcatcgctcaaggaagacccctgatagtaattgccccgcaacagtcaccttgtcattaagtaagcaagatgacctaggtaaaagtgtttctatgaaggcaaggagtgaaatcttcaactcggtatcagatgctacacggagtgaaaagtgcaagcaccggttaccaggtaatgccatgtcttgggagatgatccaatgggaaggaacacatcaaggttaaaaggtgtaaaggaatacgttgaatgctaaccgaggacaacctgaagataatagtggaaagtaaactgaacataaagaaagtgaatccgagttgcttgttcgtgagagctattcccagttatgaatcaagtgatatgttcaaagataatctacagaggtcagattaaaatcacatctaacaacgaagcctcagatttggcaggataatgattagacagtaacaaatccagcaataaagccatttgggaagacgtcaaagtatgtcaagtgggataagttggttctcttgggaagcataattcaaaggcaaagttagcgacccttgcatcaaatagcagaagtacctagcaccggagaccaggaaagctaatatgagacagttcatgttgtcaatcatggtatccttagtaagcgggatatcatagtctaaagcatatggtggtaagctggaaggaaacgccaagcatggtattctcatgatgacaagcatggtatcctagtaatgacaagcaggttacgagacatgacatgaagttgataacttgtgaggttgacgccgaagatatgaatcgtgagaagttctggatctgaagccccatcttcaagtgccgcaacctagtctgagtcagctaaaaggtgcaccctggttcaagtcaggtgaagagaagattccatccgcagcaggaggtcaagccaagcagttccgagtggtgaagttttgctgaaagtttgtgaggacggagcggaagaagtcaaacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggcgccctcaaattttagtggaattttcagagcacaaataataattgagaagaaataaacaaagttagaatggttttataaaaagaaaaatcctaaaaaaagtcttctttccccccccttcccttactgggccagctcggcccagctccctccctctctctcctcctccccgcggcccactcggcctctccccgcgcgtgcgccgctgacgggcgggcccgcccgccaccctcgctgacgggtggggcccacctgtcatccctatcctcgcgccgcgcccgccgcccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcaaagttcgccggcgcatcaatggcggccgagatttccgcggccgattccttcccctccggccgctctctccctctcccggcgctatataatcgtcccccgtgcttcgctcttccgtttccgccactcgccgcctctcctccccgtcggaatcgagcccgcgccgtcgcaccttctctccgccgtcgccgccgaactccggttcaccgccgtcgtcgccccggacctcctcccgcttcggcatcgcccccttcggcttcgccgcgtcctcgccgaccccgtccgctcctccgtttcgcccgccgaccgccggaacgccgccgtcctcgtcgacccgagccgcgccgccgccttcctccgctccggtcgtcgtttccgccgtcctcgtcgtcccggggtgagccgtggaccgctcctttcgcttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcaggtgcggctgacgcgtgggacccacggcgccggccggcgtctgccgcgtgcgcccggtccaccgtggaccgagaggctgacgcgtgggccccactcccatggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagcgtttcaattcctaagacctgcttaacaactaaaatgtggaatggttggcctgggttggcttggaacgagctggtacccagggtcgggttgccagttcggtctgaatcatcataggccttgggttaaggcaggttctgtgtgggttcacggccttgataattaatattgtatagttctaggatcgcgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccaccgttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccagcagcgtcacccgtcgtggtttggacatgactggcttcgtcttggagctgcggggcatgtgcgtggtcttggggtatccacatggagtggactaccaggccaggccgcttccggagcaggagggtgacgatgcagagccccacgctggttgggaggtcactgcagtgatcctgtctggctctcccgagcggacttcgctggcagtcaccgcgggtggagattccttccccgccgcttgccagaacgccgctctcctcgctatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctggtggagccgttccaaccaactgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgccggactgtaggcacttgaacgttggttgtccctgctgggctgctccaattctgtaatagttgaaaggctgttgccaacatgttggtttggttaaccacaacttggattagctctggtgaggtttcgttggtgcttctctcattcccattggcttgggttcttgcgtcatcggatccatcattcccatagcctttgttaccagtattatccatctgtcacaaggtaggggttgagaggggaagcatacaaggaaagaatagaccagaactagggacaagaccttaaaggaactaactctttttgttgatgtgttgtttgtttcacttattctgcaagttgattaagcaaacaacctagcatggttacatcaccacccaccgatgcaaaccacgcgctacacacacaagcaaggaacacacgactaacaacactaccctatagggtggcttaggttctgcgacgggttcccaagatcttcactccttcacagctggcttcattgcttccttcgcttcgctagcggatcctgcagtcttccggagcttcggcaaacaactgacgacatcttcttcctcgcaaagctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgccagtgtattaatccccgtcccaggaaaagccggggtacaccacacaaacatgatatagaagacacatctttattatatcgataatatttacattattacaaaggcacttcaggcctgacaagcaaaaataaacagcagcggactagcggcctacggctccatcttcacaggcgctcaactggggtataagccaggactccacctaagacatcttctccaaagcttctcttactgaagggggggaaagattgagcaagaatgagtacaaccacagtactcagcaagccacaccggcagatgcataattaatgcaagggaggtacaagggaataataatatagggattaaggtttgcagtaaacagcatttaaaagtcacttagttgcccaaagccattttgtaaagacgatcatagaactacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccgagatatgatcatccgaagtttaatgctgttatatggagatttgcggattattataatcaagttttgcaactataaaacaggtgtaagcgctagcctggaaaagacaggaaggctgcgccgttgacatgcggaccccacatgtcaacctaaaggaccgcggcagaccgagtacacagagacggtccacgggtcgacggaagcggaccccgtgtgtcaaccgaagcgagtggccgacaaacggactccactagacaccacacggtcaccacccgcacacgcgaacgactgccgacgccgatacacgggtaccggggccgacaaccgcacaacgggcatgggcgacaccgaaaggacgaggacagggcagcgagggagagggaaccttaccaccacgcgacgaggcgcgggaacgacaacgacgaacgggcgcggcggagacagacgggcacaacggaggcgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccccgacgatcgggaacgacgagaggacgaggacgacgacgaccggggccggcgaggaggctacgagggcagccagcagcggctgcacggcggtgaggatggcgtggaacacgccgctacgatgacgatgacggaggcggcgccgcgagacgacgagccgggcgaccgacgggacgtcgacggcgagaacgatcggagacgacgatgatggcaggcagcagcggctgagaggaggaggggacagcgtggaacacgccgctgcgacgttggtgaaggtggtggtgagcggggcgacgagccgacgaggaggaaggagaggccggcgcggagacgacggcgttccggcgaagttcgggcgaggaggaggtgatgccggggatgagagcggcgtcgtggagccgaggaaggtggtggcgacgtcggccggcgctccggggacgtggcagaggcggccagaggcggagaagtggtggcgacgccactggacgccggcgagggcgcgtctccggtgatttccccgcgaaacggagggctgaccgagggagagggggcagctgcgaggccgagggagaagacggcgcggccgggcggcgctcgggcgaggagaggaaggcggctggaggtggccggcgcgagggaaaggggagggcgacggcgggaacgcgcctccggcggtcaccgcgcgaaacggagggtaggccgtgggagaggaggcggctgcgatgctggaggaggcgacggcgcggccggaagacgctccggcgaggcgggagaggcggctggaggccggccggcaacgtgggagagagggggcgacggtggggaggtggctagagaccacgggagagctcgggaagaggctaaaacggtagaacggggatgaggatcccattttataggatgggggagagagccggccacgggaggagcgggaacggcgacgggaatggcggccggcggcaaaggaaggcggccggacttggcgcgtccgttcccggcgattgggggcgccgttcaagggggaattaagggggaattgaagaggattcaatggggtttaatttcccctattcaatttggaaagaagggcattgattcgcgtggatttgagggaggaagggattagggttccacgggaagagagagagaggtggccgggcggaggaggaagaaggcgacggcggcctgacgcgtgggccccacgcggtcgggcgcgcggccgacacgcggcaacggcgcgcacgcacgcgcacgtgcgcggcacgggtgggagcgcggctcggcttgggccgggcgaagccgaggcggcccaggaggaggggagggagagaagatgggccgggaaggagaggagggaggggcggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaacacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtctttactaagataccatgcttgtcataacttgtcatcatttagcattcaacgtattcctttacacctttgcccttgatgtgttctttcccgatttctcttattaatcacctttcgacctacttctttgcctggtaataaacatctttttcgatatcttctatcagtcatcttttgaccttggtcactaagtactcttcactccgagagttgtggatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggataatcacctgattttcttttccatcctcaggctggttattag

SEQ ID NO: 64467 - DNA, 1215 bp, Oryza sativa
  unsure (1)..(1215): unsure at all n locations
cttttcccccttccctttccctctctcggccgccgctccgccgtgcctatggccgccgccagcgaccataggggcgcgggcgctgcctcctgccgaccgcgccgagtggccgccttcgggcacgccgagtggccgccgcgtggggcccggccgtcagccgcccacgtccttaggtgcggctgaagcgtggggcccacggcgccgaccggtgctagcccgggtgcgcccggtccaccgtggaccgtgaggctgccgcgtgggccccaccccccgtggacccggtccgcgcgccctctcccctcggctgacgcaataaaccccttcttaaattaaaatttaaatgaagaaatccgcaaatattcacttaaagagcatataaacttcaaatggccataacttggccatttgaactcggaattgaaccgttcaagtctctaatttttccttaagaagtcaagaacccatttttatgttttgttcctgctttttccattccgttggtcgtgtagacgctgcagcttcagaagatccgcttttcgtggaggttgaagccgacgtttgggaaagcgagcaaggcaagtcacatcatccttgagcatattgaatcccagtttataaaattattttgatttaaattattgtattatcgctttatttaaattcccgcgttatcactgttttatttagccatgcctatttacctttgttacgaccttattattattgctattgttattattaccttgttcaccctaggataaacaaaaccccaactagtgggtactctattcatggttccactagtatgaatttaggtagatgcttcgctgattaattatgcaacattaggtggttttataactttagactttgggaatactcttatcacctggacactatggaatggttggattattgtggaattggattcacacctccccctctattcaaaaccctcaaaatggttntaggctgggctcggggtgcatggttttgacagtagcacctcggccatatatggaccggtcttcgggcctctgttgcaaagcactaccgtacttccacatgtctagtaggtaaggcttagtttgtggcttagtctggttataaacaaaagtacacggatggagatggacgaagtcaggggtcgatggacatctctagggcaaatgaaggctacacgagctgcggcccggtagtcgagatgtcatggca

SEQ ID NO: 64468 - DNA, 19671 bp, Oryza sativa
cagtttaattaagttaattgtctcaagaaaataagttatggcctcggtcagaattatggtttcggccagcattaagatagatgaggattggggaagaatgagctagggttagggttctcaccctccccgtcggcgactttttcggcgtggagcgaatcagagccgtccattagatcggacggttcagaccgaccccgcgttaggccatcttcgccgatgggccgcctccgccgatgggccgcacggcctctgggccgcaaaaaaagatgctgagccgcgccgctcaagcttgcgagctcacgcgtagacgggccggcccgattttgggccggcattggaagaagttggccgaaatcaatttaattcactaagcacctatttaattaatttcaaaattacacaattcaatttggcattattttagccatttaaaattgctggaaaattatgatcaattatttggtcgttcagaaagaaattaatgatatgatattatatttgaccaacgttaatatggtttcatgtcaatattattaagattattatttctttaagccatttaatttaattctagttgaatggaaatttaactagaaagtatttatgatttcatgtcaacatcattatgatggtcatttccttaataacttaattatttatactcgaatggaaccaacgagaaatttgactagaaagtattaagatttgaagttatatttaacccacattattataattgcatgacaattataattttttattccttagttattttctaccaaatggtgatataattaaggaattaattttaagattattcataattatttatgaccaatggtgctttgactatgaaattctaagtttattttgcatatgattgattaagccatggtaaactaattatatgcaatcaccaattcttattatttaagatcacttgcaatactgagtaaattatttcaagataaatggaaccaacgggaagtttatctagaaagaaagatgatttcattaagattgttatttccttaattattttctgcccaatggtgatgtaattaagggaagaaatctaagtattgtcaatcactattttaaatattctctgtaattttggccttaatggtgatatgacttagaattttatttatgccattagtgcattaattccttttatcacttctaccttacggtgatgttatcgaggatctaatctgtcagtaagcttaattcctttaccatttctgcccaacggtgatatggctaagaattttaattttaattctatggcatcactaagggcatcattcctatatcatttctaccttacgtgatttgatttaggattttaaattattaacttcatcatttttgcccaatggtgatgtgatttaagacattaatgtttattccctaaatcatttctgcccaacggtgacttgattttgaattacaagtaatttcatttattgattccttcattttgtctctgcccaatggtgatacaaagcgaaataaagattaagttattattgtgcaagttaatgtactattgcacgtaatttgcccaagcaaccacaataatagtgccacttaatatttcagcaataaataatgttgtttatcagttaaagtctatggaattattattattattcctcattgacttaactgagcctaaggcctatttgagtatgacttagcattaaaaaaggattccttgtgtctcccgcagctaatgtcactaatttttcctaaactctagaggcatctttagcctgggagaaggccaatataatgttatgtttcgcatgtcactcataaatattaagattatcatccctgttagtgttaggggagaattttgagcatgacattgcgaaactgtatctagcaaatgttgagatgaactttagaagtttgtcaagactaatgcttagtacaaatttagtgcctatgcacatttgccgccataattggcgtgcaaacttagtgggatggacatcgcacatttcatatgcgccacttgtccatttcatatgattcttctcccattagactacggtcattttcggagttgtaatactaagacaaaatggaccataattgacttggttcatcactcttcaaatcaataagaaatattgaagactaagagacaaactaagtaagatcttgttaatcttgtcatttgatggcaaagatgaagcttcactaagggggagtgttgcaacttccaaatttaatgataataaagctcatattcctcgcaaggggaaatcaaattgcctctatgtcctatgtatgctactcttgaaattttcttgtgtaagttctttgcaaaaaatagggacatgcttaatgtcctgaattaagaaagtagttaataagaagattaatggcattattttgggttgaactattatgagacgttgtcaaaattatggccttaatattcggccacatttcaaggggagaatggacgtctcattgagatcgagacacttcacccttagaaatttctgacatctattattacttagatgataaatcaccaagtaaaattaagtgattcaagtttatgaaaaataagatattatgcttccattaaataaataatacaatctgtgggagctcatcaagagctctaataagagaagattattctaccttatttatgactcatagctccattatgtggacgctagaattttgtatctcttaatttgtgacttgcacaattaaatatatataacataactttagggttttgttatggaaagacaagtcacgcatagggtgcagacctaagaaatccatttgtggacttaatcaaacattgatgatgttttaaattctgttccgtcattagtgaactaagcttaaataagaatgaggagaataattattctataatgatgaaagcaagacgtcattgaaattgtgtcattatctcttatgtcacatacctaggggagtttggaacgtctcatgagatatagatattctttcccttagattttaatggcgttgtttagctttaagtgaaaatttcacgaagttaagatattagccaacaaatgattttttatggctatgtttacccataagcgacctccgatttcctttaagaaatttaagacactaatgctaaaatcaaatgaagttatgagatcggattatggtggtaaacactaaataaagcttgttcaccttataagacattaaaaataagcgttcatccaaatagttttcgaatcatgtaagaataaattgagatggatgaacaaaataagacattaaagtgttcatataaatggttttcgaaccatataagaataattgagattgatgaacaaaataaagaatttagtagaagtttctgaatgagtcaaaatattgggccatttaagtgggttaataaaattaagcctgactctgatggaaatttcaaacaattcaagtgaggtggacaggtgcatgaaaattaaaggtgggaatttcattcaccggtactccattctaatgacattttattgtcaagcaatgcatattgctcttagaaactaaggaatttttttccatgaattattttggtccgaaggagtactgggtttatatcagtaagtcatacactgacataaagaaataatttgagagaattcaattaaagttagtcaagctgacattaagttacaaagataatcatttatgattcagctgacagaagcttgagattagctcaaatctggatgcatacagatttggcatacttttttttactgggaatcttggcagtatttaattaaatccagactaaaccactggtattaataatgttttccattatttgcaagacaatcttaagtaacatgctcttttttcctaaagtccattgatctcagaagtttagagatatttggacacttattttatgagatgtgtggatatttatgaagattattcagattaagctatgttcacacataggggagcaataaccatgtaaaagctccaaaaataatctcttactgcatagtcgacgatgaagttagattttaaagcgtgttatgattaatcatatttcccaaaactaagagtagtgaatagcgctcataaaccactcaaaagatgttaaccacccaaaatatactgttataagttgtgcactaattaaacacagttttctattctagtagcaacatgttgtgtgttttctgcctaacacattgatatggttgtgaaagacatgtcccatgatcgaattattaagctaagcatttgctaatggatccatattctaaaggctcataaattaagattaattaagattatgttttggccagtacatatgtaaattagagccttactaagatcctggatgagggggacttaatttttcaatcaacactcactaagttaagcttgagtttatttgagtattatagtgagctataggtcttgttgtctcagtgacgcataatgttgttgaagacacattgccttgggagctattttatttaatagactcataagtaagtctcgaaatcaaggggagaatgttagctgattttgtcgacttgagtcgataaggattaggagaagaactaaaccaccggtttccttatcctaacaagaaacaaactaagagataaattcttttttttgtgtgatcggcacagaaaacagaatcctaaactaattgagataacccccgagccccaccagtgtcgcttatgtaaagaaagagaaggagggaggctaggtgacaatatgatttctctctaacctcaaaccctaaaattaatggcctgatcgtttagacactggaaggggttcatcaggttttctctgtgcttcctttccatcaacagagaagaagaaaaaacagaagaattggcaaagcttatggcttcagttcatccggtcagtaatcatctcaattccacacttagaatttgtgaccatgtgttaagctaagcaaattagatcctgagaattaaatctaacaagatgatgacacctcccacctcctggttgagttagcactcccatctaatagggtgtaggattggctgctccctggttgctaatctagcttacgcatatttcaataaagctggtggtagtgaagttagaggtgcaacgttgacgtgggaggaagggggaggggggcaacatgtggcaacaataacactaagtccaatggggttgtgttttggtattggttaggatgttgaccttgttcacttgtgcttcttagggatgctagatttgtccaatccccgggaggggggggggtgtagatggtctaatgtcaatggcattgtgtagggagtatgctttgctttgagcttattaattagtcatgtggctgttgctcagagtatttaggttgtttttttccctgttgttgtttcggttttcactaattaaattagcattgtttagttcggcctcattctatctttaaaactagtatatgcccgtgctaacgctacgatctttaatattttttaataaatgactaaaattttgtgttagtaaaaataatcagtttaatgggagctttaattcaaattatgccatatatttaaggcaaattacaaagtaggtacttcacattgttcgtctgaaataccaccaaaatacacactatttctctccaatagcaatttactttggtaggtgttccctgcacctgtaagtcatataataacttgtcaccatgagctgaatcagaggaacgtaaaatatcccttatcctaaagttggcatcaatatagaatataatgctatacctcactttatacatggcaatgtctccaatcatggccagctgcaataaaattagatattaaaccctagccaatgcatattagccattcttcctaaaaaatatatggcaaggtgtcctaccatggcctcttcatttctctacaacagacatttttctaggtataaaataaagcaccttctaacattattggtaccattctgaaaacaatggaactaatgaaaaatcatgctccaattgagaaattaaggcagaaacttgatctttaatcatctcatcacagcacacggaggaaagtacttcacgaaaaaaaaagagaaactttcgcctccgcttctgcctcagacccttaggctgtgttcctagcccaggtttcccaactcatcttcctcactttccacacgtacgcttttcaaacggctaaacggtgtgtttttttgtaaaaagtttctatatgaaagttgtttaaaaaatcatattaatacatttttgaaaaaaaaattagctaatacttaattaatcacttgttaatggaccgttttatttttcgtgcacactgttccagttgggaacaggctccagcgaacagacgaacatagccttagtcttgcggcgatcaatctcgtggacccgatgccatgccccattgttggcggttgttaaatgacaatcccataccgccaacatcttcataaagtctagataataaaacatccaacatagtaataggtgcttaatcttacatattccacaagtgttggtgtatatttgtatgcagatgataaaccctgaagttgggaggaaaatcagactaaagtgaggagaattatgtatccatacaagtagggttgtgaacttcatcgaaacatcagtaaatcaaccgaaaactccgagaaatgaatagaggaaggtcccgagagtccaccgaccgaaggccaggccaggagggcccagcccaggtttgaccgaaccctctggttcggccgaaccccccgatcaccgttcatcctggggtttggcgtggatgctccagatgttctcccaatgacggttgcggtgcagttcggacatttccccttctcacaaccgtcataactgccctataaaaggacctcacttcattcactctcacacacacttccaagcttgagctgaattataagaggctctattgtactatattgtacactagaataggaagagagtagagtagaagaagtcggaagaattccggagttgtcggtaatcttctcctatttcttttattctatttattactctgaattcaatataatattcttcttgaataatttagatttatcttgtgagaattatctcttggttagttcctaaatagcatacgggattattgttcactataatcaactaaaatatagtgattgctttgatgagttataaacactaaagtagatattaattgcttagacgtggtatttaagtaattgttatccagtaattgctgcgtatcccacggtacgtttgaggtaggtgtagaggtggtgacagcccttgagatcacttaagtcctccctttccgggtacgtactagagcgacatctgggaacagcgggttgccagtgcctgaagtattgcattaggattaaagttaagctttccctagatactgtctctcactagtaaatcctctctatcctggcctatcatttactttgtgtccttggatgaaccggaggaagatctgaccatacacgttcatttggattcgatacccttggaatactccgtaggggaagtgctacctcggtatatccgtgcggttgcagattttatctgtaaccgtattaaataccaacaagcattcctagtgccgttgccggggaacggttgctgatcatttccgaacccagttcatccttgtatcctttttacttttttagtctaccttcacccctgctatcctagagaagtattcctgtcaaactcttctcgaccatggagcaacctcgttttgagatgtctgctcctcggggcgaattctatgagccacctccttcatcgaagcccatttatacaactggctatgaaattcgtcctgaactaattagtacggttagggaaaatcctttttctggctttgatctagaaaatccctaccatcatctgcgagactttgaacaagtttgatcatgccttaagattcgtggcatgagacaagaaactgtgcggtggaaattgttcccgttctctcttcaagagagagcaaagcaatggtacacctctaccgttggatgtgtaaacggtagctaggaaaagttgtgagacagattctgtcttgccttctttccagttactcgtattactgcctttcgagtagaaattcttagtttcaagcagatcaaaaatgaatcaatcggtgcaacttggtccagattcactaatttagtacaatccggaccaaccctgtccttacccgagtatgtgcttctgcaatatttccatacgggtttggataaggaatctgcattctatctggacataaccgttggagggtcgttcatgcacaaaacgccgtcagaaggaagaacaattttggatcgcatcctagaaaatacttccttcatgacgcagcccaatgaaccccagccgaaggcatccctgtccaagatagtggaacctctaacgatcgagccactcactgaaccatccacttctgctagctcgattgatgaaaaggttcctgagcagccgtttgtcgagaatgaagaaattcaggttccggattgtgccacaattatgttcagggacggttttgacaaagactacggcaataccctgaactattttagcaaaaggaaaccacccgttcctttgtcacctcccaatcctatggaactcgggttcctacgagaaactgtccgggagttaacatccataatgagcgatgaatggctaagggaggtagagctttcatccgaagtaattcggataaatgcgctccccgaatcattccttgccatctggaagggaacgatgtcggtattctctatagtccaactgtcggggccaacctcgtctctgagtcttttgcattcgcttatttaagcgataaggcagtgaccccgataaacaaattcttcaaacatccgaacggaaatatcatttaaggatttgagattgtacaagatgtacttgtctactttgaagaaagggaggcaatcttggatttccacgtctttgaaatccaagattttgacatcctaatcaggctacccattgagcaacttcttatcaacacacctcatttaggtagcctcaaaataacactgggagagaatgaattctcaattccattttcacgggcaaggatcaccttgaccgaccctctcccagaaattgagttagtggaagaggttaccgcagttcctcctcatgagtctcccgaggcccttctggaagatgaggtccccgatttcatcaaggaagaagcagatcccggtgagactctcgacctgccaatcatggaaccgccacctcaacctccgcttgagcttaaacctctacctctaggcctacgatatgctttcctacacaatgacagagaggcccctgttataataagtgacaagctctctaaagacgagactcaacgtcttcctaccgtattggaaaagcatcgttctgtacttggctactcacttcaagatcttagggggattaatctcgcgctttgcacccatcgtattcctattgaccccaagagtactccctccagggaacctcaacgacggctcaataatgaaatcaagaggttgtaaagaaagaggtcttgaaactcctgcatgccgggatcaatttatcccgtaccatatagtgagtgggttagcctagtccagttgtgccgaagaagggaggaatgacagtcgttgcaaatgctcaaaacgaacttattccgcaacgaaccgtaaccggatggaggatgtgcatcgattacagaaaacttaacaaggctacaaaaaaggatcatttcccgctacccttcattgatgaaatgttggaacagctggcaaatcattcgtttttctgtttccttgatgggtattacgggtatcattaaattcctatccatctggaggaccagagtaagactacgttcacatgtccgtatggcacctatgcataccgtaggatgtccttcggactgtgtaatgctcctacatctttccaaagatgtatgatgtctattttctcagacatgatcgaagacatcatggaagtcttcatggatgacttctcggtctatggaaagactttcggtcattgtctgcagaatttagacaaattcttacaacgatgccaagaaaagtacctggtgcttaattgggaaaagtgacacttcatggtctgtaaagggatagttcttgggcatcgagtgtccgaacgaggaatcgaagttgatcgtactaaaatcgatgttatagatcagcttcctcctcctgtgaacatcaaaggaatctgcagtttcttaggacatgccggcttttatagaaggttcatcaaggacttttctacaatagccaggccgctgactaatttgctagccaaggatgcgccctttgagttcaatgacgcgtgcctaagatcttttaaaattctcaaaaaggcactagtctctgctccaatcattcaacctcctgattggactctgcccttcgaaattatgtgtgatgcaagtgactttgctgttggtgcggtcttaggccaaaccaaggataaaaagcatcatgcaatctgttacgctagcaaaactctaaccggagctcagttgaattatgcaactactgaaaaagagctgctcacggttgtttttgctatcgataagtttagatcttacttagtgggagccaaggtgataatttatactgatcatgccgctttgaaatacctgctcactaagaaagatgctaaaccacgcctcttaagatggattttgttgctccaagaatttgacatagaaattaaagataaaaagggagtagaaaattatgtagcagatcatttgtccagattgcacatcactaacatgcaggaacaaccgataaatgatctcttgagagatgacatgctgatgacggttcgcgactccaacacgtgatatgctaacatagtaaactacatggtatccaagtgcataccaccaggggaaaatcaacgaaaactgaagtatgaaagtcaccgtcatatatgggatgagccctacctatatcgggtatgctccgatggcttactacgaagatgtgtgccaactgatgaaggacttaagattatagaacgatgccacgcctcaccctatggaggccattacggtgcattccgcacccaggccaaaatctggcaaagtggtttcttctggccgacaatgtacgaagactcaaaagaattcatcagaagatgcacaagctgccagaggcaaggaggaatcactgctcgcgatgcaatgccccttacatacaatttgcaagttgagatattcgatgtttggggtatagacttcatgggacctttccctaagtctcgtaactgcgagtacattctggtggcagtcgactatgtctccaagtgggttgaggctatgccgtgcagcgccgcggatgcgaggcacgccaagaagatgttcacagaaaccatcttcccaagatttggtacccgcagaatggtcataagcgaccgaggttttcacttcattgacaaaaccttcagagacctcctacgagaaatggaagccaaacacaacgtggccactccttaccatccacagaccagtggtcaagcagaaacatcgaacaaacaaatcaagaatattctgcaaaagacggtcaacaaaatgggaacagaatggaaggatagattgcaggacgcactgtgggcataccggacagcatacaagacacccattggaatgtccccatatcagatagtctatgggaagtcatgtcgactacccgtagaacttgagcatagagcatattgggccatcaggaattcgaacatggattttgagggagcaggagaatggagaaaaatgcagattgcagaacttgaggaaatggaaaaaatggcttaccccaacgcaaagaatataaagaaaggactaagcgctggcatgacatgtcataggctctccagaccttgcattatatttgagagatgaagggaataattcaagtcatcaaacaagccttatgaaacattccacgcctcgagagaggaatattggagacattgctgggcccttagcctgccagtcaacttcagcctgagatgtgcccgtcaaaccactcgaaggcggcgatcagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaaacacaagcacaccgactaggggtataccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaggagttgatgcttcaattaacaaagacaagttttaagtttcattattagcttcttcataattccgtcataaacaatctcttattgccatacttaataataagtcataatgtatcaccacatacacaactcaacacatttatcaatttcaaaccaatgtcacatgattacatttttaaaacatagtctatactcatgacacatcaccaaagcactcatgaccgtgagcacggctaatcaattagtttaaagaactctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatactcatcatattcattttattccagcaaaggttcaagtatcaaaccacattttaattatagatggaatgagcatttgcatatttctaagcatggctaagcaagtagttgcacatagagcatatataaacccatttgagcacaaagagtgtactctaaccatttctaggggttcaaacagcaagaggatcaattattcaaggtggaatatgtagcaaataggtcataactaccttaacccaatttcaaataccgatatagtctaagttcacatgcaactttgtaaacaaatattttcattcctcaaatcatgggattcaatgtgttcaaaggatgggaggagaaaactttccttgatcagagaattgttagcacctaatccacttcttcaccgattacgcaattatctagataaaggacacgatatgcaattaaacaccgaaagagttgaaaatccaaaatgctctaaaatgcatgatttatgcacagtgggttggtactgatctaaaataaatttaggtgaaagaatttttattttatctttatcttattccattagggagttatgaatttttagaagttttatcggtttatagtagtatagtcttaggtagtgttatggaatacttttgtaaagtgatttttactagattagacttcacaggggtgtggagatgtgttttctaagactaacacatttggtttcacaatttttggatttataatgaattctttatgcattttacaagttacaacgtgttttaggcatatagtgttttatatatgtatgactcctgagttataggttcagaacatgctacttcatgtttaagttgaataaaaggaataatttggttaactaaaacatttttatctcacatgtttatggtctttactactatggttcatattttataaagtagagacgctttaatctaaactagcaatatattatattaacctagaaattgttatatgagccaagttcttctaagtttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagttttacaaattaatggctgctctatgttagtaaatccttatatgaatatttagagacttttactacacagcaagtatataatattatttcataacttggaaatacatgtgttagtgatcctacataacttaagtttattcaaattgaagctaaattgggttctacatgaatttctaaagtttagcttatctaaaactagtcattttaaagataatagttttagaggcttttgatgcaaagtaagtcattacttttattttacctaatcagagagtgtctgatgatgaatctgaagtttttgagtttgtttcaaaatgagttgaaatgaattttctttgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaacttgtgcatttttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagtgtgtttctataattgtaaacggatccctgcacttaatctaattcacggaagtcatccctctgctctagacatagcagagctagccatggctgagctcgatctggagctcgccggcggcaaacggtggctcgcttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgcgcatggaagtcgattacgaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggcagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaggtgggtccaggtcgtggcaaactaggctagggtgagagggttgggtaagattctgggtaaacttgatttttagattaattttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaagaaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattaactataggtttgtttagtgaaataattcttttagattatgctcatgggagctattatggaatacaagtccaaaactccaaatgcacaaagaactcgagggttaagtttgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgtgacaaaatggtatcagagccgactctcgcggtttcacgggcgcgtgtatcgcagttgcgcaggcatggtgcgcatggctggtgtagacctggagtggttacacagcatggcacatgcgctgtcattggacacatgggcgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagtgtgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgttacataacaaaaggataaaaatcaagaaattcaagccaggagacaaagtactgatgttcaactccagggttaaactcttcggccacggaaaactgcgcagcaaatgggaaggaccattcgacgtcatcgacacctcttcgcacggggcaatcacactccgcgatgacttcggtaacatatttaaggtaaacggtcaacgcttaaagactttccttgagccaaatgaaactttagatgaagaagtggatgttgttaaattagttgattatgaaccatgatgatctcatctattgcatgcttaaaacccggtaagttgtcatttttgtgcttagtttaggacttattaggcctaggaaaaaaatggagctcaatcggacccaccaaggtgctggttcggccgagccagggaggcgcccgatcagccccatttttgaacttcgctctcccccgctcgttcctagtttgtttagatgcgcatttggaggtagaacgctcggatctcgctagaacacttcttcttcctctttctctccacctttgcatactctcctctccaatccaacccaattcctcgaattcccactcatacccaccaatggctggcaaatccttgattacattcatcggctcttcatccaattccacgtacgacctcaccggagaggcgacaccggcaaatcaattgatcccggtggaagaatacacgatggaaggggtaaacgctgtatgggctcaaccccttgcagctgtgccaggctcccctgcaattttggagccgatcgacgagctccctggttcggccgaacccttctcagccccgttcggcagcgtgatccctctcccctcgccatgtcacaaggacaaaaatctggggggattcacctacgcgacggccgacaacgggagaactcggcttgttgaaggcacgacggcttttccaagatgacgggaaggccgcgccacctctcgccgagcgctatgtgggcaccctgttcaccaaggaaggagatgagatgctccacaagtataccacacccaccgctactccgtctactccgaaggaggagcgattccgcatccaaggagtgagaactcccggcagtgggtatggtaagagtttactacggcctttgatggcatcggaaaaggagggggcagcagaatcccgtagccctccacctatgaaggtgaagcgtcatttgaagccccctccaattgtgagggctcccagccaattccaagaagaggaggtgaaatcgccggagccctcgatccataagctcgccgcacaagtgaagaaactccgcaaggagaacatagagcttaaggatcgcaacgcggagctaggggtagagcttgctgacattagaaataatttcgatacccttagtcgcggtttgtgcgctaaaatcaagcgtgcattcatagagataggaaaggaaaataagtattatgctaactagatgcttcctttcccatgagtaaaatagtagtaggtgcttggtttttatttttccaatcatataagcacttgctatgaataatgtggctcattggtgttaaccccaatgtttgccaaagtttgtttt

SEQ ID NO: 64469 - DNA, 4721 bp, Oryza sativa
catttcctaatataatgaatctggacaggctcatgtctagattcattgtactagaaaatgttacatccgtgtctaggttcgttttttcggaacggatggagtaggtgtaaaggaaaaaaaagacacacatgttgaagatgagacgaatttcacaaaattatctacatgtaagaagtgttttgtaaagaaaaaagatacttgagtaagatcttaaaaataagctaggatggtcataaaaaggacaataatattgttaatattaagggagaaaatattataggaaacgcgataggaggctgtcgaggttggttatgcaccgtataagaccatccaagtgctcttaaaatgccaaagttgctttatatatattatatatttgcactttatgaaccttaggttgcgaaggacgaatataatatctacatttcaatttccgttttgtccttctctgtggaggagccatgcatatggtcatctcagcatcagataatggcgaggactgaatgagacggagggcgacagctaggactaagggatgataaactccacataccatacctttcagatgacacatggccatagctcgatcttgtactattcactctatgattgtgacaagcatttcaagagaacctgaacttgcggcccagcccagaaagatcgccccaaccaaacacagcacactggcactgaacatcagcaagagaccattttccagctgctgttttttaataatggaatggtttacatctccgatccaataagttctattgttgaatatatatatatatatatatatatatatatatatatatatatatatatatatatatatatatatatatatatacagcttttgatggaatgatatttgacatggcaccagaagagaatggtgcaaggttcagacatcaagattatctccactcctgaaagaacatcaagattttctgtgatacattagcagatgaactttacatctttataaaattctgtccaattaggctttgaacaatgtactatattcaaagcaacctgtactgcccatgtgtgtgttttttcagtggctaccctgcagactcagcaagagaccatttttcagctgctgatagactgatacttgacacggcaccaaagagatagatgcaaggttcagacgtcatgatcatcttcgctccaaaaaagaacatcaagattatctgtgatatattagcagatgaactttacatctttacaacattcacaattaggaattgcacaatgtactatattcagagcagcctgtgcccatgtgtgtgtgtttttgagtggctacgctgaagactccccctccccctcaccctcaccctcctcttccttccagacagggaggatcccttggccagccagcctcttgtaaacccagaacaccacatacttggcgtttgctctcttctcgtcgatcaggaacggctcgatggtgctcacttctgtgctatacgatgacagcgcgaagcccttcggtcctgcgttaatcgtcgagatgaatgatactggtgtaaacatttcaagctattcaataagctatgcgcccatatctttgatgatgatgcagtgttgcaacttgcaaaatatgcttctgcaatcctacttaagtactctgtactctgcataactggtcttttacacctagatgcactatattgtagtcttcagaatgcggatttatacctaaataatacgctacatagcagccttcagaacacggaatatcaagtgatagtagtttacagttaaaaattcaaaaggtatgaaatatataggttatgtgaatgcattgaggtattgtcctgcttatgcctcccaacggtattctcagcaagaaagcagcaatttttgtatgaagaaatgagaaaggtgcaggaggtagcttgtacctgtgaggtctccatttggaaagaaggcccagaagtaataaggcacttcatcctttatgaaggaaccctccaactgcattcatcaaagcaagggttaataatgtcgatatatatgtaataacgcagcatagcagaaatgttggtatgaattatcaattatctagaaaaagcagaaatatttggtcattatcattccttgtaggctgtagccttattgtacaaaactatcacagcctaagcaaatgtttttaatttccttcagaaattcctacatcatcagcaatgctattgttcagaactaggctgaatcaaatttaaaaaaagcaatgagaaacctattccatgtaattaaatttgacttgtttaacattcatcgaacaattagctatgctatgctgaattgctttataccatctgtaactctgtaacttataccaagttgctaatttacacgtttcagtactaatcagtaatcacaaaatcaacaagcttcagacaacagtacttatgaaacagttagggatgctaatatgcagtgtgatcacttccctattatcatctccggcactagtcggcacactcaccctattatcttcgaaggagagctccacttgggacacgtcgtcctcagcctccagagctgccttcagcggggggatgatctcctcctgcatcatctccggcagcggcttcaccggaggcttcttcggcttcgcggccggcttcgctgcgggcttcgcctccgcggtggcttccttcttggcatcggccgcatccttcttctcactgactgcacaccacaccacaaatccatagtaaccaaaagatcaacaaaataagtgcaacttttcaatggcaaaacgcaaaacattggcatggtgctactatggcaaacatttgactgatctaatcaacactgatgcgtttctttcctaatcttataaaggatttacagtagctaagcaattgggggcggaccagtcgtggcggcggcggcggacgacgactcctgcacggcggagcaggaggcgccggaaccggagccggagccggagccgcgagggaaggcgacgaggagcggcagccgctgccgcccgaagacgagcgggatggcggcggagcacttgcacgccgccgcgtgccggccggcgagcgggctcggcctcacgaggcgtagtggctgggacgccatgggaaaatcgggcggcgacgccgatgaggtgaccgtctaaagctttcgttcttggcaggcagtggctcgccgtggccgtggtggtggttgccttccactgattcagttggatggcattggtttcccgccacaactcgctctatctgctcggaaactggagctcagtggcgaggcgcgagcagcacgattgcctgagagccagccattcgtttcattatctctttgccgtccgatcacaaccaacggttcggattagtcgctacagctggagaaacaatagaaagagaacttttttgggatttgctaaaaatatgtggccagtttttttgttaatgaactaatgattcacttaggggaaaaatactaatttatttgttccaaatcgacttggaaagaaaatactccatccgtttcaaatataagactttttgactctctctaaatttaactaattctgtagaaaaatattactatttttttcctagatagttagtcaaacttagattagtttgactttgaccaaagtaaaaaagtcttataagctaaaacagagggagtcataactttgttctagaatataataagttttataactataaatctaaacaaatgcatgttaagattataataaaaatactatattttgagatgggttgagatgggatagtatttagattttccaaaacatctaatttacaaacaaactccgtatctcacaacaaaccctatttttactgccgaaaatacttcccagtttgtgctttgtacttgacttggtgaaaattgaagcggtttgcgggggaggggcggagatgcaacggccccgtcggacacggcggaggcgccgcgtagccgaacaccaccccgcccgcccgcgcgtcgtttcccatccatccccttccacccatgaaactgacaagtgggcccaggtggaccccacctctccacccacaccacccccatggccccaccaaccacgtccaccctctgggcccggtccacgctgtacgcgcgagcaacacggcacgacgacccggcaccgtctcctctacactaggcggatgatctcccacgtcactgctctcacacccgccgtccgatctccgctctccacgatccgcgccgtccatacagggcatcacgggcatagcgtgcctgcgcggggccagaggccagagctatctgtagacacggaccacatggtcagacgagcgtagccaccccaaccggggccccacctcccagtcgccgtacgtgacatggacccggtgcacgtgattcaccgctcgaagcagagctatcgtatcactgacttgtggggcccgacgatcaccgtggtgggacccacacccaaagtatgcgtcgtctctaggcgcgtcgcccattctttaattcggatcccgcggcagagagacgtgtcaaagttggggagccagctgggggtgtgcgcctaattcaagccggtgggcccccaccaacgacgaggagggggagggcaataccgtcatttcaagagggagaagcatccaaggaagaaaagaaggcatccatccaaatccggccgaatctcctctcctccccttcgcctcgagccgctcaccgacaacgcgcac

SEQ ID NO: 64470 - DNA, 15216 bp, Oryza sativa
tttaaaactatttctcgagctccgaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcaagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcacggattcatcaaaatagagtaatgacggcgcactttcatcacagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattctcgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctgaagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggtcgcaggcaccgaagaccgcattcgtcgaggccacagcccgccgccggcaccacagagctgaccacgagccgctgatcggtgcaccgccagccgggaccagctacggtgcacaagctgtcgaggccaaagccttcaccgccggccgtaggggggtgggtgggtgggggaaactaggcccgccgccggacgccatcgtaacctccgccaccgtggcctccgccgctagccttcgccaccgctacctctgctgccagtcaccaccgcgtcttccgtgcgcgccgacctcctgcgccggctgccgccagccgccgagtcgccatacgccgccacctccgcctcacatagtcaccgcacgggagcggctcgctctagccagatccggcgtggaggcgtcggatccacccacgaggaagccagatccggccgcggctgcgtcggatgcgctgcctccaccccacgtcatcggactctccttcgcgcgccggcccgccttccacgcacagagacggggcgccatcgagtcttggcctcgccgccgccatcccggctggccgcacggaactctggtagcacactctggtggcggcgaggggagagagaggaggagaaagtggcggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtccctccaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctccttcttctcccctcccccttccacagtggcttggtgctgcgatggttgcggcgacggctcgttgttgcgggacatggcgagctcccccctcccctcccctcccctccccttcctctccctctccctctcccagatctagccggaggggagggggtggcggcgaccacggcggtaacggaaggcaggcggtggtggatctgacaacggggtcggcggcatgagagcaaccgcgacgacgacgaccgtgaccgcggcgacgacgacgacgatgctgcgcgccggccgggagcacggctctagcggcttcttccctcccctccttctccctttcccaaaggagaggtggaagcggtggccgtagcggcgacgacaggtgggcggcggcggcggatctgaccgcggcggccataattattagaaccggaccggaccggcggtccggccaggaaaaaccggaaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccatttattaaaaaaaaaaccccccacttttttttttgtggggggggggtttccccccccccacataagaaaatttaaaagaaaattccattagcctcaaatgtacaaaaagttactttggctttatcacagagtatgacaatatc

SEQ ID NO: 64471 - DNA, 18720 bp, Oryza sativa
  unsure (1)..(18720): unsure at all n locations
acttctgctgttttatcccaaaataattgcctagcgattcatgaagttggcacaagtattataaatataaagaaagtaggcaaaataaaatggaggcaattatttattaattaagaaaaaatatgtggagaaattaaatgcgagatggttgtaattagttgtatgtagagtaagtgaagatatattaataggatttattttgtatgccaaaggttattatgttttttgagaagggtagaactaattatggataggttgctctattttccaaggcttatggagattcctgtgagctaacagttaaataaggagtaaagccattaccctttttttttctcaaagtactattttggaatggtaatgtgttgccaaatgataactcatagatactactcgctagctctatcctaaaatataaaatataaatacttctagaatttctggattttttacagcaattaagaatagacgtgaagttatatgagtgatggatatgattggttgaaacaaataagtagtggagaaattagataatagatagttgctattggttgagataagtgagtagttggagaaattagatgatagatggttgtgattggttcagataaaaaaataggcggaagataactatagttttgaataacgctaaagatagctatattttaagacaaagcgaataggatgttccttttgtttggacaacacttgaaacttgatgttgcaacattgagttcttgagttggaacaactgcttttttttagttggaacaacagtcacgcggctctaaacgtgttgggtgctttctttattttaagagtatagatgggagattcatacacttatacagtgacatatacatgcacaacttacaaatgcttggagctttttggagaaacagggtctcccaagcatgtttagggcatgtttgatcgttggctggcattgtcactattcaacctgtcacgagtgtagtacggcacacaaagtgtgttaaacaattcattggccacaagtatggtaatgtttagctagagaataagagtatggcatgcatgtggacagtagacctatggagcaacaaaatgtgacttgtcatagttgaaacaagtaaccaaacaataaacaataaattatggcgtgcctaacatgtggtgtaataatgtgcatggcattcaatcaaacaaccccttactacttgaacaaaacaacacaaaaggtcatcaagcaatggcttagcacctagggcaaagggggcatagaagagcggcgctagtttagctcaacgtagtttgggaatgagaaggagttgtggaggtttaagagaaaaaacacatctcctaaggagaggagggggcgaagaggccaagggctaaaaggggatcatggttcacgagttgagatgcacactgttgacccttccatgttagtcgcaacaacagccactacagagagtagaatgaaggagatatacgatggcacggatggttgctgatcaaaaggcctaggaaatacatgaacaaccatggacggagctaggatttaagcatggagtattagggtgataggccaaagccaatatcaataacaattaatacatgtataatgatatatcgtctccacggtcagataaaaaaccaatatatgttttagttgttttactcttcatcttagttgagcaattttaatacatggttggaattgaaacacaagataggaaatcacaaaattgagtacttattgcagttaggcaagaaaccaacatgtgttttaatctcttcactttcatcctgttgagtaattttaatactactaaaattgtaaaaaatatatatatagaaaatcacaaaaccgaatctcatcgacggactctagtctccacatagggactaaaaaaagagtagaacttacaacacaaggatttagtaagattttatgatatgagggagaacacacctgtgggcagcggcttggtggatgaagggtgccgacatggtcggactcaaagactcggcgatgaccgacaacaaggcgtgatcgccggttggcgtcagagcaaaaggaggaggggcatgtcgccggcgcactccgcgtagccatgtgcgaagcgaaagagatgaggcttcagaagaagcttaggagttgaaattaatgtgtgtcgaggatgggtgggtgggtgtgtgtgggggggaggggggagganganggcccgtncnnaattagatggggatgtgcggtgtgaacaacgtaactataccaaaacacgtggacgagctaagcgcaaggccatacaatatatgtctacgaatattgattttatatattggatttgaggcttgttaataaagttgccccttcactattttgcaataagccagcttccttcactgtntattatatatttctacaacacaaatataattgcaatataatacgcatttttttacaagtagtaaaccttagcatttccgaggatataaatagttatacctttgcatttttttttccatttgcctcttccatcattttcatgtaccattccatgtgtagctagaagaattatagtttctctctctgaagaggagaggaaacctcagaataaatttttttttttggctggcatcatgcaggtgataaaacggtcatgaattttggttttattatgagagctaccaacaacctcattgtcctcggctgccacgtgtaacggtgccgaggatgactccttcccaattgttttgtttggctgacatgtagggcccatctcatagctaaagttcctttctagacaggactctccagtggaggtctattctattctaccactctaccagacgcctttgtatagtagctcctgcagtcagtgacgtagaattggccgatcactctataattttaacaaaaaagatgtgaaggaaaccatcgttgatgcagcaactctaatactagcgcgggatcctctaaaataataaaagttttatcgttttggaccactttttagtaaaatggatccaaatactagtaacaaaaagtaggtaagttggtatttgtcatttgggagtccatagcagcaaatttggctaaaaagcaccggccccgtgcatgagagaggcagcagcaattaatagcaaaactttaccatacatctaaacactaacttataaaattgcaatgccaaatcttttgccaccaaaacttttgctaaaaaaatttgctgtagcaaattgatctaaacatgctcttatttcgtaaacggtatttctatctaaacacacgtaattgaataatgattaatgaatactccagtatttacggccttgagcaaagttttgatactacatttttttaagataaaattatctagttcatatttagcttgctactaatatgaagtaaattagtcaaatcttaatagatggcgaagaaacatggagcatgtgcactaccgattatttggcttcaatttaaaccatcataattaataaattacgtttatctataaaaaacatccatatgttttttttcaatgaaaaaccaaagaattgaacccaaaagattaaaaggatggtgttatgatggtgatgctattattctattctagtagataaaaaaagagagaaatatctcaacatcatggttagcaagtatgaagtaacaaccgagcaagtagagccatccaaaattaatagtttgatatataatttgatactgaatatagctagagccctctgttttttgtttttgttaatggaagaagccttgtttttatctgaacaatggcacaagtaaaagtaatgttctggtccttgattttgttatacaaccatcctgtttgattagcaagtgccagccaacggttctatgatgccagcatgaaagcacaaaaggaagaattttcttttgctttctttttttttccccatgatcagaaggtggcaaaagcttgcttccttaatcaatcttagtatctttaggaaacctctatttttccgggatggtttgtccttagttatgttgtacattatacttggttcatgacatcacctgtaaacatatctatcacgctgcatcttgccagatacgtcatcgaagaaaatgatctacataatttattatcatttgagttagagttctatttagcaactacctttccactgagcattgattcgatgctaaagtactaggtcattaaagggtagtgttaatgattaaaaataaagaaaaataatgcaagcacgcccgaccaacaaatccagatgtgtgccatgatatttttctttacgagttaaatgtgcatgtgcaatactacttttttttttcaaataacgcatgtagggtttgttttgattgcatctaattttcgcggtttgtttgattgcatccaatttgtgcgctttgtttggactaaagtcaatttcagccctaaaattttttacaactttaataatattgaatggatgcttggtttactgctaattttttccacattagtaaaagttctattctaacaattttaggcgttgttcagcagtggtttttgcagcagcagtagctgcggcacgtgtttgcggctgcgacgcataactatggctagtagctatagctgcagccgcaaccgaacaagattttagtggtgccataacttgataaggttttagtactactaatattttttaccaaacataatacaaaggtagaagctcatataaagacatgcaagctcatccgtgttgcaaatatttaaaaaaatggcttcaaaccaaaattataaagaagctcctcatgaaaaatgtgttttcttacatatttgtatccctttggatataagttctttatataaaagtaggaaactaaaatgcaaacagaaagatgtagtaggaaatataaaagtatgctacttgcaccgtacaactctatttttaaaccactaaaaagttccattgtctttaaatagagttgttgccgttgtttctaaatagttgtcagcatagttgtgcatgtgtgttattcattctcaatacacgttgactttttaatagggacaagtgtacttatagattgaaactttataatactttaatataatttgtcatgaattatacgctaatcatgatttgttataacatataaaaatggaaactaacagtcaaaattaacattttgacacaagacaatcacttcctaagaatcaacaatgaaattacaatatgaacttggacatcgaaatacaattgaagttaatttactttgtaaagagacaatgttagcctctcaataaaaaccgatcgaaaaccacgaaatctcgatatttcgatgtgtgacaaaaacatattccaactaaaatctttttaaatgattttcagccattaaaatttaataaaaatagtaaaaatcgattaaaacttaggagaaaaaaaactatcacaccgcttgaatccagattcggctctgatatgcatggccctgttcttttctccaacaaaagttagattaacttttggatactcgtggcacgcttttcaaaccgttaaacggtgtgtttcgtgcgaaaactttctatatgaaagttgttataaaatatcaaattaatctattttttaagtttataataattaaaactcaattaatcatatgttattacagcctcattttgcatgaaacacttaattttcatcttcatcttcagaagattcaaacaccaataataatagtttttccttattgtacaagctgaccacgaactccaactcgaaccggacagtttttcctttttaaaaaaaagctcgaacctgaccacatcttggaccaaactcaaacccgaccccggccccgacgagtcggaactcgaagcatctcgcctcgccgccgccgccgccgcacgcccgacggaagcgagcgcctctctctctctctctcaccggcgacgggatcgacggcggcgggggcggggatggtgggctggctgaaggcgctgtgctacggcgcggggggcatggcggtggtggggctcgcggcgctcgtggcgctgcaggagcgcctcgtctacgtgcccgtgctcccggggatcgcgcgggcgtaccccatcacccccgaccgcctccgcctcatctacgaggacgtctggctccgcgccgccgacggcgtccgcctccactcctggttcatccgccactcccccacctgccgaggcaagcacctccacatacctcctctcgacctctcctagattttgtgcagttcgtggtttgctccctggtgtgttagtacttaggttagcctttgtttttgggtctcggttggtggatctctgtctgcgaggcttggttgggaaggcccgcgttttgatccgattcgcgtgcgtggcttcatctcttagcttcctcgatcgcgattggattggcggatctcggtaggaaattaggaattggggtttcactagaaaaaaaggggggcttaatggtgatgaaatttgtagcgggatgatttagttatctcccatgctcgcgaagattcttttgtcaatttctagggtttctgtgtaatttggttacataggtctgtcttgtctggagtatgaactgattgactgatgttatgatgtagtttagtgggaattgagttaacaagttccctttttttgggggtgattttgtagttgatactctttgttgtatgcgatgcgatgtgttggtgcttagtattaggatttctctattgttctatcgtttatatgctctgtagtgcaagccccataaatgttcaatgtacgataggtttaaacttttatattgtgatgaagaattgatcgtgcttcgttgcttccttcccattcacttgttctacagtcattagccaatcacattgcaccatatggtttagtttatgaacttagttttggaagacatgcagtttagaaagtactatactgctttccgacgatagataacagcatgcgtggctaccaaaatagttcatgtgagcagagttgattgaagcaggcgggggttggaaattatactggcggtaatttgtcgatgagaaaaatgtggaaaatgctacatatacatccaaaatacacatcagcatccttggctcttggtcccaagaaacgtgccacacaactgaagctatcttctgattagctgacctcagttgttgactccttaggcccacaccacaaccaaaacagctagctttaaaattaatgtttacacatatgcatgctataattattcaaggcatcaatgctagttgttagtgtcattgctataatctagctagtgatatactagattatactgctaaatgtataccatgaaccagctattgttgtctatgcataagttcgcgttcttctattttgttggttgaacgcatcatgtgctggtgttttgagttgtcatgctaggttagaagagatttgattatgttctttgtttctaattagatttcataatgcttaattgtatgagattgcaataattttaacctttaggagagcatttgaataattgttttgatttttatcctcttgcgcaactgtcctcccgatccagcattcctatgatgacatgaaccttatactgtgtataactgtatattcttacacattattctgctcattcttcagtactccacaaattttacatcatctttttatggcttgcttatgtgttttccttatgcaggtccaactattctgttcttccaagaaaatgctggcagtatcctgaaattttctatatagacactgaaagttataccacattttacaggcttatagacgatggggttatattcttttgaattcctttactcttaatagatattgcacatcgtttggactttgttcgactaatgatgcaacgactacagtgcaatgtatttatgctttcttacagagggtatggttctcaacagtataaactagttctgttatctttgttgcaccctttttgctcaaagctctccatatgttgtgggtccaaacatgcttcttcctccattcactagtgcatctaaaccttgaattatatttgtaggtatggtgagagtgatggttatccttctcagaagggcatcataaatgatgcacaggtttgctgattcgttcaatcggttttatgttaagttttctgtttctgtctattctcttactgctctctttttaataggctgcacttgatcatctagttcagaggaaggatattgacacatccaggatagttgtttttgggagatcgttaggaggtgctgttggagcagtgcttgcgaaaaacaatcctggcaaggtactcatgataggaaatcttgtgtactctcatgtttctgcataaaagttagggaggcccctctgttctctctgctattggatggatgacgctagtatcctccattgcacctatatttcatgcctaagtaatgtgggtcaacatgcacatgtacatgaattagggatcgatcagcttttccaattttgttctgatacagatctagtaaaaaaaatctagtttactatgtaatgacattatatcacggtcattactccaccagcaaatttcaaattcactgatatattgaaataactactcctttgtagaaatttgaagaacttagttttctttggaagtgtggatttcaggattccttctccaaacatagtttcaccaaagaaaccgaagttttatgtgcaatctgctattttttaagttaaatcatatcactttttaatgtcaatattaaggattgaagggaaaaggtgaactgatctatgtgatgaagagtaatgtcagcagcaactgtgtgtaacacagtgatcccaagatagactgatagagagactatagtatctttaatattgagaagttcccactggcaatgaactgctttctacttgctatacattctttttgtagccacactgaaaaatgccccttcttttcaagtgctagcaaccaactgtagtgtctgaaagcaatgcacaatcttgattacattgtactaacatgatatgatggcagtggcacgcatgtttaacaaaggaatgtgttataaggcggctgggacagaatctcatatttattggaaaaagagtatctcctagatctattttcccccttaaaatagactggctgcaactggctaactaatatacgtcaaaacaactcctattctctcatccattaagggtgtttggatgagataatcttcttgaagtaaatctgaatatcttgaaggtatgttaaattctgattttcgaagtcgagtaaaattcattgtatgtgttgccatatgttgcaggtgtcagctctaatactggaaaacacctttacatctatattggatatggctggtatcatgctacccttcttacgatggttcataggtggcagttcttcaaaaggtccaaaacttctgaactgtgttgttcgctccccatggagtacacttgatatcattgcagaggtgagtgactatatcaacatccaagatctattgttttcacgctttgattaccgctctcattttcttcttttctattttggaaaattagattgtaggttgcatatctttagagaatacatatcaatttcttatgtgattcaaatattctaatttgcttttttggcatgcatatttgaaatttaagctaagattttttttactacattatttcagctactgtatatatatattgacaagagttagaacttagaattattaaaatctataaggcctcagatctttgtaaatactctttccactttttggttactattttaccgagacctgatgctgtgcgttatctattgcctagttgatgtgtccctttcttatgctcgcttaaccttttcctcgcaggtcaaacaacccattattttcctttctggattacaagatgaattagttcccccttcacacatgaggttactatatgaaaaagcttttgagcataataagaattgtagatttgttgattttcccaatggcatgcatatggatacctggaattctggaggagaccgttactggaggacaatccaactgtttctggaccaatatgctccagaagtacagagttgtaataccagctgcaaaagtgaaattgctaatgatggtaattttctatcttgtctattaaaaagtttctcaagacagttctgttatcaagttttccatttgctttgttgacagggtcaatttattctgaagttctgtattgtgtttactgcattagacttttcatatgccgacaaatattttttttaataaattaaatgcacttcttttggatactacccatagttcatttatgttgtttgcttgccatttgctgcctggctttaccccttgtattgggtgactagatttaaatccatttggattgggggggatcagaacccattcattggatggacaattttctctgcccatctgaagggatttagtatttgtttgcttgaacaaatcattatgtgatgatcggtgattctgtctatctgtgtacactatgcagttttagcagtgttgatgtctgactgctggcaaatattttacccatctccttcaaattttagaaccacgtactatttttgctgttgactggagaagtttgttttgacgaattcaatctttttctagatgaagctgaagagtgaccagaacatctggagcggccttcttttttttttcttccaggctccagttttctggtgtgatgcgatttaaatcctgatgaactgaagctcactgcaaacaattaattcaggcaattattctccattcaacctgaagaaggcaaagttgtgaataccttgaggttgctctccatcctagcactacatttgtctctggagctatatatagatttctgagaagacctagcctttgaactgatgattccccctcccccccttgatttaatctgtgatgttgctttgttgaagttttttacaatatactgtagcgcattaccatgtcataatctggcctcggtgtataacagtgtaatgcataggtttttaggctctggttcagcaatttggttttgtgttttttattattggtgttatagatctggttgcctgcttcttaagcctgttataccaaaactgttgcaatatcaataggccatgtcttcaccggcagtaattttttagcattacacgaccttattgactcgttgctttatccagtttgatagttgtaggattgtcacgtttgaagagtgaacctgatgcatttttcttaacactggcatctactatgaaatgaagcagcatgaaggaactgactttgttaattgagtcctcagctcgaatttaggcgcgtatctcttttcctaatcaaatatgcacctaaattcacaattttttttggtttcctgtaaaatcaaacgattgtggacacggtttggaatggagtgcgaagatggtttgcattatattaagaaaccattcagttcaattcacgcgaattcttttaattttatttggtaaggtatcagacttaacggtacccatatatctttactaaattttagggtctagttggtagtgcttaaactcctaaatttaacttcaaggatgaagctatggagctatctaaatcaaacttcatctcaatagttcattttttgagagtattctaactatgtttactcctttttggatggagctaaaatcgtaaactgttttgttgagctacagttctagaagagatgaagttatgccaaacgagacgttggcattaccaaactttaccaaatttggatgctcgaatttagtagtagcgttaattttggcaaccgaacaaactacacaagccgccgatatgagtctgtcgggctgaccggtgggccccacgcgccagtaaaatctggaaaaggaaacaaaaacgcgcccgccccgcccgccctaggcttagcctaactaagctgggaagggggtggggaaatttcgtcgtcgcgatgggccggggcccaccaagtggaggcgcgggggggcgcgcggacacgccccgttctctccaatccaaccacttaagtcgccttccctccccctcgcgtccgcttccccctcctctcttctctcttttaaacccctccccctccaaaagataccaaaaaaaaaacaaataatgtcagaataaaacgcggcgcagcacacaccccagctcctcctccggcgacgagaaaaaaaaatggacgcgcagtacaacccgcgaacggtggaggaggtcttccgcgacttcaagggccgccgcgccggcctcgtccgcgcgctcaccgcaggtacgcgccgccgccgccgccgccgcagccggaggtttttctagatgcggaccgtttcgagattttttttttatgctgttatgttagtggggagttttttttttggtttttttttctggggttgtaggatggttcgctgattggtttggtgtggttttttctcgctgcagatgtggaggatttcttccggcaatgcgacccgggtgagtggaatttctttttcccgcttctgttttttttttcctgcctttcgctttcgatgcgcgttggaatttgtacagggaacgcatttgtttcgtccacgaatgcgcttagctcgctgcggatttatgcgctgcagtagaattccgcgcaaatctccggtttattttttgaatccgacggtttgaatctgtgtctcgttttgaatacacgagtactactagtagttaagcagaatacgcgtcagtacgtgaagctctcggaagtcagaattcgaatcaaatgccctaattcgtgggggtttagtgggtaatggacggttgagattaacctaaaccgacacttccagtgagaatgtgagagtgagaccttcaacttcacactcatgaggccatgaaagctatagcaggtagcagtagactagtagcttggcagtgaaatggaccaagggaagaagcagtagcacttggcctggaaggcgccacaatctgtggaggctgctgctacatttgagtttgggatttttggttgttgggttcagcagcattagtggggtcctgtttggtaggtggggtttgattcttgtggcctaaataatggggggttgatgtggtttctgggattcttgggagcacatgtcacaggcctacaatggtaggaggaggtcaaccttgctggctttgctgcaagcaatgctgcttgtggtgtgtagtaggagtacagaagtaagccggtggctgggcagttggtgttgtgaccagcgggttgtgatcccaatggttcttggctaaacatggggtacagtacagctccactgttgcatacagccaagagcggtgctgtggcccgtggggatccactggatggtggtggtggtgtgtgattgattttgatcccacaacaaagacccagcatttgatcctataaccggcagcattcacccatcctatcctcaatttagcctctgttgaaacatcgtgttgctgacatcatgctgcctcgtgtcattatctctgctttcttctttacattagaccatcacaacaccactctctgcacactgtactgcttggtccattgaagcctgtaagactaataaatgctctgaacaccttactgtggaacgtggaggaggtcaggggagggcattgtgcagtgaagatcctcagttgttcccaaataatgaaagttgtccttgtgtggattgggcctttgtttggtgaattacatcaactacttgtcatttaatgtccaatatccatgaactggctagtggaaacactgcttgaagcatttggttaggaaatagggtcttatattgaagagtctattctcatggcaatggagcagcaaaatgataattttggtgagcttgagtcatgcttattttgagttcatatatatgccgtgaaggtatggaagaagaaattcattgacaagtggtttcacttgcggctatttgatttcaaccactaaatttcttaataagttgggttccacctgtttttataaatgtgcaacatgtttcttcctaagccatagcactttgtaacagattgatctacatgttttcggatagtaaattgtagcaaataccctaaacttggatacttttctcatatcttttgagccttagttgaattattgttttgcaagcccacccgtttctcctatgttacaaccgtcgttaggaaaaccaccgttggctctaaaggtttgtttgattatacttcaaaggtgaccttatttgaacaagatgagatgcatatttcagcttactttagctaagtcatactcaaattctgaccagtgggcaccattttctcctagtacacctatgctgacctgatatttgagcactcataagcgtttaactaatatatttgtccagccatacataaccatgcgtttctctttctgcagaaaaggaaaacttgtgcctttatgggtttcccaatgagcattgggaagtaaatttgcccgcagaagaggtgccacctgagctcccagagccagcattgggcattaactttgcacgagatgggatgcaggaaaaagattggctgtccatggttgcagtgcacagtgatgcatggttactttctgttgcattttactttggtgctcggttcggatttgataaaaatgacaggtatctcatccttcctatatctatacttctcttacctagttatggtgcttcatgtgccttttttttttttagatcctactttgctcatgcattcaccacacatgcagtatttaagccttaatcagatagactcagttttagtatcatagcatcaaggaaaaaaaagaaggggtaaatattgttgtatactactagtagtaatggtgcttaaataaaatccggaatgggtaggtgtccatcctctgggaatcttttgcctcactaatagagtgactcagcatgagcgtggagtaaaattttctattacagactgaagaatagtcttgctaacattttaacatgctataatggtacttgtatgtatggattgcttaatttcattctgtaattctacggtttgtttcacaaagatctagagttacctaaaagagccagctctcagctgttctgcttggtacatattcatgtttgaagtttaatatatgttttctagttggtaatcttctggttttatctgtgatgttagtgtcttgggagtgtttcggtattaatggaaatgatgcacatggttaagtggttaatgtttatcgcatgccttaatgactttaattgagaaatgatgttcttgaatatttgccgctttgtacctatgtttgacctgtcatgtgttactgacactctgctgttgttgtgcaggaagcgcctgtttggtatgattaatgatcttcccacgatttttgaagttgttagtgggaagagtaaagccaagccaccgagtgctaataaccacagcaatagtaaatcaaaatccagcaataaaacggtacggcccattctcctgaattgtactcataccatgcatgactcttgcttgtgtgaccaatctcagacaccaatacaccatgcaaatccttcataatgctcagcgctttgtcatttccttattgttgatctgttcagtgtgtttcgttgtttttctttcaccaaatcaatccttttaacatttttttaaaaatcttaatcatatgccgttctgaaagcagaagtcttctgagcctcgggcgaagcagccaaagccgcagccccagcccccagtgaagaacgaaggccgcgaggaggaaggcggcccggacgacgaggaaggcggcggtggcggcggaggaggcggtagggaggaggagcacggggagacgctgtgcggcgcgtgcggggagagctacggcgccgacgagttctggatctgctgcgacatctgcgagaagtggttccacggcaagtgcgtcaagatcaccccggccaaggcggagcacatcaagcagtacaagtgcccctcctgcagcggcggcaacggcggtggcggcggcgtcagcggcaacggcaagcgtgcgcgcccgtcctaaggtgtggcacggcgagcccatccagagttaagatttgggctcgccgtgtggtaggagcagtctgcatagtgcagtgcagcggctattcttatttgcaatggctgtaactcgtgaggatgatttttaactttgttaagttattgtatggcagtggctgtaacttgtaagggtgtttttaacttgttaggcatgcagttgtgctgccccttagggggctaagactgcttatccattgtactcctaatctaatcttaatttggtttttttttaattaagtagatggctgtatttagctggtctaccagcttactactgcgtcctgtgttaagagtttgctttcttgctccatttaggtaccgtagccgtttgcagtgcagagatgtcgaacgaaataccgcataaatgcataatgatgttctccagtatacggcactgtatccaaagattcagaacatagctatgccggtagattttatcagtaacttttggttttctagtgttttttatcttcgtttttcgatcacttagaatacaagggcaatggttttacattagattttgttatcaacttgaattttctagtgctttgatcttcgtttttggatcaaaaagaatacaagggtaatggttttacattcatcaatttttattgtttagattacgtacctacctataataacattagtcagtagctacgaattggcaatcactgatattcgagttcgaccaaggacacgtcccctaaatgctgatgctaacactcgtattcaacaatcaatatcaaactcaagtgcgaaatcaggcgtgctagccagggtattataattgcaaaggctcacattcatatttgaatccatctttacattggatattgaaaatgaaacgacacatggtaccaatcactcatctgcaacgacagaactaaaaatttgtagtactaaacgagaagccattataagccagtacctcgtgagagatgagagaagcaaaaacacaagcacgcatgcccggagtccactgataagtgacaacccctatgaagtgattagtgatattcgcatcatgttagctgaacagtacactactaatgcacgggaagacgactttgatgcaaaacctaatgacaaggacaaccagggcgaaggaaacgtggcctggggtggtataaacaaagaattgtacagcttacaagttacaatccagaattaaacagctcggtagcaaagcacatattgaatcatgctgccgatacaaaaatcctgctgtttagaagatacaagctaggaatagaaaagcaagcgaagactcaacatcaacattgataacatgtgggaaaaatgattgttgaggaaaccatagataaattggccgaactcaactgcccatttttcccaaaactggtttagcaggaaagtttaagcagcatgtacaatgaaattgtatgtgcagctccatttatactagtcctgcatgcaatgagttctagacaaccgaagttgataaaagtttcatgacactgccatacaaacaacaaacaaatctgtttcaggtctaatgagaggaaaatgattgttggagaaaacagaataagcttaacccaactgcccactttcctctaattgatatagcaggaaacactttcggcaaaaaatgcatagcataaggcattaggccgatacacactatcctgcagggtaacatgacaacggaaaaaacaaatgtaaaatccatgaaaaagtaaaacatttctttggtactgctatctagagagaaaactaaaagctacagaagcacaataaggaataaataaagcaagaatgcaatttacagatcaccaaaacagacataatgtcataatataaaaatatgtagagataaatgagaggaaaatgattgttgaaaaaagcacaaaagcttaacccaactgcccactttccccagatcaatatagcaggaaacacttttggcacaagacgcacaaaaaagcgttaagccgatacacactatcctgcaggatgaagcatatacagtgggcagaatgattacctactatactaatctcatgtaaaaaaatgagaaatatatcaggaactagaaagtgagacacaccataaatgttactgagcaccaggaagaaattaatagtgacgaatcttgtattagttgctgatgtttgcaacttaaaaactagaactctttactagtaataatgttaataatgaacattacataactgaaaaaaacatgaagcgcatgcatcagatcacctaaacttattctatttaagcagcaactgggatctcagctgtaagaggctttgaaaactcatcctcatccttaggggcatggatggtaacaagatccggtaaaggagtcattggtccttgcttgcccttcggatcccaatcaagcataatcttgaccttaatacccagcacaccctgaaaacaagaagcagcttctaagaaaaaaattcaagctatcacaaggagacagcaacattttattcaaacggatggattttatgtacaaacctgtctcagaagaacatgtctaacagcagagtcaatatacaagttaacaggataaccagaagaaatcatgtatccgtccttgaacttcatggatttagcacgctgagccctaagcttcccactcacaataacctgtaaac

SEQ ID NO: 64472 - DNA, 18285 bp, Oryza sativa
ctatagggcgaattcgagctcggtacccttttttatattgttaggggaaagcctgtagctcggacattatgtggtctggttcgtcctggacttgtggcaagcagctttaccactataaagctttttgtcgtaatggtaccacaatatctgtaagtattttgtcatggtcatggtcatgtgtgtatacccaattgcccatattgttttctgagcttcatgtgccatcttctttgcagacccactcttttgtgcttgtcatgtctgaggaggaaagtcgctatcttgcatacttggaagatatgtacgaagataagaaggggcagaagaaggttaaagtgcgatggtttcatcaaaaccaggaatttgcttgcgctatacctcctccccctcctcatccttgcgaagttttcatcactccttattctcaagtaatcagtgtggagtgtgtcgatgatattgcaactgtgttaactcctgagcactatgaaaaatgcgtcaatacattgccaaattcttctatggtgggaatccgtttctgctttcgccaatacagtaaaaataagtttaaacgttttgacctgagatcattgcgtggatattttagtcaagctgttgttttgtccttaaaacttcccccagagcaagaaaaggatgatggttctgatatcataaaaacttttgagcaatggacacctgggaagacaaagtttcctaagcagtttgagaggctttactcaaaatgtttgggaactaaaatctgccgaggcccacaagaagactccatagcatcttatcagaaaccaagcagtaagcaatctcccagaaaacatctctcagtcaagttcatagggccccagaatcagcgtatgccaacctacaatgttggtgacagaatagaggtcttgtctcaggacagtgggattgtaggctgctggttcaggtgtacagttctcaagtcatgtactaatcataacaaattgaaggttcagtatgatgatctccagaatgctgatgatagtgggagattggaggtatgactactggtcttagtttgaaatttaagtggtatatgtatttttgaaaggcagaatatgccataatatttggtattttgttgttacttctattctttttcgtaatgccatgatttattttattaactctgtgtaaaatgtatgctttcataagaggatgagattattctatgcttctttgtaggagtgggtacctgtatcaacattggctcgtcctgataaactgggattgagatgcccagagcgacgcagagttaggccacgccctcaacaaaatagtttggctgacggaactaatcttttacctggagctgctgttgatgtatggcaatttagtggctggtgggaaggagttctagtcagtgcagacaacatttcagctgatagcctacaaatatattttccaggtaaatttcctttttgaatttttttttctggtcctttcttccaatgaaaaacaacaagttgttttgataaaatagatccttctgcagtccgtatctaattttgaccttccaagctaggggcaattgcaaatttgctgttggattgaatcgttattgcaagactgccactagaaaaatgcaaaaatgacacactgtcattcgagtggtatccctgcaaaattgaaaaaaccattggcaaatttgcaaatgccccagtggtattccttgcaagcgtatggaagctaaaccatgttccttatcatcaaacaacgatttcctatgttctttaatcctctatttcatctgcaacatgttgatatttctattgtttttacaggcgagaacttctttagtgtatgccagctaaagaatttaagaatttcgaaagattgggtcaagagccactgggttgatatagaaatgaaaccagatgtgttatcgaaaataccttcggttggtgttcaaacaaggcaacctgataatctgacatctgttgagaggccggactccagaaattctgcaatgtctgaccaagagcttgcagccatacaaacaaactctagtgaagataaacaaacaggagctgatcagccagcagaagttagtttgactgatatggcctctgcttttgcagaggaccagaaacaaacagttctaggaaagcgacctagggatgatgatgctgaacaacattgcaatggggaagtaggcatagatgttggcaaattgtgaagtttgggaagcgcaacctcattagacgtatgtacatagctatagatatggtaattggaccccagcagaggggttttttactaggttgctgatatcagtgagcatcgacatcttttttcatacacgtgttcccttgttttactgttagcttcccactttcaggctttctgtcaccagatacagaggttgcaaactaaatattacccttaccagtcatattgtatagcagtctgattgatcattgcttctcttatgttttcctccggagtctggactatagtttcagtttattctcaattgttaatatagtttaagttcatatgaataacattcttgtcctagcttgcttgtgctacaagagtatatctgcatttaagctgttgtgaagattcaacgactaacaatcacacattgtgattgggtatggtgtgcaattgcacatccatcaagtatgaactgcacttgcgcatgttgatctgaagaagttgcaaaatgagtggttttttctcctcctcaagttctgtatcatctatttgtggcatcctgggatctgaagtcaattctacctgatgccaatgccatcccatgatatcattatcttctgttatgttaggcctgatgtccctggcacgagcatgtcacattcatatgatgcattacctagttcctttacacatgcaaactctcatctgctatgattggctggtctaacaaatctccggtcccattatatcgcaaactttgaattctataaaactcaatctttgaagttgattttatggtttcatcgtggtttattttacaacattttgcttttgtatcattaaattttacctataaattactttttgtttgctaataataggcgatacgaataagcataaagataagtgaaatgatggggctgctcatctcactacatatggatgtatgtcaaagtttgttacatggtacatcgttacatgtcagctattatatctactaggtacatgttctatctgcagactgcagtggagaaggaaccagcagcagtctgaactttctgaacttgtgaagaatcggcgatgatctacagccggagccactgctcgccgttgatgaagctccggccgatgaacggccgcgcctcgtcgtaggtgagcgtccgcgaccacggcaccctctgcttcgtgctcgcccctggccctttgcagttgtactccccgaacagcaccgtcctgtcagaagattcagacacattctctgtcattttctgacggatatgatatggcagtatcgtctctaggatttcagaaaagaaaaggaactcatttggtaacagccttgtcacatgtggtaactgaattcccctatcaagactgtttggtgagcctgcaatgcaactcccaaccacttcctatgccatttgatcatcgaggatggtaagttggtaactagtaaaattcagctaaaatataatctcttcgatcaataatattaatatgccatgtgaacctgacagagtagctgcaattataattgtaactgtaattttaatcaagagcagcaaattgagtgtgtgattaaatggcaggaaagttgatcactttgttcttgattgatcaccccagtcgctccatccctgggggacgatgatgccactgaggtcacagtaggagtacaccactctggagtacttgccccatgctcttcccaggtagagcatgccggagccggtgagccggcagccgacgaagctgaacccggactcctccgacggcgagctccgctgcgacgccgcgatcgcgccgtagctcgtcgccacggcgtgcagcgtgcaaccctgacaaaaagaaaaaacaaagttacaaaaattcagactgccaagaagctaattgtccattttaatcatggcatattactgcctccacgtgttacagttgtatattgatctaataataatatattgacgtgtaaggtttttgcatgttcgtgaaaaaaataaattgatcatggcaccacattgccatgtaatgtcactctcattaacactcactccggcatttttcattcagtgacagttgtgccgaaggtagaaagagaatgtgaccactaattctgaacaccgatttgtgtaagagcattggtggcattggtgcagggctaagtgcctaaccaccttatcccacttagctatatagctaggttaagcaaggtgctaatctaggtgcctcaccagagtgagaagttcttttgctgtaaggtataaaatggaagagttggtgaatgcctgaattgtgagtttgtgacagctctgatcggaccaacaggagacacagcataaaaggtatagtactactagtctagaggacaactagagcaaagtgtgggggacagagtgtccaaagattttatcatgctatacataaacatattcttaaaaaatataaaatacttcctccatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcgccggacagcctcagcgccaccgcctgctgccccaccgcccccggcgccgccgccgccgccgagttctgcaccaccaccacgcttgttacatccaggaacacgtttcgccgccgccggcgagccggccggcgacgacgacgacgacgacgtgcggtgtgtgtatacctcgaaggtgatgtggctggcgcagaagtagtcggcctcgacggcgacggaggcggagtagaaggtgcccacctggtggcccgacgcgccgacgtcggacgcgcgcgagtgccacgtgatcaccgtgtggccggtgcccatgccgatcagcgacacgaacggcttcgtgatcggcaccgtcaccttctccctgcacggcacgccgtcgccggcgaggtcagcgccattgcagcttcaattccagtcttaaaaagcttcgcgagataggacgacattaactcgtccatggcggttacgagagggacaggtagtggggaggcgatcgatcggtcgaacacccacgtacctgtagacgcccggcctgacgacgatcttgaccctcctcgtgttgccggcggggaccatgtcgacggcgccctgcacggtgcgcgagtgccccgtcccgtccggcgacaccacgatcgtcgtccgctgctcgccgccgccgccgccgccgctcctcttgccgccgccaccgccggccgtgtcgtcccacgtgctgctccgcgccgccccggccggcatgctcaggtcctcccacgtgatgaacccgccatcacctcctactccggcgccgccgccgccagccaccgtcacggcgaacacgagcgccacaacgacgacgagcacgcccgtggcggccatgtccaactagtcgagagctaccgatctctagctagagctaattaaccacgcggattaatttggaacacacgagagatcaaccagcttagcttaatggagtatatatcgagctcgctgatttcacattacacacgccatggatgatgacgacgacgatgtgaagaagaagaagaagaagaagaagagaagaaaggatggaatgcaagaagacgttggaggcgtgaggaagtgatgatgccattaaatatggggagcgccacacacaaagccatgggtgttttggtgtgcccattggagatatatcaaagatttttaacattttagggcacaaaagtgggtgtttttgcttatggagttgtgtacacggtttcgtcgaccgcgaaaaaccatttttttttcatgagactaatttcgtccacgaaaaactttagcggtttgtcgctcgaaaagccgctttcatccaggttgcgtgatagtggggacctatttgtcagtgactgtttcgtgatggttctttaagagtggattgttggtagagctagcacgatggtgttgcattgcatggacttgttttgtgggaagggaactcataagggtgtgatagttattgcatagtattttttttgtgattaattaattaattaattagtatgtcatggcataatggttggtgctttgttttattgattacaagaattggaaaggttgttcatgagttgtgcacgagagagaccaagatttgtttggggaattttcgtggtggaatttggacaaggtaggctgatcaaacggggtagttagtaggttgttagtgcagaacggttgagtctagcatgcacgtcccactttctcaaccctttttacctagctcttgtgaattgtgatggtccatagttaactgcttttcttgacctaaatggagaaaaattagattggcaaaaatgttttctaaaacaaagcgctaatgcttcagatgagaagaatggcaagagatcaatggtcaatgccattttgtttcctattgctagttataatggattaggcgaagaagcattatgtaagtgcgagcctaacactgctgaaatctgtcaaaaggtcaatgcactagagctatttttgacgattaggtaatcttctgcagaaacctgcagttcaagtaaagccgtttactgtgcaatcaaatgaacatgggttgtgtaggatctatgcccaaattactcaaaaattcagcaaatcgacacgcttattcgtgacaactttcatcaaaatttcgtttacaaatgagcacggtgaaagcaatttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatataggctctagtactttcaggctcagccttgcaacaatgaaatggtcctgtggtttcagcccatggactggttactggttagagatttcgtaattgtcatgctgttctgtggaaatttccagaagcttctagaatcaccatatgcacaaacagatatggcatatatgtatgcatacaaaaacagtttttgttcatgggtgattaaaacatgggtacaagtgattcccgaattccaaatttattgtgattgatcttttcacaaatcacaatatgttcaggagattaccgaaatttggtatattctcatttgggttactctggatcccaaaaaactttacaaggaagtgggattttgctgtgtcatcagcatatgcttaagctttgcatactgcagagaagtggaatttttgcattggctaacaaaccaagtaaactgtgatcatatttagcaagtgatcttcaagtgggatattaaatttttacataatcctaaatacttattcaggttccaactaccatctccacttcaccaaatgttacacatttatttctgcaaaatagaaaagcatatattaggaacaaacaaattcagcatagacagcacaaccagattgctacagattggcagttttttggcaggggatgcacaaatgcaaggcagtatttatatactgaggcaagtaagcgattgagtaccatgatattatatcccactagcctaagcgattgagtgatatactgaggcaagtaaggtttggaaaccggagcggaatgtccctagcccactacaccagtacaacatggtactctagctaaagtctgcaatgatgaccatgtgcttcatccttcatgcgttaagtcgttatgccatagcccataatattgtttgttaacatctacgttgagacatccacagatagaaatagtacaaaattggaaatgctaacaaccaaaagatgccttggatgatgttatagtttattaaattgaaattaacatgtggcatcttgttttacatccctttccctcctaaataaacacaggcacgtcattagtcataggaactttctatacttgaaccaatagtcagtggagaaaatacagtaccaaccaagaagcatacaaatgggaactaggtatagtgaaaggcacacccttaacggcttaacagtaatgggatccatgttcgataagagaggcctcacagccctgattttgttgcatccacgcttgaaaaaattctcaaacttcagacttaggtattagaattccagaaatttagaaaatattgcgtaagctagcaactctagtctctaagtaacccttttttcattaagttacaaaagttggtaaccatttcatatctgataatcacacttatgaccagcataatcctcacagcgaagcaaacatagatatttgattatataaataatttaaaagaaggaaaatctatctccatgcagcatcaagatcagggataggatcaatttgttcatacctaatacttgttcgacgattgttcaagttcaggcctgtggactgacatgcgagcaatctcagatactgccgtctcactagcctgcgtatcatcaccagcaagctcctcatatgcagcctcgaatgcttcttgccagaaccgtggaagccgtacccgatcaacaccggtgcgtgtgtacacatcccacatccggcgcactagcttctctctgtcctccatctcctactcattatttaaaaattaggcaaaacttcagtacaagatttcattcacaactaaaaaatgcatatagttttgctcgtctatgttttagcttaggattctgctggtcatattgactagacaattatgcagatgaagcttgggaaattaaaccgttaacacaaatagcatatgttccagacaccaaaatcaagaaataaaggtgactgctttctcgtccatgtaatggaacaacttaaaataccatcagaccaaaaaaaaaaatcatcatgtttccagcagagcgtgtacccttccttagcatttttttgataatgagcattttcttagcacagaactaaacctttcagaagagaaaatatgcaatgtatgtccaaatgaaactctataaacagagaaaattactagattgcagaatgcttagtctactatgtgaatttctaataaaataagctgtttgtgactttgctgaaacaagtacccatttcatccccactatgaaatctgaaatcaaccaataatgcatctcctttttcgcaatgtcagaccgttgggacttgggaaaaatgcatgtacacatcggacagttgaggaacaatggaagagattaggcaccgaccaccgagtggcggcaagatctggaaggaaggaagggaatgttggggtaggggagacatacgagggggtcgaggtcgtcgataagcgggtcggggaggtccccgaactcggcggcgaggtcgccggaggaccagcggatggtgacggaggcggcgaacatggaccagagcgcgaggagcgcgatggcggcgagcgcccacgccttgtaccgccccttcccgagcagcgccgcctccgccccgccggcggcggccgagatggggatggagatcttggtcgccggcggcggcgtggaggagtggtggtggtggtggtggtcggcgggagccttcatggccagcctcgagtatggcggtggcagtgggagctcagcagctgggtctgggactgggcgatgtgggcaattactctaccttttgatgagatgatttgagcaacgtgtttatttttctttgatagttgtagtgtactccctacgtccaataaaaaattaaaccagtattaaatataatatattctaatacaataaatttagaaatacatatgtctatatttttaggatgtgtcacacatcccgtactagattcctttttttttttacggagagagtatatggataagaggaccaagattttaatttttgatgttgctgccaatctatttttgttaatgatggctatgattattcactcaaggaaaagaaagagaagtgctaggagagaatgtgttaaatatggcccaatagttaaaagagataggatgagaattgagtatctagacacaaaaatttggaggaacgataccacttgtatcaacatacttagacttacgttattaccaccttttagaaaagactctttgttttggctatgtaagttctttagaaatcgtggtttgcttaacgataccatccacatatctattaagaaacaagtaactatgtttctaaatacagtaggggacagccttagaaatagattagttatcactaagtttgataggtctggagaaacagttagacgttatttcaacaaagtgtttcttgctgttggtgagctacaagatgaactaattaggcctcctttattggacaccccaactaaatttgccgggaatcctaggtggaatccttacttcaaggcgtgagattcatctatgtctcattttcaattttatatttaaataaactagtatgaatggtgaacagttaacagtgatggatagtatatcatcactaactgttgacaccaagaccctttactagaagtttttagcaactgctccctccgtcctaaaatataaagatttttatggttagacaccggtattaaaaaattatgtggaattaaatgagataagattatgattggttgagaagtaaaggtagatgagaagattgaattgtggagggttgtgattggtttagaagagaatgttgatgaaaaagttattgtattttgggacaaaccttaagcgctaaaagctgttatattttaagacgggaggagtacaattccttttaacatatgtagctctatagattctcagtaaaaaatatatgtatagttatataatccacgaaataaacaaaataaacaagaagtcaaaaactgaaaaatccaacctttgtaaattcttataagccaagcaattgttaataagaattttaagctaccgagagctttaagccttttaactcgaagttgccaaacaactgtaaatcttggctaaaccgctaacgcatgtgaaagtaggcctggtgatggtgggccttgggcttagcatgatctgtattaaactaattaaaactgctaaatcgcaaaaaaaaaatagaagttgctctaaaatatcaaataaatctatttttcgattttataataattaaaactcaactaatcatatgttaataccacattattttaaaacacttaattttcatctttatttacatgagtttcaaacaccacctacctatatacttaaataaacatctcaaacaaaattggtttaattaggagttaggtggccgtgagagcctgtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgaggcctgaggcccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtattttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaaatttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgatgtggtcgctgcgcagagtcgtcctccggtcttcgatgattcgggcgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgataaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatatgttgcattccaccgatgctctgcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctctgcatcggtggcaaacttacgagctttcacaccggccgcattgcaaaacctcttccatgcagcaatctgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttacaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaataaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcgctttcggcctgacgggccgctggcgaaacgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaagagcctgcaatgagatgggctctgtgcaaaagctgagttaggtggcccgatcccctttcttccccgcaatcaattgctcaccggcggagaggccgccgccgccgccgcgttcttcctcctcctgagccctaaaagggaatccagctcgaggtcgaaccaaccaaaagcttggcggcgtcgcggagacgcggccaacctgctccacatacaccgcccgtttcgccagtgtcttttctctttttactggcgcgcgcgcgggcgcgggcgcgggagaggcgagggagtggtggtggcgcgctgcagggggggctgcttggctgcggagtgcggacgacggctataaagagggcggaaagagagcgcccgatcccgctactcatcagctgccgtctcctctgtgtgtgtgctcgcgcgcgcgctccggttgctcctccttgggttcttgatttgctacacgcgtttgcttgctcaccacgtgtttgatggaatacctgtgaggtgaggtgaggtgaggtgctgtggctgtggtttggttgatgctaatccagctgttatttgtgctggattgattgcttatttgtgcttgttattactagtcgttgttagaaagcttctggctaaaaagtcgtcatttttttgcgaaagcttctttagcctacaacggcatagggatttcgatagctaaaaggtgtgcttatcttgttaatgaaagagaagtgcagatgctttatttgttgtcttgttgttccaaactctagaaaagtatgctctttttgcctttatcccacgagtagtagtatatcatcataaaacttaagggtccctttgaaacgcagaataggaaaaacacaggaataggaaaaacgtaggaattgaagtagcatgttttcctaatcctacaggaatggaaaacacaggaaatatgaagagggtccctttgatagcaccataggaaacaaacaaagcaaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctctaaaattcctatgacaatcctccaattcaaaggggccctaagtagatgggagaatggagatattcccgatatacacacgtggattggagcccaaccgtgcatagctagccatcatctttgtctcactttgttaggaaatttaagtgaaatcaattaaaatctaggtaaatccaaaggttacgcctttcagtttaactatcaaatactccttgataaaactttactaaatataaagagtttgatgttgtttccagagaacttatatcaaatatcaataatttttggtatccattcttctgaaattagtatttcccttccggaaaacatacttaaaatagcagatatttcctctatttcacaatgtaagtcattct

SEQ ID NO: 64473 - DNA, 3282 bp, Oryza sativa
cgcagccgttgtccgcggcgccgggccgccgagcgcacttgtgccgctcctacttgtcgccgtccgccgcccgcccccgtgcgccgccttccaccgtgcgcccccacgcgtcgccgtcgtccgcagctccgcgcctccgtgcgcacttgcgccgctcccactcgccgtcgttcgccgcccgccccagagcgccgccgtcgtccgaccgccgctccgcacttgcgcctgcatgcacgagtgagagagaacggagagagaaattaggaagagatagagtggaggcatgacaggtggaccccaccattttttgaaaaaaaatgctgactggactgccacgcgtacgccacgtaggataaaaccgctctgaattgggtcgagggggtatttcgtccggtattgaaagtccagggtgaagaatgttcgtttttgtggttcagggggtaattcggacaaccacaatagttcggggggtaattcgtactttttcctttattttattatgacttgatttatcatcaaatgttctttaagcatgacataactatttttatatttatataaaaatcttgaataagacgagtagtcaaacgttggttaaaaagtcaacagcgttatacattaaaatacggagggagtagatttctgaacttataaattttgtaactacttattcttataatccgagtggaaatatgtattattcgttagcttgagattctagaggaaacagtaaccggtaaaggcttcttcaaacatgcctcgattacaaatttacaatacgaggtcatcgtggattcatggtggactttgccatcatcggtcaacatttctctttcccgccgctgacaacatttatttccttctaccatttgcatgcttgcattcaacacaaaatgtcaaacttgtagccaaaacagttgaggccaaacccaaacatttgaattcaaatagcaaacattctcccaagcacctaggccctagcatctctagcagtctcagctagcactagaagaaatcaagaaatcccgttcaccttcagctagcactcgaagaagaaaaaaggtattttcaacctgctagaaaattaaggaaaaaggaaaatagttgttcctttttctctagaaaaaagatagttgtaaaagtttagaaaaaaacttgggacatttgtgctctaccgataaatttaaaatccaaattcacccgcacattgagaaacaaaataaaattttaaaaaatgacattgtattcagacttgtatttatcttatttatttgtcgctctaagacttgaagttggtaaaatgacattttttcctccttttatataattgtttggattgttgtttcgaagtgtcatttggaagaaaaatgtggcattccagacaaactatcaaactgtttccatagacggatctttccacatttgtgctctacggtcaaatgtcgacataaaaaattccagtctttgactgcgattccaattcttccgtgactagattttagtattggatataatcacaccttaagattacttagctaccacaaacttcatgggtactcttggcttcgttcggtagcagcagattgagagaaattcactctttttaacgggcaaagttcccgaattatttaatgatgcctttttttgcaaaaatatttatataaaaactgttcaaaaaatcgcattaatcttttttaaaaaagtttgaaataattaatactcaattaatgttgcactaatcgcacacctcattatcatcattttacgtattttcccaatcttcctcttttctcacctcttaaacatatcttagattccaaattacactactcccttgcacattcccattgttcattagatacaacctaactatacttttgtgtatgattattgcgtgagacatacggggcgaggaatagatcttgctgccataagtgtaagcaaactaagggctgtgtttttttttttgggaaccctgccctttacacacaaaacatgacaattgattaacacataattaattaagtattaactataaaaaacatgaaaaatatattaatatgattttttaaagcaattttcgtataatttttttttaaaaaaaatacaccgtttagctgtttgaaaagcgtacgcacgaaacataaaagtgatgagttggaaagttggggaaagaacttatgggtgcttaccgaatttgagatgatgctgactcaacctgcggcatcctcagtcatgctgactcacaccggtctacagtccagtcaacctcgtattcacgatggctgatcatatgtcatggctcgccttcaccggtcaacattatctccttaatttaacttcgcagatttcattcaacgccaaatctcacaagcaatctatccaaatctcttttatatatactagttttcatcatccttgctgcaaaatttgacaacgcaacgcaaagcagctgctcttccattccatgtctgcgcgtcccaaccctccgcccgtgcggcggccgcgctggcgccgggatctcaccgtccggacgccgcgcgccgacgtcgccatgtcgctcgccgcgccaccgccgccgccgtccctcgacaccacggtggagcccccgctcgctgagatggagctcgtctgcctcgtcgacagcggcgaggccggcgaggtgtggctggtgcgtcaccgtggcacgcggcgggagtacgcgctcaaggtgctctacgagcgctgggccgccgccgccggcggcgacgccgacgacgacgaccactcgtccctggtgcggtgccacggcgccacgcgccggagcggcggcggcggcgaggagcaccggatcgtcctgctcgagcacatgcgcggcgggtctctctccggccgccgcgtcgcggacgagcgcgccctcgccggcgtcgcgcgccaggcgctctccgggatcgcgcacctccaccgccgcggcgtcgtccacggggacatcaggccgtccaacctgttcgtcgactcgtcggggcgcgtcaagatcgccgggttcggcgccgaccgcgccatcgaccggacggccaacggcgggccctgcagggcgtcgctcagccccgccgcgtacatgagccccgaccacgcctgcggcggcggcggcggctacgccggcgacatatggagcttcggcctcaccatcctcgagctctacacgggcagcttccccttggtcgagcaggggcaatcgatcccgctgacgtgttactccgacggaccaccggaggcgccggccaccgcctcgccggagttccg

SEQ ID NO: 64474 - DNA, 628 bp, Oryza sativa
ttctcttgcaccaccgcgactgccgatgctgcgattttttcgactctctcgagcgcctcccccgcttgggactttggcgcgaagaagttggggaagtacaagctcgatggcgcgggttttggctccccgtcgtcgccgctcacactcgaagagaggtcatgcgcctttgcttgctcggccattaggctgaacaagggaaacttggcccacacggaagagtatgagagctcagaaaacacacgctgagccccttacctggcgcgccagatgacggagctcggggctcctcaccgggagaccgcgcaggcccccctttgccagttcggccgggggcttagggtgagatctcaagctctcgctgtgtgtggaaagatcgcgtgccaggaagaaacgcgagacacggacgatgtatacaggttcgggccgctggaaagcgtaataccctactcctgtgtttttggtggatctgtgtaagagcaagttacaaaaaatcaaccagccctctcttctctcgggaaaatccagccccctctctttgtgggcatggtcctccttttatatcttaaggggataccacatgtaccctttcctttccaaactggacttttcttctctttatggacggaga

SEQ ID NO: 64475 - DNA, 594 bp, Oryza sativa
ggctgatatacacctccatgaagttcaaaattgacagttcccaggatatccatgggagtgtcgaacgtgctgatggcgaagagcctcgaccaattcagaatggccctgtgcctacaaattccacccagacagtatgaattacatggtcatgctgaccgtgctctggaaatataaaaccaaaatggctcatctcttatttattgtaggtattaacccaatatctggtgcagaaattaatctgggatgttcccattcagcaactagccatgcttcaccggaagccgtgttggattaaatagttctatgcataatttagtaactgatcacgtcttatgttttatcactgcaatggatattctttaacaaaaatgtaatggtcacttctactttccaaaggcaatatatatactcttgtttccccccccccaaaaaatatatctactcttgtattattatttctctgcaaataaaaaaaactactgatttgcttccagcctaccaaatgaatgataccttgaaattttaactgtaggattgatcaatacccaaatttttcttactatatatatgtacctgggggcatccaaactggtc

SEQ ID NO: 64476 - DNA, 518 bp, Oryza sativa
ataaaaacacatggacacaaagaggggaacaacaaacactgggtggagggagaggatcaaaaagctacctattaggaactatgcttactacctgggtgatgacataatctatacaccaatgccctgtgacatgcagtttacctaagtaacaaacctgaacttgcacccggaacctaaaataaaaaataaataaaaggggatgcataagggtgagagaagatgtgacgaccaaagcagaagtcgcagtaatatgggatcacaagctgaggaatgtgacacctctggaagctgaaaagacaatgcagacagattttccccaagatcttccagaagaaacacagtcctgctgtgacagcaggatttcagcccacggagacttgcaagactgtaagataataaattgatattatttaacctaccaagtatatggccatttgttatagcagcacctggaaattcatacacctggatttactttcattcatagaatttaccacttttttttttttttgggacag

SEQ ID NO: 64477 - DNA, 2003 bp, Oryza sativa
tatgtactggtttttatcatgaaccgttacttataggcatcatatatgtgttggttcttaataaaaactatacttataggcatcatatatgtgttgattcttaataaaaactagtacttatgagctcatagatgttggttacaactaaaatcggcaccaataatgacacaatattttctatctaacattttcatataaagttggatgaagataaactttatatcaaatttgtagttgacgagacatataactttgtaggtgatgaattttttatttaatgtttttctgatgtccgaaaatgtgttataatgtttcagatctatttacataagtgaatatttaaaatttctaaatgatctcggatggagacaaaacatatatgaacgttgtaggtatagatgacgtctacaattttgtagtcgctaaaattttcagttgagcattataaatttggataacaataatcacaaaacaatagcatggtaagaatctttagaagcatgtctatgaatatgggttgcaaaaatcatgtgatatgtgggaagcgaagtgtgacgttatagggaagtaataaaaataccaaatattttttcatgtttttttagcacctataaaaataaaaaagggtgcacctctatgggtttttctgcagtagtgagtatagactaagtttagatctatttgtttagtaatttacatcttcatgatctatcttatcaatttaatatttctttttttttgtcagtacaagtctaacgcacacacaacacaatcgtgcaaacgctcacatatctaccaggaggactcgttttgtgaaaattttaaaaattttatatagctatctagattgcatgtatgcaactaggtgtgtgtatatgcactttggtgaaaagaatacattctgcaagcaccaaatcctatagacacagctagcatatgaatcatacgattcaacagagctgatcgacaaaaaattgaagaacggggaacgccgtcctgacgcaaaggatgccgtggcagcatcagatttccacggcaagtttttcccttcccgcggcaggcagtcaaaacaacggcgggtggacaagtcaatgtttttgacacgactaacaccataaaactttaaaacatactagttgagagttttttttaacattatgattgagagttgacgaaagaaaaaaaaattaaaacatactcacaaaataagataattaatattaattattttaaacttaaaaattaaaaatacaactttttgtaatttcttttgtaaaaaaatattgtatagtattttggtaagcgtatgcttttgaaagagaaggtaatttttctctctgtgtattgtcgctgaacgtaacctaagatagcattaaacaagtactcatatgggacaaaactttaacgaagtaaaactgaataaaaggacgcaaagtgcaaaaactaaaaagaatttttcaagctgttttcttgaatttagatatatatgaaaaataactaatctttaattaagaactcaccgggcatacactagttggtcatcctcatgctcttgttaatgtcatctttaatttgaccaaaacacttgcttgctaaaagaggattcctagcatcccaaaataaatttagtgagattcctagcatcccaaaacaaatttagtgaggagtaaaaatgacaaaaataaccctcatcaatagtagtaaaggtagtaatggtgataagtaggtaaatgatatttaagagataaaacttctcattttatatgctagaggaggtaggtaaagtggtagaagttgattttttttttggataaatttaaactctataagttgagttttttgggacggatagagtaatccatatcgttatcaaccatgacggataagattaaccaaagcacgagggtcgttgttgaagctgagtacacatttgaccaaattttttaatgtttagtggcacgtacatatatacctacagatatacatctctttggcatgcacac

SEQ ID NO: 64478 - DNA, 1774 bp, Oryza sativa
taagtgtcatctgtcatttcatccccgatgaacattacttattacttcacttggtttcatcattccatattacaggaaaaagttatatgtttctatagaaaagtcaaacaacaagcaatggcccatacaacgccccctcctgttgtcacatgctgtagggttctgttggcatgtgttttattcaactgactattgcctacttgtacaggtagctgctatgtctggtgatgcaaggcgagccttagaaatatgtagacgtgcagcagagtttgcagattaccgcgttaaacaatctgggcacacttctgtgaatagaggtacggaccacatatctacaagccatttattgcagtcatggattctggatttatgtaatcttgatgaatatatattcaagtactatggtcttatgacttcatcccttcattcgtatccaattccagctgtgtatagtgatcaaactttaatctgatacctgtaggaaaaaatgttgtttgcatgggtgacatagaagctgctattcaggaagtctttcaggcaccacatattcaagtaagtgggcactgattgcttgttttaagaaatcagactcctagttcactttgtaatgcagtacattattcagttaggggttggttactgcacatacttagcttgcccttccctaacaagaccaattactttggctaggtacaccttcaggtgtagagaccaggagttatcgtccattatctaacaaaacttaaccaattactaatgttagctgaccttctaagcctcacctgtaacttttttcctctaacaggtaatgaagaactgcccaaaatttggaaagattatattggtcgctatggttcatgaattatacagaagtgggctaggtgaagtgatgttcgataaggtgagcacccactttttgttgttttaatttatagagcactgctacacatactagctttttcttgctaaatttttactaacaatcatcttaaccgtttgatttaggtagatggaagttataaaaaatttagatactcatagaatgacacatcagtgttagtaagaaaaaaaatagtacatagagccttttcctaatttatatgttgctggcctagctttgtgagcataaagaaaaagcaaggtagagattgacttttctctgattctaatgcaaaaatatcacctctgtttattctctagtaggtgattcatcaaacttattaggcctttttagacagctgtatccactgtctttcaagtttcaatagtacagcatattaccgtccttcacatgacttcagaattcactgtaacagtattactacaacacatactggttatttccctgaatcagtacaatggcctgcagggctgaaacgtgcaagtgttttgtactttgtcatgtattcttcattaacattttcaatgcatcgttttattttaacagcaccttgtatttatgtgaattgaggcagatacaaagtcttgttttgcttaagaagttcccttggtgtcagtacttttaattctttagtgaattacttttgagatgtcaataatcctaattgatgttatgctcatgcttaatattgttggtggtttgaaggaagaaatctgatgggctttcctattatgctgtaactggcagcaactgtcctctcttggtgccatgtcaacagagaaatattgcctggctatgatactcttctgaaaatctggtaaatgaatctggttttttgtttacttcatattacatgattttttccccaaatgt

SEQ ID NO: 64479 - DNA, 22345 bp, Oryza sativa
cgaaccaagtctggccccaatccctctcaactttcacaggtaagcaggtgagcacgtcttgtatctgtatatctccactatagtatagtactagagctgaaaatttagaaaacaattggttcaagcataagtaagagataaaatttccaattaatgaaattcttcatgtgattgatctagtatattcatattcccagctgaacttgtgcttgtgaacaatcatccatgtttagggaactttatatatctaagtgattgctttttgtgagatgattaagatgaaaggaattcttgcaactattcttatgactcttgggaatttgttttcaaaataaaattgttttaaaagctcacctccaattgactctaccttatacctaccaaggccatgtgcaagtacattaatgatcaaaccttatcatgcatatgactgtttgacattatattaagctttgtcaaatttatgtgacttgtgttagatatctttcatactctcatgatcaaggggtcattatcattaccactttccatttccacatataaaattaagctaagcttctacactagaagttggctttccacaaaaatatccattcaaataaactcctacattgaactatgctttcttctcctagaaaagttcttggcaaaaagaaaatgagaaaaggaaggaaaggcatggctagaaaaaaaaagaaagaaaagaaagaagatggaaataaagcttgctctcaaaatattgagcaaagaaaatatagccatgccccttccataatcatgccaagagaaccaattagagcgaaagtataggaaaaagggagaatcatttctttattccatcattccacaaaatattttactttttcattttccgccataaataaagacccttgttctaggagtatgattgattatcttcttgagtcaatatttttggctttgcactatatatgatgcaggtatgtcacagtttatccctaccaagctccacatatcagccttctaatagggatgaattatggcacattttgccttggtaaggatccaaaaagaaaatatacatccttgagggacaagagaggaagtcaataggaggagaagagctgatttgcgaaaatttataaaaatcccatgagtgtaacagggaagcaaggactggaatcaagatcgttctatttctcaattactcaagatggtaagttagccactgataaagttcacaggtgcaggtatggttgtaaaataatttatatgcttgatacatatcttgaagaaattcattttacactaacctttactcagtgacgagcaaagggctaagtgtgggggggttttgttggcggttgttcaatgccaatcccatactgccaacatctacataaagtctagataataaaacatccaacatagtaataggtgcttaatctcacatattccacaatattccacaagtgttggtgtatatttttatgcaaatgaaaaccctgaagttgggaggaaaatcatactaaagtgaggagaattatgtatccatacaaggaggggttgtgaacttcatcgaaacatcagtaaatcaacccaaaattccgagaaatggatagaggaaggtccatggactccaccgaccgaaggccaagccaggagggcccagcccaggttcggtcgaaccctctggttcggccgaaccccccctgatcaccgttgatcctgggtttggcgtggacgctccagaagttctcccaatgatggttgcggggcagttcggacattttcccttctcacaaccgtcataactgccctataaaaggacctcgcttcattcactctcacacagacttccaagattgagctgaattataagaggctctattgtactatattgtatactagaataggaagagagtagagaagaagtagtcggaagaatttcggagttgtcggtaatcttctcctatttcttttattctatttattactctgaattcaatataatattgtaacgtacccaaattctagaccttaaaaatttcctatcaaaatagttggaagctaacttttccatttttgagagctaaaaatttccatttttaacctaggtgtggtcaatctaacttgaacctaagtaaaatttgggaacaaattaaaactttttcatttataacctaggacataaatgcaaacacgagtaaaagcatgcatacttgcataaaacatgttttgacttgagtccttcatgtgcatttgaatctttgatttgcatttcataataggtctcatgaatcttaactaagatctagataaacaagtaaaccattagggcctagtgctagctagaggaagttaaaatagaaaccatacaccttaaaatatatcaacatggctaatgtcaagcctcacaaaactaatttcaacatccatctaaagacatgtcatgaacatgaaagtgaacaaataaattatatcatatagggtatattctatcttaatcatctctataagcattctcttcatttaatactaaagtaaacttatgcataaataggtaaggagcttatgacatgtgtaaggtaaactgtaattctaacatatcaatatcacctcaggttaatgagagtccaaatataacttttataaacatttacatgcatttaggaaagggaaacacatataagacataagtcttgcgaattatctaaaataattcgtgtaagataaaatcgtgggaaaattcatgtaggctctacttaacatataaaactcactgtaattttggtataatttaataactaaatttcatacctcgaataaatcagtcaaaccagtcaaataatagactaattatagttcttaatcggttaaaaccatacctaactaaaatgtgcatttaactgcatgaaagtgtataggggaaataatttattcaaatactaggtcatttatcatgaataaatataattttatcagaatttatcttctctgtttaggtctcctaaaaattcaaactaatttccaaagggcccattttctcctaattactgtgagtaatctatccaaaattttttaagtgcaaccaaagaaaatggaatctaggtatcttcaactatcatcacaaaaattcacactaatttatcctggccacaaaataaactatcgagttacaaaggaagggtaagtgaattaatcctgaaaatttgtccaaaatcacttacacccaattatctacccatccctcacacccccacctagattacaccgacctggacccacctggcagccttcttggcttacccttcccctgtgcaacttctctagccgaccagaactgagagaaagaccgagccgacagccctcgggcgcgttcgacgcgtggcctcgacgtggcagcgccgaaccgaagcttcacctcacccagctgcgtcgccactcttcacccaccatcccagtgccgatccatccgagggaggaagctccaactttccctctccacctctctttcatcgtcggccgccgaaaaggggcacgccgccgatcgccaacgagtcgtctccatccctatctgattcacgttctattatcttctctccatgccgagaaaatccttttttgactccatcttgtttcgtccactgcagcgacgggaacgcgacctcgtctacggagctctggagcgcgctccaagcgccgccgcagccgacatcgtcgccgttccgaccgctgtagaccgatccaagccgagccgtcacgccaacgccttctccttgaagtcctcctcaaaacccctcaataatcccaggcaacggcgcagcaagtgcggagatcggccaccgtcttcttcacctccggttgccatcgccattgtcgtttccgcctcctccggtgagccattgttggattactcgcgcacaaaccatccctgtgacctcacaaccctcgtgcacgccttcctttagcagctcgtcgtcccgttcgagccgtcgccgttcacccgcagaaggacgccgtcgccgggaggatgcgcgagccgttgctgtcaccaagaccccggaaaacatcaacctaacccgcggtgagtaccctagagcctggaagaccacatgcatgcatccctttgagtacatccagtctatagcacgacatgcaccaccacccgaaaacttcctctgctcggactcgccgctggcgctactccgatgtctgctgtctgagaaatgtataggaatggaatcgcaatatcatgcccttcattttctattttggtcgcaaccccaacggagtcaccgtttgtcgccgacaccggcgagcagagatgccgcccatggctgctctgctgcttatcgaatggaaaaggagacagggacctcgcttggagaatttaaacaactataaggttcattatgtaatgttttcactcaatgacatatgggcctaggactgcgggtttatttactgaaactctaggggtctttttgcatattggcctgggactgacaatgcacacctaggaacaaaatctgaaattataaaagaacagtaactaaaacttgtaaaatccatataaaattaaatatagctcattttaagatgattcaaatttctgtgaactcaccaaattgggaactttgatgttatggaacaaaacttgcactcacagtacaaatttagcctctcaaatttatccaaattaaatcacacataaagcatgcacaaaattataaaatgcatacaaaattcatttcaactcatttcagagcaaacttagtttctacagatccaccaacattttctctaaaaacaaagtaaaataaaacatctacacattctgcatcaaatgcctctaaaactattatctttaaaaataactagttttatataagctgaactttagaagttcatataaaattcatcttagatcctttttgagtaaacccaagttctgtagaatcaccaaaacatatacttccaaattataaaataaaattatatacttactgtatgataaaagcctctaaatacttatgtaagtaataaccaacatagagcaaccttaaattgtaaaatttgtagaaaattcatctttagtctaaatgaagtgaaccaaatatctatagaaccagcaaacagtgggcttcaacatattaaaataaaatatggaaccttctgtacaggttatagctctaaactttaaatttataggataggtactaatcacatagtattgattgagcaatatgtatatatataaatgtatatagaaatacactctagctataatgaaacccaaataaaacttgttagaccagtgaatgcatagttccatccccttccaccaaaacttatcaaacttaactcatataacaatttctaggttggtgtgttaagtaactaacatagaacatccctaattataaaatgtgtagtaaaataatataaactctaaaattatgaactaagattagattagttaactaaaatactcattttatacatcactagctagatgaggcaagttctggacctaaacctctaaagccatgaacctatataacactatacacccgtaacacgttataacttgtaaaatgcataaagaattcatattaactccaaaaattgtgaaaccaaatgtgttagtcttagaaaacacatatgttcactcagcaaacataaacttaataaaaatcaccttacaacagcatttcacaatagtacctaaataaatcctatactataccgatgaaacttgtaaaattcataactcccaaataaaaaaagatgaaatagaaattcttccacctaaattcattttagaccagtacctattcactgtgcacaaatcatccattttagagcattttagattttacgcatattttggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcctgcatgtcgattgtatactaacaaattaaaatggtgttaaacttgttagacaaattcctattatttgcattatcaccttaaccccacatatatccatatccatcattcctaaccttaggaacaatatgactataccactttttatatgagttttggtgacactaggttactataaagcttagccatgcttagaatggtcttccttgtcattatgggctcattacaaacatgaaaattgatttataattaatctgggcagaactttaatacttgtgattttgataaataaaatggtggaaaacatggattttaggtttaggcctcaagtggtgcacatatggtgattagttgtgtaccgatagggggagagtgtgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggaacttatgtatcgcgtgccatgctcttgcatgattattatttcacatcatgtgggtaaagtgtacaaactctgcagagttaaaactaatcgattagccgtgctcgcggtcatgagcggcgtgtggatatctattgagtgtagagttgtgtttattcttctaaatgctgaaatttaccttcaaattgtgatgagatttgagaatgatctccttgctgccatggaaggcaatgaggtgcatatttatacatgattaatgcctaccttgatgcccaatatgtcaagtactagtttgctgaaatttatttgaaagtaaacctgatttagaaatgttttatgcaaataaaacttgctttatgctaaaaagaaccatattatgccttccttggttatatgccttgcaaaagcctaagatatctacttacttaaaggactacagttagctttacgggaaatcaacactttgttgaaggtggaatgtgaatacagggacagagactatccatattaccagtagggtgttaggcttgtcttggtgcttgccagtacattatttctaataatgtactgactcttgctattgaattaatcttttgtttgcaggttttagtcttagtctttgagtgatgcgggtaatcgactgcttcttctaggacttgaacttaatggggtaaacccctagtcggtgtgcttgtggattgggtagacaagcttccgttgttctatatatttatttggccggttggccaatgtaactaaagtagatgtagtttataatcgctttcatcttatttgtgtttgctatgtataatcatgctcgagatgaaagtgtgaatctagtgcacatcctgggaactagattcacatgagtatgagttaagaatatttgagatgttgtagatctttagccatttttgtcaaagtctcctgaatgtgtaacacatctggccgccgccttcaagtggtttgacgggcacatcttaggctgaagttgactggcaggctaaaggcctagcaatgtctccaatattcttctctcgaggcattggatgtttcattatatttgtttgatgacttgaattattcacttcatccctcaaatataatggaaggtccggaaagactacgacaaatattcttcttgagtaatttagatttatcttgtgagaattatctcttggttagttcctaaatagcatacgggattattgttcattataatcaactaaaatatagttattgttttggtgagttataaacactaaagtagatattaattgcttagacgtggtgtttaggtatttgttatccagtaattgctgcgtatccacagtacgtttgaggtaggtgtagaggtggtgacagctcttgagatcacttaagtcctccctgtccggctacgtagtagagcgacattgggaacaacgggttgcctgtgtctgaagtattgcgttaggattaaagttaagctttccctagacactgtttctcactagtaaatcctctctatcctggcctatcatttgcttggtgtccttggataaactggaggaagatctaaccacaatgttcctttggattcgatatccttggaatactccgtaagggaagtgctacctcggtatatccgtgcacttgcggattttatctgtacccgtattaaaaaccagcacccatatccttcaaatccaactcacaaaaaatcatggctttgattgaagaagaccagttaaagattgaatctttaatccattcctctcacgcataaaggaaaggactatagcaaaaaaaaaacaagaagaagaagacgaaattctcactgttgctcgtgcttgcgttggcgagttgacggtgcccgcgttagtgccaggcggcttccgagttaggcatcggtcactcgaagagtactcgttggacacgcatgcgttcgagctacgagaatggtgtcgtgagcttgaactcgtggcccgcttcatcacgttgaagaaacgtcttgctctcttcttcatcacgcacacaccagcaaagaacacacaagatgatgttgcgccctaaaatcattctaaaattttatcgtctaaattatttctataaattgtaaaatgccaaaaatagccttcaacaattaaatgtcatcaagtttcaactcaaattcatgtgtgagaattttctttaagttcctcatgctaaaaaacacttaaccattttttagaattttaagagcattataaataattttagtgtaacaatatcatttctcacgttttcaaaaataaagaaaaactaaaataaagtcctgctctggctccggcccttctctccttcctggcccaaccgagccacgagcccatcagcgaccctcctctccgctctttgggctgccccctcgcgccggcctatcgcgcccaccaggctgcccgagctgcatgtgcgctgcacgcgtgcgccccccgtggggtccgcctatcggaggcgtcccctacctccagcccgaccgttcctctctctcccattgaaccctagcgccgccggtcaccttgatcgacctcctcaagttcaattcatcgcaaaaaccggtttcttgtgtagtgggcatcaattcccccaacaaatcccattcaataccgcactaaatcatcctcaattttaatccgtaatcatcatgttcaatagggagctccaccgtcactgccgtcgtttcctgtcctgtagcggtcgaccgcgagtctggagtaggtggtggcggcctccttctcctgtacacgcagctgcgtcggcagtaacggcagacgggagcttttttttttttcccgggaaaacggaacatatgggcctcggctaggggacattggtgacctcgaacttcgccttacgcctccgcggaagcattggaagggcaaaagtgggagagggtgccagagaacggaggtcaattggagcgacctgggatggccatggcgagcaccgatctgggcgtgcgaaagaaaagggccggcgactggttttactggctagcgtgattttcggccggtggccccacgtgcgcgatctcgtactgggtgatcccgcgtgcgtgcgttcgctgtcgtcggatatgatgtattggatgattttcgatcgttggatgtgtcacacgatgaataaataaaacaacttgtatagggtagaagattagccggttttcttttttaatattaagctgtaaatttgtcataatatttaaaaataagcaacaatccgtgccgatacagagatcattttagtacagatggcatccggagccagaggagtcgacggagtctcgggactagagttcctgatctggttggagatgaggaaaggatggactgcagcttcagatctggatgtggagcaaatccataggggctgcagctacagatcgacacatgaacattggagcaaaccctagtcaatggagagatacaagatgaaggggattcgagaggagaaacctacatataggtggatttgaatgatttagagtggggaggaggaagaagctagaggggatgagaagaggaaaagacttgggatgggagtgaagaaagggttatagtattatggagagtggtgactgtgaagtggttcttttccctttttttttttatccacatgaaaatttgccaatggtcattcatgttggtgaaattacttgtgccaacaaagtacccaaatttttggcgatatatgtccaaccatctggtgccaaagtgaaaatagctacccgcccaactcccaccgcgcgcgaacccattattttcactgattgcctcgttcacatcagaataatcaaattattgtgacaagttgtcaagttgtgtatccacgttaagaaaattatatttctttgatgttggtataggctcgtatggaatattagaatttccacgatagtagcctttgtacacgtacatcagtaaaattatcggccgtcaggcccagttcagttttctgtagtgtgtagcttttttagatagtggaatagaatatcccagtctttgctcaacgagctacaatcaattattacaggtagcacataaaataaaaagtttctcacataaaaaagaagacacctaccaaccaagataaggagtacgcaattattgaattctgtttgtgaatctccatccaaaattggtaaacagttgcataaccattgcctcaaaattacgacatgcaacttttaaacgctcgccctcttcattacacttttgtagcagtgcccaagacctaagccagtgcgttgccctgaaaattacctgcatatatgaaacagatggtgatttgtcaaaaatcatatcattcctactcaatcatagagcccaacatatagcagaagctcctatgagaataagtttcctattttacttgtccacccccagaagccaatcatcaaaaatatgagatatgctattaggagggtaaagactaaaagagaactgtacagctctccaaataaactttgcaaaatggcattccataaaaagatgctgaatagttccattcttcacatagaaacaaaatctcaaactcccattccagtttctccttgccaaattatctttagttaacactacccctttaagcaagtaccacataaagatcttaatcttcagaggcaagcatgttaagcttccaaagaatcttatttctcttaatataacattgtttattaaagccagatacattgaccggacaaaaaattggccattcagatgatagttccatctaaaacaatcactttattgattcaactgaatatgtacaatagaagcacacaattcatgccactttgttagattctgaccaactaaagcctttctaaaagaaacatttagcggaacagatctcataacattagcaactgaagaacttttccttcgaacaatagcatagagagatggatacctatctttaaacgccaagttacctagccatttatcttcccagaatctgacttattccccattattcagaatccaggaacccatgtttaaaaaagtattcttaactttcataagacctgaccaaaaatgagaatcaccttgtttcctatcaacttgggtaatatactgattataaagatactttcttttcaataagtcttgccaaagccctcgctcatttattaatttaaacaaccatttactaaaaaggcatttattttgtatttctaaattatggacacctaaaccaccttgatctttgggttgacaaataatatcccatcttgtaagtctgtactttttcttatgatcatccccttgccaaaagaatcttgatctataataatcaattttttgaagaacccattttggaatctcaaaaaaagatatcataaacatagctaaactagaaagaacataattaatcaaaaccagtctacccccaacagacatatgttttccctttcaactactaagtttcttctcaattctttgttcaataactttccaatctttgttactaagctttctaaaatgcattggaataccaagatatatgacaggaaaagtacctaatttacaaccaaagatagtagaatattgttcataaaagtcctttgcttagccaaaacaaaataattcacttttatgaaaatttattttcaagctagaaaacttttcaaacacagataaaatcaatttcagattcttggcttgttgtaaatcgtgctccaaaaaaatgatagtatcatcagtatattgcaaaatagataaaccatcatccaccaaatgtggaattaccccattaatggtaccaacatctttagccctcttaattagtagagctagcatatcagccactatgttaaagataatagaagacaaaggatccccttgcctgaggcctttgtaagtttgaaaattattcccaatttgatcatttactttaataccaacatgaccaccctgaacaaaagaagctatcaattgacaccatttaggagagaagcccttcattctcaacatttgttgaacaaaagaccatttaaccttatcataggctttctcaaaatcaatcttaaatattaccccgcttttatttttacgacacatttcatgaatagtttcatgaagaataacaacctcttccataatatttctcccaggaataaaagcagtttgagtaggactaattactttttgagtaacgccaattattctatttgtagcaaccttggtaaaaattttaaaactaatgttaagtaagcatataggcctatactgttgaattttcatggcctccacacacttaggaaaaagaataatagtaccaaagttaagagagaataaaggcaaagtaccattatgacaatctttaaaaagatctaacaagtcggctttaataacattccaaaacacttggtaaaactcagctggaaatccatcaggacccggagccttgttgtgttccatttggaaaattgcctctttaatctcattctcggtaaattcttgagttaaagcctcattctctaattgagatacttgagggatatcatcaattttactctcataaacctgaagatcaaaatcatctggaggaccaaataaacctttataataagtggtaatatgcaattttaaattcgcatcaccccttattaattgatcaccatcctgtaattgaaaaattcttgtttttctatgcttaccatttgcaaccaaatgaaagtacttagtattagaatctccctccaagatatctttagtcttagccctttgataccacctaatttcctcttctctcagaagcgtagataatctatttgtataatacactctaatatcaatttcctcctgagtcaaaagaatggtttccgtttttttatctagcaaatccaacttatctaataactcttttttctctttttaatagatgccgcttgtatgtttagcccatcccctcaaatgttgtcttaaacgatgaattttagcctctcaacgctccatgggagtattaccttcatcaacattagaccaaatctcttttaccatatcaacaaaaccatcccgtaatagccaacctggttcaaacttaaaactatgttgagcattacccggagacgaagaatttgtatttaaaagtaaaggagtatgatcagaaatatctctattgagagcaaaaaccgaggataaaggaaatttatgttttcactccgttgacattaaaactctatcaagtttctcatagattggatttgctagattatttgcccaagtaaaattcctacctaacataactagctctctaagactcaacccgtcaataacagcattaaaaagaaagggcaatctatcatcataattagcattgtttttctcatcagggctacgaaaaatattaaagtcaccaccaataagaattggtaatgtttcatgactacacagattaactaattcagcaagaaattggtccttaaactcattttgagccagaccataaaataaaattaaagcccattaaaattatcagctttgttgcacaaatgaaacttgatgtaaaaatccccctcatcaattaaaccaatatcagcatttagaaggttaatacctaagactaaacccctccctctaggaggtttgcaatgccataaaaactctttaccagcacaaagatttttaagtgcagtaggagtaaaatctttcttaacggtctcagataacgcaataaaatgttacatttcttttaatggaaatagagtgctaaggccctttgatcaaaaaaaaaagataacgcaataaaatacctgctgtatgtgatttctctagctattccgtgtcgtacgtcgtctggtgatcgatgtgatgatgatacgatggacggatttcgatttagtgcaaattaaaccgtccagacaagcttaatcaatatacatggagtatataggtatcaaatcgatccatatgccagcgacagcgagcgatatactggcagttttaattactactcatagccagtactgttattactgtacatgtataaatacggccgggatacagctaacctggccataaatatatatattgctgcccgtattcctgtgagatcgatatatattgctgaaaagaaaagaaataaagaatgagtcgtcatcaccagcaaatatgtatgcgtgcgtttaacttttgaattcatgtcgtttgcgcaacagaaagaaaatagtccagcaagacgatgagttgtaaaattttgtttgtatccatctacaggtgatggttggcgtcgttccgaaatcaacacgaaagagaagaaaaaggaaagaaaaaggttggcgtcattttgtagtatatacgtgtaggtgtatttgcttaactacgacgccagcatcggcctttatttcttttgagcatgtagttcgatgggaagtgttagctagctaggcatgtagacacctggcatggcatgcacagcctccgaggccagaatagttgtgctgatgatatacacacaatagatggcacgcatccacgctcgatcggttgatcgatctgccttttgagttttgtacacatccatcttttcctagcatgtatagcgaaaaagggcaagtagtaaacatgtgtacacgcgttctgaacttgaagctattagctatatatctatcttcctcacaactctccttttaattagttcttccatttccacaactactccatatttccttttttctcatttcttcgatttgtgcgtcgaactgcagctgctggtatccagccgccgcttctccgtagctactttcaggccggccgaccgagcggacaggtaaaccggtgtggttgtggcggaccaggccgtctatcatctccgtaggttgttctatttgatccatctatgcatctgtattgtattgtattttcacgcatgtatgtcttataatatcctcttatccggtcattggtcaaacagactcgcaccagctgctttcgctctcccttattaaatcttcaccggcgggtcggatcgcttttcccctttcttttggtttcagatctacacccttgtaaaaaaaattgatcccttggtaaaaaaaaattaaatcatagggacatatttagataagcactgtgtccagattaatctatgggattggtttttttttgaacggagagagttatttgattagcttggtattttctctcttcgcctcccctaaaaaagatctttcttctccttttttttctatctaaaaagaatatatcttgacaatttctgctgtttttgttttgtttgtgttcaaacgatatgtatgtttgatttttattttgttaacttttgatatactaatgatctgttccgtaggcagatttattggtcgaacaaaacttccaaatctgtttatcgaacaaatcatgaatataccaagtgttagaaaaaaaaaaccatcaaacacaagtaactcagattgaagttataaaaggcaagagcactatatcaagtggtaaattaaacacggtatcatccggttgcataaatatcatcattaaatctgtacttggcaggggcgtgcgagcgagacatggagaacgcagctggtggaagaagggcacaacaaacgcaagtgactgaggagaggcagaagaagatgaagcacaaggcggctcaggagattgctgatggcagcagcactagtgacacagtacatggtgctgctgatggtgtctgcttcccgtgtggtacaagtacagctacagcccacctcttgcaacccaagcactcacagccacagcacgaggtaaatatgcatgaccctgcttttaaaatcaattaatccttgtactccatatatatgccccagttaattatatttatatatatatatatacatattacaaaacagagggagtactactttaattagcatgctagttaatttcttcaagagacaatatataatatactacctccttcccaacatcaaattttaaaaaagggacgaggcatgactgaaaaaataaaacaaaaaagtagtcaaatatatactgcgatgacacgaatgttgtcaagctaaggtagggagcgtccaagcaaaaacaaaaaagatgtaatatagcaaatttaagtaaataataaaagcaaaggtgtggtttttttggggggagggggttgcggcggtacccaaccgtgtaaggaatatattaaggtaagaatataccaagtataagttaaatttggttccctcaagtataggtctgatctatttcattcgccttaactgtaaatccgggttgatgcctccaactactaaaagctagcaacacaactccctcagctgtttttgacagtggtttcgctgacatggcgtccacgtggtagcctagtcatcaaagaaatttaaaaatatacttgggccccaatgtcagtgactacctcacttattcttcctccaccgcacccttctctcctctctctctccctctctctccctctctctctctctccacgagcagcaccagtgaggtcgcgacaacaggtgctgcgtgagggccatgtgggtctgggcatctggccatgctctgccacagggcatagctcccgtggagcgccagtcaaggtcaagctcagtggccatggctatggcttaggagaagtacccgtcatccttgtgcaaccgacaacaggagtctgggccgaactcatggaggagcgagaactcggcgtcgagcaagaacccatcccgccgcgcaacgccatacagctgcacacttcgttggtgttctccacctccttgggtcgcacgtacgtcaaagcagttgcactagtgccactcatgtcgactacgttggggacaccgacgaaaagcgtggccatattgctcatcccctgcacccatgcgacggggttgaagtaccagtcgccaaagaagttgtttttgtcgttcatcatcgcaacactaactagactcgctaacgtggttgtcttggatcaccatggcatgacacagttcttgcctaacctgtccaccatggccccaaatgactcgatcatcgagaggtcgaggaaccccgagttgttcgccttgacgccagtgatagtttcagcatggttgtggaccaggagcgacatccaaacgttgagtgacaacagtgtcgggttggtcgccagcacgatcaagggtaggtatgtccacatgaggaaccccaaggcaagcaccttcttggtgatggtgtccaccggttgcatcccaagcccctctgtcaccaccagcttcaagtgtgatgactagttgacgcaagccaacttcacttgccgccccgcctcatcgacgatccaccgcgatgacgttaatgatgcgatggacattgttgtctctctggctgtagtaaaagaagagactagggagtgaggagtgagtggcaaaagaactttgatgctgctcatggtcgtggagagagagaggggagtggggagtggagaaagaagataagatagtgacttacatatgggccccatatctattgtttaatttgtctgatgactgggctgccatgtcgacgtaggggtgggcaaaaacctcaaaatcgatcaccaaaccaaaacatcggtttttttagagttcggctggtgatgtggtttttgttttgttctagttctggtgttcggtggtttcttcggtcttcatctgctgtgaactgagctctccaacgaaactgaagttgtcggatgcaggagtggttcaagcgaattggcctcctcctcatttcacacgattttcgaatgtgagtatagtgtttcattcttgtgagcttgggcggtggagcccatagcattcctcggctatgctccatgcatttgcatgctgtggtaccatgccttgcttcaagtgatgtgcgttgagaggatgtttgatcgatgggtgggtttagttggtaaaaaccgtatccaaaaaaacaaaccaattttgtttggtcttttttactcggtttttgttttattcgtactttctttggttgtcattctacggaaaccgatctttcataaaaccaatatgaaaccgacccgattaaactggaaaaaacaaacacccagcccatagtggatgccacattagcgaaaactgcctcaaaacagtcgagggagttgttttgccttttagtagttggaggagtcgatatacccagctttgcagttgatggatacaaattatatcttacctacatttgagagggtcaaattggacttttcctatgatgataccctagttgggttttaatttaggcccccttcaattggctactcaaattaaacaagagataactagctacaagagggttagctagctaggggtgcagttagtttagtctaccgtcaaactgtatgaaggatgcaaaaacgatgggtcaggaagaaactagatgtgtctgcaacaacagatgccatatatgtatgatttatctgcccatacgacatacgttggtggtgaggatcgatacatagctctaggtatccatccaagaaatatatacttgaggaggccaatgtgaaaaaaaaaaactttcgaaagcagggattattttgctatttggttaatactaaaatagtaaaagttaaaaggcccttattatgattattgtaaagctggagggggccatgaccccctctttatctctacaaagcttcggctttgttagtcacccccattcatttatccaaaaaagactcatagaagtacaaatgtacctacggaaacaggttacccatacttggtacgacttagtacacgtaacacaccttccaacaatggccacgctagccaaattacgggaaaaccaaatgggagcacataagtcgaaggacaacagcttgttttgacattgttgcaattaagtcaattggtgatggtagatgcaaagctcatatctcgactggcactagtgccatgagctctatatgtaaaccaactattctctctcctatctctgctactagcacggaaggtcaatacaagatatagcaggcgtataatggacgggcctaacataagttggtagtttgtcaaaagacgccgcaatgacacatgggctaacaagagagatattaaaacgtgtgggtgttcaagcacactcctagtgagtcacgtgccttgagtaagccatcaccacatcctgtgacgacgctcaagcatgatgcctcggagttaagcgtgcaagtcaaccatgtaattaacatgacatgtaatcgattagtgctaaatatggaactaaataagtaaatatatgttagtgcaatttgttaattcctataccgttgtaagattttgggtgaaactttggaagcacgtgtgtccaatcacactcatgttgatatatcggatgcaatatagcaaatgtgtatgacactgacgaccatcacaatgtttcttaagtgaggttccttcaaattatccaaattaattttatgggttgtttttgtctggaaaattgtttgtaacacaggcaacactcaatattggccacactgaccaatttaatgtttgagtaaagaagaagggaatgagcaaatttatagaacaaatgcttcttccccttcacattcaactcatttgtatcgttggatgcaaaagctctcatcttgaccattggcaaagtcatgagttatttttatcaaccatgtattccctcttcctcctaccactagagaggtcagagtatcaaactgctagatatagaaagcatactcaactactgccatgcatagacatgcttggtgcaagttgacagttcgagcatgtcacaattgcacatggtctaacaagagcagattacaatatacaggcgttcgattacatctccggcgagtcatgcaatttgagtatgccatcacaatgtttcgtcgtgatgctcaacaaatgatgccttggagttaccatgatcttgtgttagaacaaatctatgccaaaaatagaaaagtaaataactaaataagaatggatgtattgtgataagaataccatcacaaaatttcaggtgaaatgtaaaaaccagtagcgtaaagtcacattcatgttgatctatcagatgcaatacaagatgtgtatgctatcgaatgacattaatcccaatatccgttaagtggggttccttcaaatgatccaaattctatgagctgtaggaaaactcttgtaacttatgtaactcgtccttgccaacattagtttgtttgcctgcatgccacactcgatattgtccacaatgaccaatttattattcgggtaaaccagatgagagtgagcactcaaagaaaaagtgactcttccctccttcgtattcaactcatttgtgtgtcatcggacacaaagctgatctcatcttggccacccgcagaatcaaaagctctctttgtcgaccatgtatcccctctccctcctcctattaccaccatgagaggtcagagtatcaaactactgtatctagcaagcatacctaactgtagacatagccatgcttagtgcaaaccaattgttaagcagagcacatcacaacaacacatgggctaacaagagcaatattacaacatgcaagcattcaagccaacctccgttgagtcatgtgggctgagtatgccatcgtaacaatctaccacaatgctcaagcataatgtctcggagttaagcaaaatcaaccatatcattgccacgatcttgtttagcactgatcagtgtgaaatatgaaatgaattaaaatagtaaatatgggtgggtgcatcatgataagagtatatacttgattactgtacaattccacgttttcagataaaatgttagaagcacatgcctatccaagtcacacttatgtcgctatatccgatgcaatatggtggatgtatatgccacgaggaccataaatcccaatatttattaagtgagtttattttgaccatccaaattctatgagtgtattttgtaggaaacaatttgtaactcatccttctaacataagtttgtttccatacacgccgcacttgatataggggccaccaaccgattgaatatgcggataaactagatgagaatgagcatactcaaagaataagtgcatcttcctcttcacatgcaactcatttatgtcattggacgaagctctaatcttgaccaccagcgaagtcaagagctctctttgttgaccgtattcccccaccctcttcctattaccattgtgaaagagcgaagtgtcaaactaatagatatatagtacacatgtactaaactaaggccatatatatgccacaagtcatcagttaggaaaagcacgtcgtattaatacataggctaacaagagcattgttatggcatataggcattagagcacacctataaggagttaatgttggctgattgatccatcacaatgtgctctaatgttgtgttaccacaataccatagaaataggcaaattgaccatattatcacaacaatcataggtgattgtagaccaatgctaaatatgcattaaatgatagtgcaaatgatcatgcaataattctcattgattgaggaaataatacataaagcta

SEQ ID NO: 64480 - DNA, 1829 bp, Oryza sativa
atttttgggtctaaaatggatggagtccatggatttcaattggattcatccccaaatagcagatgatgtcgtctcagacacagaggcactccatcaccaccgccctcggccgcctcgacctcgccgcgcagccgcgtttggatgtccggccgccgcactaggttcgccgtcggagagcttccgccgccgccgcccgccgccttctggaaggtggagaagacgcgggcgcgggggaggaagcggagggaactcctgctgcacggcgcgcatggcgccgacgagctcgccgtccacgccgtcgccgaaccacgtggccaagttgagcgcgaacagtgcggcgtacaggcagcacgacgagcagagcggcgccaagaaggcggcgtgggtggtgtcgcccaacggccaagtgaagcgagaaaaggcggtggaagcggcgcgcggcgagggagctgcagccggagccggagaagaagaagaaaagcggatcgacttggccgtgctccgttgccctatctgcctccttcctagctgttcatccaatccatctgacattcttcttcttgttgttgttctttcattcgattcgtgagggctcggctagtggcaatttcttggcgtgcagtccgcggcggggcacttggcgtgcagcagctgccatggcgacgtcccggcaagcagtgccacgcgtgcggcggcgccgccaagatcctgtgccccaacgacctgttcggctgctggagctacgtcgcctattacgacgtcgccggccaccagcgcgcctgcccgcacgcgccctgctcctgctcggagtcgcgctgcgacttcctcggctcgccgccgatgctcctcgcccacctcgtcgccgacatgtggttggtgtcgatttggaatggggtgaaatggactggaaaagtgaactgaatccatatagatgaaatgggttgggttgatttgggttgaaatatgatatgggttggattggtttggattctaagagaagacaaatgaattagagtggtttggacttgtgtagcttactgctttggtttgggctggttgtggattggatttcaaaccattggcaggcttccacgcatgcatgtctctcttgtttggtttccctccatgtactttgatcgcaggagtactaatttgtggttgataataactttgatagtgtgtccgctcttgccgcgttgaaaccaaagagttagagaaatcctatatatttatataaagttcatttctacagtggttattaatgctatttatatcttttcttattaagccacatcatctaaattgtttctttatccctatgtagttgagataggtatattgttcaaattatctctcacgttttcttttgttattaagccgtatcacctttgttttatatttaagatgatgtacttagccacatcactattgttgtgattttaaatggccaatctagtttaaattattataaataacatcctaattgtatatagttttttttctgcagtcgataaagatgaaattatataatgttatgcctactgattatatgttatttctattattactgtataaaacttacgcagcaacccgtgagtttcatgaagtctgatttcactattgcgtagctttcatccgcatgattactaatggtgagttaataaattaaccatgcagcggctgctctgaacacgatactagggagatggggcaagaaggcatcaccggagtggaacatcagcggtgagctctgcagcggtttcgcagctgataaaaccgattgggataactaccgcgacatcaacccgttcatcaagtgcgattgcaca

SEQ ID NO: 64481 - DNA, 5393 bp, Oryza sativa
cactttgcatgtcggcctggtaatacaccaacgcaatttgcatatcagcttgataatatgccaatgctctacttgaatagaacacagtcagttccacaaataaacattgatatccaagtcacatatcaacacctaatcagcaaatcctgatacggatctttttccatggaatatagaatcataaatcattgaataggttaaaagggcagacatttataagctatttcaactattaggattgctctagctcccaagcgttagaaaatgcatgcatgggatagtcatatggcatatttcacctattccatggttcataaagaataccagctagagattttatttaagattgggaaaaaatgaactaacaacgcattttactgcccaagtaggaagcactcaaaatggtgtgctatgcatcggttattgattatatcacacacatcttactggattctgacgaaaaatttttattcaagctccaaataggtacactacttgcaaagggaagttagcattgatgattggtcctagaaaattttttataacacgcaaagtacggaacttagcagtttgacatactataaacaggcattaccctattacattgaacaaatgcacatgacttgtgacatgaatacacaaagttaaatatataaataagtgtgccgctgcagcaaatcatcggacgtcaatgaagccccatcagcctcaaaatggcacaataataccaggctcctgcacagcatattatcatagagatacatccaaaacatatccataaacttgaaccccaacaagcagactgtgaccctacctgattcaactaagaacagaacaaccatttctcagtacatttacaacacaaaccgtgcatgcgatctctctaacaacatcagctagcgattccatatccgaacaatcaaatcactccaaaaaaaaaactgtactattctattccatccacctatacccctctattccatccatctcgagtccacatatatacagtattttcggatcaaacgcgtcaaaaacacgccagggaagaaaggattcccctccctcaaacaatccagcaccaaaacgcgccgtctcgccgccaagcattacgaatccgacgcgctaccacctcatcccccgatcaaaacccaccaaacggaatacgagaacacgaaacccccccccccccccccggatctacctgctgctgcgggggcggaggcggaggcggcggcgcgggcatctggacccccgccttggcgcgcttgctgagcgggccgccgtcctcttcgccgccatgcagcatctcgtccgcctccagcttcaccgtagcccccgccgccgacgccgccgccatggccggctcggccggccgcttcccggagctcggcagctgcaccatgggagggatcacccccggaaaccctaaccctaaccctaaccctaactccccccaaaccgacgccgccgccgccgccgccggccgaatcgaagtcgaaatcgaagcagaaggcgaacgcgaggcgaagcgaagcgaaatcgaatcgaagtgattcgagaggaagggaagcgaggaggaggaggaggaggtgatggcctttggggagagaaaagggtccaaaaataggcgcccacgcggggtgcgcagagaggcggcgcaccagtggatgacaggtggggcccacgcggagtgggcccggcgtgtcggcggcgggtggtgcggatctcggtgtggataaagtggcggggccggggggcgtggaggtggaggtgatggtggtggtggacgggtgtcagtggctagaatggatgacaggtgggggccactgcgttgatggtgtgtgagggctttggctttcacgtgcaaaacgttttcccacccaacctactctcgtatacggcactactactctactggtcctctacatcctatacatcctagagtatttactaccaccgtactacactactactagcatgacaaagtcgtcgtgggttcattttatattatagatatgtaacaagtatttaaggtatataatggatttaataaaataataaaaatatatatgtaacggatatttcatacatctaaaggattagaatctagctgtcgtctcgggttgcctcccgcggggtaactacagaggcgcctaaccctagttgtcatcaccattcccaaaatcttctcatcgttgtcactggcgccgcctccgacggggctatggcgatgggccgctctctctccatccaaggtaagattaggcatatcatagttctcatcaccaaaggcgatagaatggataaattgaattaggaaatggtttgttttgtcgccgttgtcgtcatggcctttctccgatgatgttccgtcgcctttcattgccagatgatttgatgaagggcgtaatgagattgaatcaactattagtgggttgtgaggtgtcaccgccgctatcaccgaggtcaacaactctttagatggggtggcgttttgttcatattttgaccgctaagggcccctttgattcacatgataggaaaaatataggaataggaaaacacaggaatcgaagtagtaggtttctcaaatcctacaggaatcaacaaacacatgaaagacaataggagtccttttatagtgctgtgagaaaaacaaaggaaagttcacaaagaggtcatacctcttgctatttttcgtatgaaatgcgaagcataggaatacaatcatatggaaagtttactttctttcctatgaatcaaaaggacatgtaggaaataaatccatagaaatttgaatcctataaaagtcctttgccaatcatatgaatcaaaggggccctaaaggggcttggtgcctcatagtcatgtcaatctgaacaataatcaagaggagatccgatcgactggtgaaggggcgtggtggcgctttcttgtcaagctggcatgatgggttctatgtagatatcgcatatgattggttgggatacctattgggtgtatgcctcactacacttggtaggggctatgggtaggatacttggggaaccaccattgtcattgttcctatttgggacagcaaattgatgataggtggagtcagaagattcctaaataggcttatttcattcatcaatgaggtggatagatgaggtcagtgctttgcaaatggtgttcaccctttgattttgcttggttttagcctttggtgatcggatgacagggactacatagatggtgaccgccatttggatcatgatgatcggggcatgaccgctgaattgagctcgccacaatcaaatggcaacatgaggtacaattggcggaggctttagggtgaaaaccccgatgtggtcatttggatttgacaacgtagtgtttgttttgtcattcctttgttgaaggtgtcgtttcagattttggatgaaaatctagaccagacttaatatgacaatggtacacattcgtcggatccttcttgaaggcgttcttttggattagttgtaaacttttcatactcattttggtttgtactagagtgagcttccacagaactgcatgatttgttctcgatgtccttttttttctatttctaggccatgtgcatcttggtagatgcaaaggtcgagtgtaattttgtttattaatgaaatcttcccattatataaaaaaggatttgaatctatacatatgatgggtattttaggtaatcaaaaggatttgacaatacaattggataaatccgaaatacagcttgtagatgtcatcattgtcgttggtcatcctcgctcgtatattgggcaacctctctttaatttatatctagtggtttataaagtgttataccaatgtgaagggggaacaaaagggtgaatcttcaaatatgcaaagtcttacacgggcaattcacaaaatgtattgaggagacgctgcgtggggtaaggctaaatttatggcgcatgttctagatccaacggtctacaatcttgttttgaaaattttcacataggtatagatttgcattacatatttcccccctaatacgcaatggacatttcaggcgttgaaatgatttggcagtacaatgagaaataaatatattatataatggtcatttcaggcattcaattgatttgggaatacaacgagaaaaatctatattatataatggttatttgaggcattcaatggatttggcaatacaataagaaaaatatatgaacttgcttgttatgttacatgatctaaacaaaattttaggttgttattaggtctaaaatctgtttaacgagatatagttttgatttttttaaaaaaaaaacagaatggctccaatggatatatggggaagagtgtctgacaaaaaaacctttttagtccatgacaactcatagttaagagtgcatctaaaaaaactatagttaagaatgattgcatatatctgaaaaaggtttaaatttgacttcgagttttaagtggttttaccgccccattgtttcgcttatttctcgaataagcgaaacgacatatttgcaaacgaaaaataatttgtgaataaattttttatatatgtgtttttagcgatgtaaaagcaaaagctaaaaaataaacttcgatgaaataaccccaaaatcaactccaaatttaaggttgaaaattaaaattttggctaataagcataagcataagcaaaaagataaggccgtgattccaatcaaaatcaatatatctacctagcctgaaattcctgcttctaagaaagaaatcatataattgttttagcatccaccaaactgcttgcacaccgttcacctgttcatgaaaacctctggttcactggactatactaatttctcttcttccatcctgcaagcatgcagcagtagagcaggaagtgcaggactacctagttggagaagggaaaatgcttaccttaatgaggaagataaattcacagttggtaagaccataagtcgaaaattgctggagcagttcaaacatcccaagatcgaaatttcgggcattcgatttttgtcaaaggaaaatgttctgagtacaactgttgagtatctaatgtgctgccgtaaaatgaatgaatatggcacaaacaacaaaaaaacgtaaaactaatggtgtgattttctccttttctatatatcattttcaatcttgtcctgaaatgaatccatgcatataacctatcaactcctgttggcaagcagtgaagcctcgtcatcgtcgttttcgacaacgtcctgatttttgcattcttggtgcaaactaccggtgctcgatttcccatccactgtaagagaggttaactcaacattgtccatttgatattgggcagcatcatcctcaggtagcaagtcacctggaaggagattagagtt

SEQ ID NO: 64482 - DNA, 2127 bp, Oryza sativa
aatagctctcacgaacaagcaactcggattcactttccactattctcttcatgtcgttattatttagcattcaaagtattcctttacacattcaaccctgacgtattctttttagatttctcttatcaatcacctttcgaacgttgtcaaccaagtactcttccgaaataatcctcatagaacttgtttttattacacatgtctcccttattacatgaatacaaggcactgtcttaaacaaaaagggaaggtgcttaacatcggtacattgtttccactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagttgtccgtctgggaacgatcgttctgactaggagttggaattggtggttggaaatccttgctaacattggcatcagtggtaccgtagttgctatcacaattggagtctttctcagtgtcaaaattgcacgcttgattcgagtggtcactaatggggcaagaaccatggttgttggtggtatcatcaccattagtattgctagggttgttgtctgtattgcgtccgtcttcttggggcaggaactcttgatgcacaacagaagatccggtgatctgaagtggctcagtgcgctgtctttggttaccacatggaattactgggatgttgacaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgattgtgcgcaaccaatcactggcttccataggatcgacggcaatggcaaaggttggaagccccgttttgagaaattctgataacttgcactggtgcttgactgtaagggcttgaacgtttgtttcccctgctgggctgttcccattctgtgatttttgaaaggctgttgccaacatgtcggtttggttaaccacaactttggattagctctggtgaggtttcggtgatgcttttctcattcccattggcttgggttcttgagtcatcggatccatcattcccgtagcctttgttaccaatgttatccatctgtcacaaggtagaggttgagaggggaagcatacaaggaaagaatagaccagaactagggacaagaccttaaaggaactaactctttttgttgatgtgttgtttgtttcgcttattctgcaggttgattaagcaaacaacctagcatggttacatcacctcccaccgatgcaaaccacgcgctacacacacaagcaagaaacacacgactaacaacactaccctatagggcggcttaggttctgcgactggttctccaagatcttagcttcagcttcacggctggcttcactgcttcctacactttgctagcggatcctgcagtcttccggagcttcggcaaacaactgacgacatcttcttcttcgcaaaactgaccatctagtactagttgaaatccgaagaaggaagaagggagtaaaccttttgcaaatagcattagggggaggaaaaaaaggaactttcgcaaatagttttatttataacatatgtccttaagttttatccacttggcttatcctacagtcgagatggcttttataccaacttgtcgcgaccgggaaaattg

SEQ ID NO: 64483 - DNA, 527 bp, Oryza sativa
tgattatattctgatgaaaaaaaaatatgtttcagtttattaatactcaatgtttcatacgtgatagcaacatgtttcgacgtgtgtctttactgtgtttcagaaaaaaaaaaagttaatgtttcagtgactaaattttttcaccgtgtataacttaatgtttcactggtggtcaactacaacattttgaccgaccgattttttttacagaagcaggtgcccgattcggaggttcctccgtcatatggatcggagttcggtgcaaagcccactttctatgtgagctaacaagcctctttttatgatatgtattactccctccgttcccttttaatcgtcgtattgtaaaaaaatgataattccattttgaaagtcgcattacggtggggaggcagtgaaaatcctgggaaggacgttaatgacacttcctaccgaacacttgttggcgaaaaaatcgaacacaccggcctaggagatctgcttagctccagtgcaggtccaaaggttggtgagatgtgggcgtgcca

SEQ ID NO: 64484 - DNA, 2743 bp, Oryza sativa
aatgacattcgaaattaaatgcacatttaaaataaaagaagaatttaaatattttatcaacatgctcaaagggattgtttgggacatgtgtgacatgccttacaataatcaattaaacaatatataaaaaggatggaaactacaagctaacatgcaaaacgagaaaaaagactaataaaaaccaaataaacaatacataaaaagtaaacaaacatttagagctttattttagatgaattatgaactgcctcatttcgacttcatatgaattagtaatgaattttacaagatttaattcaactaaagcctatttaaaaggattaaatagatttattacataatttataattattttaaagaagaaaaagataaattatgatgtcatcagcaatcagtccaccgtagagtaggtccacagagattgaccacatgttcactgagatggacaaccgagattgatcttgaccaagagttaaccaagagttaaccaagatctgacggctcaaaccgattcaatctagggtttagatggaaccacgtggcaacatgttgacgtgaaatttgtcgcacacgaaggcctgagagatccacatagctcgtcgtatcaatcgggtgtagggcgtggcggttagtttgatcgtacaattaagaagatagatagatggattgtataagatcaaagagccgatcagccaataggctgatgtgatgtagcaaggctagccgatgtatataaggttttcatcaatcgtcaataaaccattcctaatcaaagataatcttgatagatcagacctaattaatcgagacggtatgatattgaagttgataaagagatatttaactattgattatacaagtttgagtataagacgatacaacacttagaagtagtaacaagataactaattggctagaactctaataaaatgttgcataaaaacttatcggcttagtagaatataattacatattagcacaatctaataaatcaaacctaaacgagacagtataagattgaagatgataaaaaatgggataattgcttatttgaccctgttttgaagcctaacttctaatctgactatgtttttcttagtttgcttatttgacttttttaaattgaacactccgtctgaccctctttccactacatcattagggtttcttctagaaaaagaaaaaaaatctatttactatttaaactgaccaaaataccatcaaggcacttcaaccctatccatcccaccttgtctctctcatctcttacaagcggcacatggagaaatggatctgcggtggcggcggtgcgtcgagggagtggctagcagcaccgccgatgcgtggaggtagggagcagcagcgtcggcagcgcatggggaagcggcggctgccgcacggatagggaggtcggcgcaaacgccattgcgcgacggagcggccgcggcatcacgcgatgcgtgtaggtatctcggaattcccgtgtcgcatcagcggccgaccgcggcagaagtggaggaggatggagcgtttcgttgacgacctactcaggtctctcaagaagaacgccacggtgggtgcgccgacgaccatggtgaacgtgttcggattattatcgagatattgatctggctactacttggataaccttgatgagatattgattatcagagcacttgattaatttgctgcgcctagacgtttctctacaagtgaagggggcatgcaagagtataagaattccctcgcgagttcattcgatgggccgtttaattcgcttgtggaggcatcggtttgtccgcagcggcgctgtcgcggggagcagtggcgtgcaaagggtggtcggcggcggcacccagcatcaacctccagctactgtgtattaaatttgtcaaattgattctgatttgttaaaagatccatttgtatgaatgtttggatacaagagggccaaataagcaagggcaaaagggactatttgcctcttatttaacagtgttaacccgccttaacggaacagggtcagacggttcatttgattttgatgaacagggtcaaataagcaaactgaaaattgtagggtcaaattagtagttatgcttttaaacatggtcaaataagcaattgcccctaaaaaacctatttatccgataaatctacacagacgtgatggatataacaaatctatctaaaacaatagtataattagagaaatatcaactaaatcagaatatcggacctaaccaagaaagtcctaactaagtcgatgcaactctaaacggcaatgcagttaaagatagaatcaatatatcggatatgtaatgcttgcgtcaacccaaaaagaatacctgacttaatcgagaaagttcttgccacggcgatacatgaaaagttgatagaaattacttcctcattggagatcaaaaccaatgcagcccaactcaaagtaagaacttgctagaacaaaaggttgcaatgcgccgaaagtaattgtattaatatgtggagaaagtttacaaagaccctgtggtacatatttatctcctcaggttgatgcaagtcctaatcagacaagacataggtttgctaaacataaaaggaaaaaatacaagtcttaatcagacattagataaaacttcctaaagattaaaggaaagttactaaatcaacagatagaattaatatgccatgccatggtcttcaccatcctttttgaattcggtatcttctggatagacttcca

SEQ ID NO: 64485 - DNA, 4213 bp, Oryza sativa
tgtgtaagttgcattccaaataaactggcctgagccctgagattgagaatgggccacacctgctagcaggctatcagcaggagaaatctcactctcaaaaccgagacaaagagagagaaaaaaaaaagaaaacataggcaactcaaaacttctgaaccaattgcgttccatgtaaaatatcaacataccatgacttttgactactttttattgaaacaacaaagtgtaaaagatgtgtgtgtagcatcctgatgtttgaatcacacggaaactctgaaactgaacagcccactctataataatctgtatccttcggcatatcacccacacaacctgatcttcagcaacaacgcatcatctcgggcaatctctgctgcgatcatttcagcccccatcaatggcaatactggcggtaccagcagcacctggagaacccgacgacgccatcatcggcggtgccgcggctgtgcagccaccagagaaggttggtcagggagttgccatcgtcgtgccccgtcagcgccctcgtcttctgcaatgccgattccttattgtagatcccctccagggcgtacacgaagcccttccacccttctccgaccccttcccttgacaatgccggcattgtccagtccaccagctccttgacgaagctgatgtccgggaacagcgcctcgctgatcggcaggacaggcagcagctggatccccagcctgcattccttccactccggtggagcgaaccagaggccactgtccctcttgttcgcccacaggacgccgacgacacggttgttgccggtgaaatcgtcttcgtagatggtgtcaccttcacggacatgccaccatgtctgtgctgcaagcatctccaatgcggtcaatgtcgcgccgatggagacaaggtgagtatccccatagctcaatccgagaagcgcagcggagtagtacgcattcacggcctcgctagtgctctcctggttgcgcccatccgcaaattctgtcaaacctccggcccaggaatggagcttccagagatcaaacatcctcaatcttgtgtagcttgcgccgtgtttccgcgacaatgtcatgaaatctgcaaccatggagtaggcctggggcatgtacttcctcccccaggagggatcaatcttggcaagcacagcaatggcgtacaagaagtaccccaaatggtagtggtgatcattgtaaatgccgaagccgaaatcggcgccggtgtccttggatccctgcaatgtgacaaggccaccccatttgggttcatagaggaatccattgccctggaagctgccatccagccatggcgtgacggtggccttcaagaatcgctgcaccgccgggatgacgtcagggcagccgacctcctcggcgattacggcgaacctcgccgccctggcgatcgccttgccgtagaagtaggaggaggtggtcgtgatggagctggaagcaagggcatccacatccttgcgcagcgcggcggcgacctcgcccaccccgtcgtcgctgatgccccgcatcgagtgccatgtgggggacaccggatcggtccggagaacccaagaatcgccgacgacgccgaccatgtcgccgtcgatactccggtacctgaaatcgtcgagcacccggacgcagcaatcctcggagaggaggcggaggtggaggggatgggcgagcatgaggaggtctccccacccttgcttgcgccaggtgtactcgacgcagaaggggcggttcagcgaggcctcgccggcggtggggaagcaccggctgtactgatcaagaaccgcctccatggacgggtccggcaggtaggcgacccggatgacgccggagaagccgggggccgacagctgcgtgacgctggactgcgcgaggcggatcggcgcggacgcgtagaggaggaaggtctggccgctgttcatccggagccgccacttggtgagcgcgtcgtcgcaggaggccacctcgatgaaggcgtggacggacgcgacggagatgtcgacggggcccgcggcgtcggcggtggcgacggtgacaaaggggcagcccctgacgaggaacgccctgagcgacggcgagacgtcgagggtgactgagaggtcgtcgaacgcggcgacccggtgcctctgccccgccgcggccgccgcggcgtcggacgccgcggagacggtcaggtcctcgacgaacgtctggatgacgaacgacggggagtggttccgcgccgggtagcacagggtgagcgcggcggcggcggagcggaccgagtacgggtggatgtactccggctggtcgccgttcttgagcacgaagttctggaagaaggagttggtggggagcggcgacgagagcagcgccggcgcgaagaacctggccgggtccgggaccaccgtcgacgccgcctgcgggaacgcgtcccgccctcccgggaacggcggcggcgggcgtccgtgcggcatgccgggcagcgccggtggaggaggctggatccccggcggcggcgggggcggcggcggcgaggggttggtgggcttgggcttgaaagggggcttggagaggaagcgggtgagagtgcggcccagcttcctcttccacctcctcatcgcctcgctatatatacaaatcttggctagattttgattcaaatttgatttgatttgattttgaactgttcttttttttccctttacagtaactcaatttccctgcatttccggaatttcctgtgctgggtttgacttggtttccttcgcccttaattttctgcctctgttttttttttggaattttgtgccaaaatttctaaggagtatttatttttaatttgggatgggcgtgcacgcgtgccacgtgagcgactatttcatcaaactttaatcaattttccgcctatctggggtcgcaataaatgacaccgtgtcaactctccgcgtctcgcctctcgcgtgctagcgcgtcggcgtcgctgcttctttccttcctcctgacctgagagcgatgattagtcgctaagtaaacgaaacaatttgatgcaaaaaaaaaaagaagaagaagaaaatggatggccatgagcgcatgatggaggagaaagtgtaagcaaagacaagattattttgtagtactccactttgcagtaaaaaaaaaactagaactccagcaataattgaatgtactaagactgaaagctcaacaacaactggctgtactataaaatgctaataataatctaacaatcttaagagctaagatcatggaggaaaaaagcaatatttatgctaataatgcatcgatttaattaattaccctggcctaacctgacgcaagtctcgaagtagagttagtttgatggagtggttgttggttggttggttgcgactgcgtgaagctggaagcgacgaagcgagcgaggcaggtgatctgatcgctactgcatcatggatgggttcagatatgggagaggcaggaaggatgcaagcaagggcaaggcgtagcttgtatagtttgtgtgttgccccgtgccgtaaggctggcaccggcgagatggggagacgacacaagcaaaggatggccttgccttgccggcggtcgcatgctttgcttgctacgcgaggcttgagaacaacacggttattgggcttcgtttcgttggacgccgccgcaaggaagggagacggggaaattgtggatgggattagcggttcctggagtgaataaattttagcgcaccatcatagttttttagccggtgtttactgtttactgttcagggggtgtttaggtggtgtttggatccagagactaaactttactccctgtcacatcgaatgtttgaacattaatttggagtattaaacatagactacttgcaaaatatcgacgtttgatgtcgcgattccggtatttgtgtagtatggggatcgttggtactatgatatatgcgagattgtaataaaagagatggagacaaggatttttatacaggttcgggcccctgaattgtcaggtaataaccctactcctgttggccgaagccgatcgttgctcttattcaccataatcacaccagtataatatttagggtagcctatctaactgttattgacttggcggtctgaagtgttgactcatagtcgacaacagggtagtcttcctcctcgagttcatgctcggcgagatcagagacagcgctagatccctat

SEQ ID NO: 64486 - DNA, 17942 bp, Oryza sativa
caggactcgtcgggtttgccacaaggatcgatttattgcgtcatcatcgcagctccagtggccgccgtagtccccgtcctcaacacggtcgctggcaccgccaccgtcgccagccccaccatcgcctagggttagggtttgagactgggaaatcgggttggggagggagatggacagctgggcgcaggggtagattgatcttttaaaaaattatttgacctctttgtctcggaaactataaaatattgcctccggtgtttcacagccaatttcacaaatttcgtagtgtccgttggcaaaaccaagattttacgatgtctcaccgccaattacacgattttcgggtgtcctataccaaattttgcctacttaataagttattcccctcgtggtctctcgtggagtactggagtggtgggctcacctcacctgcgatggcgaaatgattggtgggtgggtggtacggctgtgtgtgtgtttttggtcgctcgccggcggaagcaaaagaggaatttttttttcgcgggaagaaaaggaggaatcttggggcatcatcggcgatggggacgtgcgacttggcaattctttttttcatttttcaattctactcgctttgtaaaaaaaaaaacttaacttctaaaatttaaattttatccaaaaaaaatacaacctctatcatcctatctacccttagcatataaaataagggtgtgtttggttgggtggatgagtctggatgggagatggccgccggattttctgtggtgtttggttggagggcaaggtggatggggcggcccggaatagggaatattctctcgatatgctggatgagtgcatccggccgatttggctggatgaagccattcagttttggtctgggtgatgtgtcttattctgattaggtgtggttagtttgattttctgttaagcaagctccaaatgatttttttctcctaaaccgtctatctaatttatgatttgattacaccattatatttgttataattaaatattaaaaacaagatctcggatgattatattttgataaaaaaatatatatgacaaatgggtcccactaacttatggctttttccatccatgctatatccctgcaaccaaacaagaaattggattgccttatccatacaaatcaaacaaaaaattggattgccatatccaacaaaatatggatggccatatcccatccatgcatgtccgtgaaccaaacacaccctaagatgttttatcacttcaatacattttacttcatccgtttcatattataagattttataacattatccatattcatatatatagtaatgaatctagccatatatgtgtacataaattcattaacatctatatgaatatgggcaaagctagaaagtcttacaacctgaaacggagggagtacctatctatcactcttactactttttttaatgattgaggatatttttgtcattcttacttttcactaattttgccttgggatgctaagaatggatttatttttttaaggactgagtgagtaggatcgaaggtgggacacgtcaaacaaactgacagccatagataaaatgaattcagattttagcagatattcagatataatgtgaattcaggtttgagcagatattggcccggcttgaaacagttttttattattttttttacacgacagattgtttacttgatttaacgtaatatcaagtggtctaaacaaaccactggaagaaatgttcttgagaatcgtattttcacgaaaatgacacaaatatccgtcgcaaaaatctagaaaaagaaaagcgaagacaacagggatattatgtgaattcatatctttatggatctttttctttcatagaaaatactcacacagaccactaaatacacaaacgctcaacacatgtttaaatggacgaaattaatactacgtcgagaactaaagattctaagaggatgataaaaatataaaaaaaagtttctcatattctaaactctacttcattttttaatttattgaagcagtttaatactccctccgtctcataatataagggattttgagtttttgcttacactgtttaaccactcgtcttattcaaaaaattttagaattattatttattttttttacttactttattatccaaagtactttaagcataacttttcgttttttatatttgcataattttttttaataagacgagtggtcaaacactataagtaaaaactcaaaatctcttatattatgggacggagggagtactagagtaattactagctataagtttgtattataggcaatatatatttttaagtttgtattactagctataagtttgtattataggcaatatatattttgggatggattgagtatttgtcccggtaggtaattggggttaccgctaggtacatgagtagtggtggtggtactaatgctaccttctgtattagtatagatttgtaattactaagatttttttctgtattagtatagatttgcaattactaagaaatttctcagataggatttaaatcactaatatcactaaattttgttgagagtgtacccatagatttagtggtggaagaattgaaaaggacatttctttaaggaaaaaaatccgtgccaattgaatttctacctaaccagaaaaattactttagagcacccctttagaaactctaccctccaagatttttttttttggatgatatttacctatccatttcacattcaccacgttagcatcgaaccaagtacatcaattcaactttactcgataccaccaaaacaaaaaaaaattgataatatctacctattcatctcacgtgcaccacgctagcatcgaaccaaatacgtcaattccaatttactcccttggaggctcattcgatttaaataatatccaaataatcattattgtatgaattgaaaccttacaattttttctatatgcatcattcatagatccttccaaattcacaagaataatggtaggattcttagcatgaagtgagatctcttagaaaaattcatatggattagagtagtgtcattctgttttttttttctattcctataatttgaaaatcttatgaaccgaataagcccctaggcgtgtttgagatgacgaaaaataacaagatacgcaaaactagatgagtcattacttattagcgcacgattaattcagtattaactatttcaaactttaaaaatgatgaagatgattttttgagtagcttttctataaatttttgggtaacacgtgtataaaaaagacaaggctgggggttagggagagtgtatgactcaacaaactgacttatcgaagtcggtaagagagaagacgctcatatacaaaacattggtctgtaaatttaactcatttctagttttccatacatattataacattggtcaccctttgagcattcgctcgggggctatttctatctaatattctttcctgagtattgatttcaggaaaattctattcgacattgacgaaggctccatgtctctatggttctacaccaagatcgactaagacgagtatgacaaatgttgacaaggcttcgtcgcagattctacaccttctcgatcgctcaagaacggttggtggatctcgacaaggaatacaaaatgaagaaatggtgtacccgtcgagataaaatttcttgacttcaatccaaattctcgattacagcaagacgggagacttagtcgtatgctatgtactttcttggttgacgtcggagattgactcagacaaaccctttaggtgcccgcacgaggctgataaaggaattctaacgttatctctgaactcaccgagaacggtcacgtgagcacgataacagttactccaaggtctgcgcgcggttgagaatatgaattcgttcatttgcatcgaagtcgggggctactgtcagggttatggataccacatacctaatagtagttgactaaatctcgacaggacccaccacataccatgtcttatacggatacaaccttcggatataggagaagtttcgcataaggaaggatgactagagttctacatggaaacgacaaggactactcggaatgtatccatattagtttccctaattctacttggacaagaggacacctatgggtataaatacaaggccccctaggaggagaggggacacagacaacatagacgccacaaagccacaagccaatacaagccaacaaacgccaagacaagccatcggatatcgacatcagagatacgcctggatcgaccctatccggtacctacagaggctggtcgtagggatctagcgttgtctctgatctcgccggacacgaactcgaggaggaagactgccctgttgtcgactacgagtcaaaccttcagaccgccatgtcgacaacagttagataggctaccccaaatattgtattggtgtgattatggtgaataagagcaataccggctttggccaacaggatgtagggttattacctgacaattcaagggcccgaacctgtataaaaatcctcgtctccatctcttttacctcagtctcgcatataccctagtaccaacgatccccatactttgcaaataccggaatcgcgccatcaaacgtcgacaatagttactctctctcttttttctgccgaacgcagccacagagctgcaaccgcatagcatagttttgctactcttactagttattatgatggcaaccaggggtggatccagcgtgggtgctgtgggggactcgagtcccccctaccccgctggatcaccatcgatagaaggggagatgaaagagaaagaataaggagaaaataaagagtagagagaactgaagaaggaagaatgagatgagtcccccttaaatcttaaatcttgttctaatccaccctgatggcagctacatcaatatagccgcagcaacatacaacaatcttaatcgtaacacgcctaagtatcgaacaaaactgactcttaatgtgtcttccctcccacaaatcgaccctgatgcatgagcaacgttacaaatactaagtgggttcccacttattcaaaacgtttatattcgatactctactttggttgagtttgttacgaggagatgggaacaattctcctgcgcatggagaacggagcggtctattaacacgtgattaattaataattactccctctgtcccagaatataagcagttttagagttaaacacggttattaagaaagtagatagaaataagtggtgaaggtttgcgatttgatgagcaatggaggtaggtgagaaaagtgaatggtggaggattatgattggttgggaagataatgttggtgaaaaagttgttatattttgggataaataccgagggctaaaaattgttgtattttataacggagggagtagctttttttttagcggtattcctgcaggtccaccctcgaagcaaagctgcaacagagagtgaccgtactgagctaatcagaaggtggtgtttggatccaggaacttaactttagaccatgtatttagacactaatttaaagtattaaatattgactacttacaaaactaattacataaatgaaagctaatttgcgagacaaattttttaagcctaattaatccataattagagactgtttactgtagcatcacataggctaatcatggattaattaggctcaatagattcgtctcgagaattagtccaagactatggatgggttttattaatactccatgtttaatatttataattagtgtccaagaagaatgcgactttctttggtgccctgattatctgtccgtagtccggactggtaattcgttcttaaagattaagttaggttttatcggtacagtagacttggaagcaacctgtatctgtgttaacaagggattcgatctggtaagctctctgcatcgtagtgctgtttcgtatagaagaaaaaacagattatagcaagcgtaggagtacacggctctctcacgaaattccagcttctaacagtatgttgctgaaattcaatccaatcaacagcatggacgctccccgcaaaaaaaaaaaaaaaaaaaaaaaaaaaaaaaaaaaaaaaaaaaccagcatggacgctgggttgtagttgagatcacattcgtttcgcatgttttccacaatgtttttttttttaaaaacaaactagcaaaggcaaaagctttgtctttttttgtattgatagagcaaggacatatttccacatttgagcctgtaatatttgaactttggcaactccatattgctgcagtttggcgttcaaaaatctctattgtgagaagaggatgcacgagttaattagttttaaaattagtaacatactcatacgcattacaatacaatacaatagatccatataataattagaatggattgtacctgaacgcgttctataacttaggaatgaggatatattaagagtatgaatacatggtggcacgatgtggtactctgatttggcaaacaaaagcgccatcaaaggtgaaattatttatgtggttggccgaaaaaggacgctgcctcacggcggataatctaagtaagcgtggttagtcgcactaacatgtttgccaactttgctgggtgggtgatgaagattgtgagcacctatttgtgtcttgcatctacatgaccaggatgtggagaatgatcaagagctagattggggttggcttcctgctgccatctgagtcatgcttagacctaggagaatggtggttagcaatgtggcaaaattttcagaacagctacaaggacgccattgacagccttatactgcttgtttgttggatggtttggaaggaaagaaatacgcgtgtgtattttagaatcagcagcgctcggcaggtttcctgtttggttcaattaaagaggaagtggcgatttgaaaggaagttgtggtttttagaaatataggagagcaatcccttagtgtaatctgttttcttttgggaggttgctcttgtgacaacttctatttacttcgacagtttattgttgaagtcaaaactttatatatttgtttatattcctcagtcttaagtaaatcaggttggcctatcttgaccggcccggcaatatcaaaagtatgaattgaaattcagctcctcgcggataggaggaggattgatatgcgaccgattttctgggtggtgggaggagaggaaggcggatgaatatgcaagtagtactacttgaaaaaaaaagtaaataacaactcaaaaatattttttttctgctattttatattggagtagtcctccccccaccatcgtagtttcctcgtgtaagaaaacaactccctaaaaatactaaaccaaagaaaatattattttcatgcaaaaataaaaaatatatattaaaaaactgaaccaattataattccattgctacacaatgtcatggtatctctactatcttaaaaattcgtcctcttttcatcccctcctctcaagtctcaacgtgcgcagcacgtccgtatacctaaaagtaatcactgtccatccttatcacatggacttctcccatcaatatacggatttcctgtctatcactaatcctatatacttatatagttcattcccactaaatgtagttaatgaaatttctctcttctctcattaatccacatcaccctaattatttttagcctttggatgatagatatatgattcaaattgtctcttctttattctgtcataaaaccatgcaatctcaattatttttagtctcaaaattgtactatcaatttgttttagttttgataatcatattacatcttatttgtacatataataatataacttaattttccgcagcaacatggcgggaaattcatctagttatattaacctgacggacatgtaaactagtaaaaaaaaacggagcatagggccaaacgagtgatctactcgcattcgctttattgggcctccatacccttatacatgggccgcaaaatccaaccattgggccctcattcccgcccacgcagactactcgaccacaccactttttttcttttccaatttcacaccggatccccgaaattctctttggttcgaacgaacgcgacgcgaaaaagcacaccaccacttggcttcggtttgccggcgggcgggccggccccaaccaccaccccaaccaaccaaccaaccaagcgccgccgcggttgcggctgcggccgccgggagacgcgggcggcggaggttgccgggcgagaggcaggcgagcgagcgagctgctgctgggtttggaatcgggaggagatgagcggcgcggcgctgtgcgcggcgctgacggagctggggttcgacggggaggacccgctggacgcggacgcgctcgagtggccgttccagtacgaggaggcgcggcccctcctcgcctggatctgctcctgcctccgcccctccaacgtcctctccccctcccacctcgcgcagtgagttggggtctcgatttggcggttgttgttgttgttgttgctgctgctgctgatgcttaggatgaaccagctgtaatgtcgtgattctctgctagttggtgtccacagtggatgcttgcagcgcggaatgggggcatatggtggtgttggtggttgcgggattcggagagctgatggaggtggtttgctagggttctagatgtgggtttgtgcttctatgagaaacaatatggggggattagtgagaataggcttttacagtagctttttttttgaagattttgctgtagatcttgatcgggttgattagttgcacatttgaatctagtgtttggcatctcggtaagttcattggtagctgcatttttgcttgttggcatgtttgattctgaagacagaggattgttcactcggaaagtgtgcccatttgggataatgaaaaaaatggattgtacaaatgtgacatatggcaatgccacatcgaaattctactggcatctccttttcctggcacaatggggctttagaagtgacctatgccacatagagatcatttatgatagtttctacgcttttgattccttgccaacctcattgaacctgcagctaaggttttcgtaggattcctgattttttacaaattcattttgatttgtcatcttaaacacatagcagtactcaacatcctgcggaactattgggcaaactctatcaaatcatgtgcggcattgtgttgaaaaacttggtttttactgtatcactatcgtgcatgagatgcttctaaatttacattttcactcacacctgcatttgtattgtgtaatcttggatgaaccaggacaatttaccattgtttggttgccatatttaattagtaacatatttgcatagatgacttctaaagcttcccctgcttcttttgcttgagttattctcaaatgacaaaatagattttgcattgcaggtatgagcaacttgtggaagagggtaggctgctagaggtatattcaccaagacctttctggaacgtataatttctgttatctttaacagtataggatgttgcggagctgctcctgtcagattgtgcaagcatggttccaacttccaaatgttggatgcctctaggacaggagttccagtttgtgaacaactaagatattaaaaaaatttcctagattttctggcaaaatataagatattagccagttttcaatggttgtcatgggatgctgaacctcaaggaactattcccatccaagatctgggactctgcttacaaactataaactcaaaattgggtttttgttctttacattctataacataagctgtattgtccacttgtgtttttgaacacttatatctgtgatcctgctaaaccttaaaactcatgctatcattggcattgttttctcagggtgaggatttggactctgcttttgatagtatttcagccttttcaagcaagaaagataatcaagaggctgtatttggatcagaagaaacaatccttgatatccggtatgcttggaagttcaatcttataaaattatagtggaaattggcatcaccattgaacacttactacatttacattgattcttgggctcaaatcctagaacccaactgaaatgcgattatacctcagtttttataggggaaaaaactttgtcctttcagaatttatattccaaacggagcacactactgagaaccaatttctcaaaaaatcatactaggaccagattttgaatcgtgctggaaatgataatttaactagtataaaacattgaaatctcaaaacaaaaaacaataaatcaagtaaaatagctgtttggtgaaaaagaaactagccaggtaacgcagaccataccactcaagtccatgactaaaattccaaaatgtggagagctatgtcaagacactagtaatttgtagtctggtttaaactttaaaactcctgtgcggagcccggttcctgccaaatgctagctagttgaagttaccaattggacattggatgtgcttttcctgacatgtattttattatgctaatgctgcaaaaaagaaaaactagcatacagagctgaggtttttgaattacaaaagcagcttgggcggcaacaagcacagtttgatttgcttgcagggcaagcttctacttttatccaaggcagacgggcaagtgtaactgccaagtttgcagttaatggaccacttatatcattggatgaacaactttcttctagaaacttaagaggtatatttcattatgttgcatcttatatttttctttccaacaatctccataattttgatctcctattagtatctccttaaaaagattgaatgtggaagttctatctcaatcatatgctttgttaaccatgattcatttccgaacagtggcatatatttatttatgcaataagatatttaagatatctagagtttctttcatgaggaaattgttcaattaagatgattcattatcttctaactttcagatgaatgcagttctcggaagaatcactgctactacccaggaattggcccattatcattcaggagatggtatgctctttacctatagataatagttctgttgtttttttagcttattttgcagaaaatagtaagggagtattctactggtataattatacaaacatatacgtaaactacatatatggaggggtccaggactccaggattaatgctacctttacatgcatgcaacttaagaaagaataatgcgccactgatggcttacgaatcatcagacaacaagagcatagagaactacagtaatcagaatggaatcctcttattatgtactgtggctaagaaatttgaaatcttaaaaacaagtacccatcccaaacagctgttaacattccatgttttcttagagctctctttcatatttatctatttcttaatactaacacttatatgaacattgtgttttatccaataagattcctctataactcattcatcattcatatgtgcagatgaaagtatatacttagcatattcagacttccacccttatgttgttggagacttggcttgtacaaaggagctgaaccgctggttctcgaagcaatttgagaaggtaggttctctttggctgtcatgttattctcagcttacttatttatttaacacttattctgcttacttatttatttaacactttctgtcaggggccatttcgacttgttgctgaggaagggaagtccaaatgttcctgggttagtcttgacgacatcaccaatggcttgataagaggtaaataccagttatagtaaattgtatgcaatgaatagattgattatattatttaaagagcgtaactctgatcctagattagtatgatgtgctttgaatgaactaattatgaaaaactcattcctattatgcaggagattctgaaaaatcacatcatcaccagcgtgtggctgaattgcaacgacttcgttcaatgtaactatcccttgatttatcgcttatccaaagttccaaacctttctgtttgaacatatcatagtttttttttttaccatgaaacagaaggggaatcctttatgttgaacacatcatagttgctaatgtttcatgcaatcttgttatatggtgcctattgagatattcaagtgattttatttttcttcctattgcacttctttttgcatcagtctgctggaattttgtcattgtgctatcctcttatatgtctagaatttgctttatatctttgtggtgattctaatgaccttgaactgtaaacttgctctaatttgggaacagatttgctacaagtgaaagacagtggattgaggcacaagttgaaaatgctaaacaacaggccatactctcgattttaaaatcacaagtgtcatctgacgaggctcatatacatagggatattcattctcttaggtatacattcgttactgttcatcactattattttatcagaataactgaaacgaagaaaagatagatcaattacattctccgtatcttatttattttaggagaaaaggttctgagcttgctggagaactctcgactctttctcaaaaagtacaggcttttgtatctgaggtatgctctacccatgtagaggcactgccttttcttgcaaaatacttacattatattccctagttacaaaaattggcacttcatgagtctgtttagctggatgcatatgggtttgcctgtcaattgatgaaatgtatatggttttcgacagagttttcatcaacgtaatgccacatccatttaataccataagggttgaattgcatacttgcatctggtaggatttaatgattcattgcagattaaattcctatttcagaagaaaaagtgttccaagcactgtcataaaatagctttcagttgtgaaatctctaaaccacgggcagctagaaattataatctgttatgcagatattagctttgttctgctataagttctcaggaaaaagaaaaacactcatcacttataagatactttcagcacttagaggataatatgccaatagtaattcttactgcagtgcatcagacatacttcttttagcatatggttaaaattttcccgagataggcttgtttttcccagtattcactcgttctccccctccagactataccatgcctctgctcagaactcgctcaacttcaaggcacatatattttgcaaggtttgttgatgatatttacattactttcgctggcttacatgattctgttgtatcatttccttgatattctagcattcaaatatgtaggggactacgatttaaaggtcatgcgccaggaatactacattaacaggcaaaaaacggtatgcacattcatcacatggtatatatgtcatgtacacttatttattgtcagcagttcctttgtttgcttattggtggtatcttctataatgttatgaaagtttataatcgagataactattcagatagtgttattacctatttttccttctgccttcaaatctatgggtggtaagacacttgcaccaaatagcctagggggccaaatattcttgtgacaaactttcaatgtttagatttagttggcccctgggagtattcattagaaaatctggttggtctacaccttgttgaccctatttgtttttcgtatacactcagaagacaaatttaagtgatcagtgaaaaatgtgctgctagcttgcaccaatacatgctgagatcaccttaagccagctacttttgcatttgatggaacagtgttttacatttttctgccaaggtcatacatactgccaggcatatgattgttttattacacatccttctgattctgcactgtcttcattctgcagttcatcagtcacttggctaatcagctagccagacaccagtttctgaagattgcttgccagcttgaaaggaaaaacatagctagcgcctattcactgcttagagtaatagaatccgagttgcaaagctacctatcagctgtcaatacccgtttggtaagcaatctcatttgttgagaacctcctatgttgtcatttcttcttttttatgtgtctacatgtttcatgctacactcggtagtttttgttcaatctgcccttcttagttttccaagaaatgattcttagttgacctaacaaagaaatgttttttttaattctttagggccattgtacttcattaattcaagctgcgaccgaggtgcgtgagcaaggtgcaattgatgaccgtgacactctcctccatgccgtacgggatctcttatgtgttcactcaagtaagctgacaagtgacaactctactcagatagctgtttgaacgttttaatttcgatattcaatgtttcatgtcacttctgtagatgtccaagcaacaatgccaacatacatgtcagcgcatgccttggttcagcagatatcagcccttcaatctgatttgctttctcttcagtctgaacttgaaagtgctctgccagccgatcgcaaaagatgtatcaatgaactgtaagtgatactatagctcacactatgtctaaatatcagttgcctttactttatctcctgcctgaaatacgcaaaatcaaatttttgaattgttgcttttagtgtttcttctgatctaagcaaacctacccacattcttggtttagtgaatagaacagtagtgtcccatgttgttaaggcggtaaggcatcctaactcctggcagtccataggcagtatggtaaggtgggccagacgccattactcctggcagcgccttacagccatagcgacgctatggtgatgccttgataaccatgagtgcgtcaactgtgactgactctgaggtcctcatgtataatcaagttgaatattgagacaaccatgagtgcgtcaactgtcactgactctgaggtcctcatgtataatcaagttgaatattgagacagatgatacttttcaagtttgcaacggatctttggttggtacggtttgcttgttggcttaactttgcgtcttcacctatacatgatgaactgttgtctcagccccctcatctactgctcaaatataaatttccttttagctggtggtggtgaatcttccacggtgccaccaatcctctacattacattttctaaaaactagcccctacagtttttagcattacggattatagtccatttatatactgatttggcctccttaaattcaaatttagcagtcatttttcatcctttccactcttgcagatgcaccctaattcaaacagtggaacaacttctatttgcatcatcgacgactgcagaaccaatattgacaccttgggtacattctttcatccttaaaattatcccatttcttatatctcccgtgttattttcagcactccttccttttccttttgaaagttatgaattgtttttacctgtgcttgtgaactaaatctatgcttggcacagcctctgatgcgagcactcgatgatatggaaaatgccaacgcacaagttgaagtttctgtggaagaagtaacgaaggctcgcacccaaaagataaaggtattatcatgtgcttcttttccctagtccctaccaaataacatggcaaagcttgtgcgttacatattcatcgataagcatcatggtctcaattgcacattagatctttgagaatcgcgctcatgaagttgggagggagaggcaagtgttcgtcgatttcttcagcaaccccgagcgactcaagaatcaagtcagagagcttacctcccgtgtgaaagctctccaggaataaatagatagatagatatccctcgtctagtttggtaagcacatgagattcaatctctacccctgttgctcatatacaagccataaaatctcaccctctgtttctagcatttgtgtgccaggtcgtcccgcgaaatgggaagcaacagccaagctcgcaatgatgctgttgcttgcaaagtttcccttcctccaatgcgaagtttgggggaaccatcggttagtttgttggatgttgaggtgcacagctgctgttgttatattttggggatgcagtcgtgattgttgtaaagtaaccacgagcccgtttcgtcgtctgattgatattcaggctagatggtggttgtacatttgtgtactggtgttgggagactcgaaaactagcattgcttagtgtgtatattagattgatcttcaattatttgaacactgctaatgagccctatattagattgatcttcaattaaacactaacatttgatgccaatgtgcgctgtgagggttccttcatatttagactgaaaaataataaataattgggacttgttcttgctcgccggtggcgctggaagtttcatgctccgggattagagatcaggtgaccaaatcaaagtcaatatacctcagcattgaagaaagttgtaaacaatttgacttgaattctaattttgcacaagggcaagcccgagttaaaaagaaccaatgaacactttatccacgacccatagcaatcctgaaagataccgacacgatccgaagcaacctaatcgattacacatttacagggtggatactgaagactaagaacagctctctcatctcatccacagaagacaagagagggggggtcgggctggcttattgctcaggtacaaatctctttttacagaagcttccctcatttagggaatgaggaattgaggatcgaagtcctgggatatccagactcaattctcagaatcctcgggtatcttgaaaaggaactggggcaacgaggcgatgcggggaagattcatcagcagatctccgaaggagtccttccttgacatggctggtggctgagcgggacctgtagttttcactgtggatgcagccgagctaaattcttcatcggaaccttcggtgccatcgcctccaatgctatcactgtcgtttggttcaggctttggctgggccaccggtggcgtatctttctgaatcaaacagcagagggagtccaccctcgccatcagcgatctctcgtcggatgtcgatgccggtgggccctgtgcatctccgagaaggtactgagcgatctcctccagtgtttcttttgttggcacctcgttgctgggcaatgtaggattgactgatgtgatctgctccgagatgcagtttcccaagtggtttaccaaatcatccactgacatagacggtctaagcccaggcactttcagttgactccaccagctggggatatttaactctggagcaccatttacgtttctgctgactccctgaacgttcactgcactaggtcctggtaaataactatagaattagaaaattcaatcttgaacacaagagaattttgtgtagaaggcattgtaacttataatcatattataactagaagtactaggtcagcacatcagtctaactacatgtgtaatttaattgaacagatatgacgcatctcagatgaccaaaaaaattgtggtggagaatctattgaagtaactaaatgtagtaattctgagaaaaattgcgatgcatctaccagcaatatatctagtcaaagacaggaagtgcaagaagagggacagtggaaatggcatcatgggcaatttacctgggtttcctggctgagcaagaaatcctgcttgcgttgcaatggaatcattgacttcaatcttagcagacatggatgaaccagcacagggtgacaaagaacctgaaaacccagataattcatgttcgtccttcaaattagtaaaaccttggcacttcgattcaactgggtcctcaaatatagagcatctgggttcaaaaacgggagagtccaatatgatgtctggttgctgactcaattggtttagccgctgatcacactggagaagcttttcaaagtttttg

SEQ ID NO: 64487 - DNA, 1453 bp, Oryza sativa
ctgcgctgagcgcggagagagagacatgggctcaattcgacccagaactttggaggggtttctaatttattttatatttaaataaccattgaattgatgtttgtattgttaaaattagtaattgagctctgaaaaatccgaaaaaattctagagagtgtaaactaatcatggagaatataataaaaattaaatccagcaatgttttatttaggaaactttatttcccactttaattcattttcttaattaatgtacactttaatataaattctagaagtattttattaaataatttataaattcctgaaacaaaatcagggtgtggcactactaaagagtcttgtactaataatttatagatcaagggtttgcacaaaatataaattcaatcccatggttctttctgtgaacaccaacaaatgcttgtcaggtattcatcattatttttgtgttggctaattgttctagtttatttttgtgatcttttcaggaacttattccgtaattacttgactggtcccattccgtcgttcatcggaaaatttacttcaatgcaatacttgtatgagttacatgtttgttctagatcatgttccatctattggtcgttgtttttttttaattattgctaatcatctcaaggtcattatctttcaatccactatctggactacttccaaaggaactaggaaacctcaccaatcttctttcattgtaagaaatcttttctcacatgtggattaatcttccactgctccctctgctacaaaccactcatcctttcagctttaactgtcaattcctagcagttttcacgcgcgtgcgcgcacatatatatagagagagagttgaacttatgactacgaatctgagcatagcttatgtgtaaattgttagctagaagttgtatttttttttacggagggagtacgaactataaattatgaaattatttctcatgttgaatctaaatgttaaactatataaatatgtaaaaatggatggttagaaatataatgtttgacttacaacaaaagtagaatgacagataatatgaaatgagtggagtatatatttggactgcacgaactaatataataatacatgaaatagcaatcgcataagttctacttcccccgtcccataataagtgcagttgtgggttttagtgctcaacatttgaccgtccgttttatttgaaatatttttataaatagtattctaattgttattagatgataaaatatgaatagtagtttatgcatgacttatttttttaaaaacaatcataattttttcaaataagacgaacggtcaaacgtttgatacagaaacacttatggttgcacttataatgggacggagggagtgataaaaaagatcaaaactactactaaataggatgtaataggcatgtcagtgtaactcctgctcatgtggtgcttcatatga

SEQ ID NO: 64488 - DNA, 8885 bp, Oryza sativa
tgtccccactccactatggggccttgtatttatactcataggtatccccttgtccaagtagaactagggaaaccaatatcgataaaatccgagtagtccttgtcgtttctatgtagaactctagtcatccttccttatgcggaactccttctatattcgaaagtcgtttccgtataagacatggtatgtggtgggttctgccgagatttagtcaactactcttaggtatgtggtatccataactctgacagtagtccccgacttcaatgcaaatgaacaaattcatattctcaaccgctgaccttggagtaactgttatcgagctcacgtaaccgttctcggtgagttcaaagataacgttagacttcccttatcagcctcgtgcgggcacctatagggtttgtctgagtcaatctccgatgccaaccaagaaagtacatagcatacgactaagtctcccgtctcgctgtaatcgagaatttagattgaagacaagaaattttatctcggcaggtacaccatctcttcattccgtattccttgtagagatccaccaaccgttctcgaatgatcgagaaggcgcagagcctacgacgaagccttgtcaacatttgtcgtactcgccttagtcgatcttggtgtagaaccatagagacatggagtcttcaacgatgtcgaatagaattttcctgaaagcaatactcagaaaagaatattagataaaaatatcccccgagcagacgctcaaagggtgacatattataatatgtatggaaaaattgaaaatgaattaaatttacaaaccaatgttttgtgtacgagcgtcttctcttttaccgacttcgatcagtcattttgttaagtcatacactctccctagcccccagccttatcgtcggagaatcattctcggaggataaagctcttggacccttgacctgccttggttgaaaaagtgctgatcctagcccctagccatgaagttggaaaactcaatttccgattacacggcttggttaatacacacggcgagaactcttacatgaccaggtcttatatggtcgtttgtctctacatgatccgataaggccttatccgctttgggcgtccccagccgaagttcccttaagttcctcagaggccttgtcaggacggcgtaaagggacatgaggataggtttcagctctaggtgtcgttgtggtaagggatctctgggaaaaacacttggtgatattatgtacctgatatcaactttggagtagaggtaatgggaggatcgttgtaccgctggtcaaaaaccagttgtagccccaacccgaccacttgaagtaaaggtagtgggagaatcgctacaccactggtcgagaaccaggtagtagtcgtaactcgaccacttgaagtggaaaatagcgggagaattgctatatctctgatcaaggaccaggtagtagccttaactcgaccactagaagtaaatgtacgagagatcgctacaattgactggttgagaaccagtgagtaggtgtctctcgaccattaggagttggtacgaggaccgccacgctgccggtcaaagaccagtcgtagctgtccctcaatcatctgaagtcatctagagtcgtggtgcgaggaccgctacgctattgccgtagtcgtaccttgaccatcagaagttaaggcacgagagatcgctacgatttactggttcgagaactagtgagtagaattatctctcgaacaccaattgaagtgcggtgcatgagattgcgtaccttctactacgttcgagcagccatcggagtatacattatgctctcgcaacacctaatggcaagcttgctggctgcgatgagcatactgctaccttcttacgtggtctcgtagagctcagtcgcagtatgaacttattctgctcgatacatccatatggcaagcttgtcggtgccgaggagacattctacgcttttactggcttcgagcagctcagcgagtagcaattatactctctgaacaccaatggtaagttgcggtgcgagtagactgctacccttttacgtggttcgaagagccatcggagtagcaattatactctcgaactaccaattggaagttgcggtgcgtatgagactgctaccttttactggttcgagaaccatcgagtagaattatctctcgaacaccaatggaagtgccaaagttggtttattacatgtgcatctcatatggccagcatgactcacatacccaacttgtagcatatccggatgtccgtccgcaatcatatcgggtgatcaagccgacatcattagcgagcaattatccgttaacaaccattttctcaaacagcccagccatagccggtgctatgagataggtcgccggtcttggttggtaggttgggcgcgacgactctgcatttgtcgagatcgttctcgataatggggtgtactcgaccacaacttactcgagtgctcaattgttcctgaaaaatatttttctagaaggcaaagcatatagcagagaatatcgagtatgtactcaaaagactgcatggatcttctagtattatcagggtataacgagcggatgtaaatatcaggcattacgtaaaccgtaagaaagcatgattcatacagaagagaacagagcgagcccccagcgttagaccgtagttggcctaacatcggaagcactcgcacaatagatattatataaaaaacatgctctaggtaaacataataaatcattaatctgacaatgctatatgatctgaattggtacgataaattgcatataaaatattgcgtacctttgtagatacatgccagatgtatctacgaaattagtagatcaatttaaaaaatcaatctaccaattaccttgttgcgtactcgttcgatatcatgtgatctgacatcttttggtacaccgcggagcttgaggctcgaatgatctcgatagatcaagttgttgacgacgatggttccgatcttgtcggaggatatattccggtcgggtttgatctccccacagccgaagtcgtcgagtagcttgttgttggagaatccatctcttaaacccatctcgtcaaaatcctgaagcaccaaaagtcccctacctggcgcgccactgtcgatgtttgattttgcgattccggtatttgcatagtatggggatcgttggtactaggatatatgcgagattgtaataaaagagatggagacaaggatttttatacaggttcgggcccctgaattgtcaggtaataaccctactcctgttggccgaagccggtcgttgctcttattcaccataatcacaccagaacaatatttgaggtagcctatctaactgttgttgacttgatggtctaaagtgttgactcatagtcgacaacagggtagtcttcctcctcgagttcgtgcccggcgagatcagagacagcactagatccctatagccggcctccgtaggtaccggatagggtcggtctaggcatatctctgatgtcgatatccagcgtcttgtcttggcgtatgttggcttgtattggcttgtagttttgtggcgtctattgttccatgtcccctctcctcctaaggggccttgtatttatacccataggtgtccccatgtccaagtagaactagggaaaccaatatggataaaatccgagtagtccttgtcgtttccatgtagaactctagtcatccttccttatgcggaactccttctatatccgaagtttgtttccgtataagacatggtatgtggtgggtcctgccgagatttagtcaactactcttaggtatgtggtatccataaccctgacacaaaactaattacataaatgagagctaattcatgagacaaattttttaagcctaattaatctataattagcacgtgttactgtagcatcatgtaggctaatcatggattaattatgctcaatagatttgtctcgtaaattagtccagggttatggaataggttttgtcattagtttacgtttaatacttctaattagtaccccaacatacaatgtgatagggacctaaaactaattacaaaatccattagtaaaccgcgagacgaatttattaagcctaattaatccgtcattggcaaatgtttactgtagcaccacattgtcaaatcatggagcaattaggcttaaaagattcgtctcacaaattagtcgtaatatgtgtaattagttatatttaatacttcatgcaggtgttcaaacattcgatgtgatatgatgaaaatttttggggtgagatctaaatagggccataggttgtgtttcgttactttaggatcaactccctctcctcgttttccacgtgcatgcttctcaaaatgttaaaggtgtgcttttagaaaaaaactacacgaaagttgttttaaaaatcatattaatctattctttttaaaaaaatagctaatacttagttaattatgcgctaatgagtcactccattttacgtgcactgcacattagttcctaactaggaacaacgaacgcaacctttaaattagttcactatcgtaaattaaggtttcaacatttttacttgccctcttataaacacatcccgtcgctaacgttgcaaaatgtgacgagcggaggcgacgcggtaaacgggtgaggaggcgatgcggcgtacgtccgacctaagtgggacgagggtagcgttgtgcgagcggtggcacggagcgagcaggccatagagacgggtgcggcggtggagagaggcgacgtagcgtgtggccagcgttgtggaggccgacgcagcgtgaccggcggcagcaggtagacgacgtggcgacgatgaccggttggtggtttttccccgacaaggtgctgccgcacgagagatccagcgatggtaggcagcatcggggcaagtcatcggatgcagacatgtggcttgaggtggaaacgatgtgagcagtccggtcgaggtgacggcaatggtggtgccgtgaagtggatgttgtaggcctgtgacatcctcttttctggacgctagtccttttgtagtagatccttgccaccacaagatggttatgttggagataggggatccactcttctctctcaacctctccctctccaacccaattgtgtggatggagattgagtgcgccggatgtcgcacttttacttgatggctagctagcaacgaggcgttgacgcgatggttgcacattgaaggtgctcgattggtggtagtgctgagttaggtaggtgcatttcggtatgggagacgggaagattagaggcgaaagtctagcctgtttgggtcgacaatggcaacacctatgggtgtcgcttcctctagggcattgttgcggaaggattttctctctctaacggttttcttcaagtgaaagacacgtcaactctaggggtgggaaaaaagctcggattcgtgagcttagctcggctggtaagccaaactagccaagccggctcacgagccgctggtttggctcgtaagcctaggccatcaagcgtttatatagattatttatttttttatggagttattatttatcaacttaaaatttatcatgaagattttgaagaattgaaatataaacttatttaaattttacatgttgataatttgttcttactttttttaatgattataatatatatatatatatatatatatatatatatatatatatatatatatatatatatatatatatatatatatatatatatatatatatatatatatgaagaggtgtttcaacaagaaggcttgcaagtcagctcgagtcgggaaacgagccaagctcaagttttagcttgtttccctaaccgagccgagccaagccaagccaagcctagtttgttgcaagccactgcaagccgagccgagccaggcctggcctggctcatttccacccctagtcaactctcaggacaggcagcagcaatgctctcggcaccatgtcctcccttgaggcatcattttaagatccagttattaaggggtgtcgtgttcctgttttgctcttcagcaatggggttttgaatataggcgtatggtgtggggtttttttttcatgtttttctggctatagcctcctaatgctataaaattataaatttccttgtgtaacgagtactaaattataaatttattgtaagagttgacaaaagcaatgtgggtggaagtgaacaaaaattactcctcaggagtaagggcgtgaagttctagaagatctagcatgtgcagaaagcaaagcggcatttatttttttaagcataaaagttggaatgattatgagatgcaaccaactactcccgcccaaccaattgatgggacttagagcaggtataatagtagtctataagccagctgcaaatatattttaaggagataaataaggagagagaagagcagcgggctacagatttatagtcagctgtagaacggatttcaagacgcagtgtgtgtatgacatgtgagactaggtattaatagtgtagtatgtaactattgtatggatgagctattagattagatatagatgaattaaagctagtagttggctatactattaaacttgctcttaaaatctctcacacgaagtttaaaaaaaataaataaattccacacataacatttgtgctaatgtcaatatgataagtttaaactgagcgtcagaacttgaacagaagttctactatctttttgaaccttcaacctgtttagttcctccataataacaaaaaatttgctgttttagagcactttttaccaaaatagatctaaacactagtagcaaaagttgataatttagaatttgtcatttggagtagcaaattttatcaaaaagtacgttgggagccgtgctctctctctactgtaaaatggtaaaactttaccatgcaactaaataccaactagcaaaacttcaataccaaatcttttgccatcaaaacttttactaaaaatatttgacaaagtaaattgatctaaacaggcccatagccattagcaaagagcgagacacaaataaactctcaaaagaacaagaaaagactgatacagtatcgaagacataccattcagagtcgaaaagtgccttgaacgtgaagcggctaaaaatttttttagtccgtattacatcttatgtcaaacgtaaagtaatgataaacccattccataactttagactaattcatgagacaaatctattaagcctaattaatccataatcagcctatatgatgctacagtaaacattttctaattatagattaattaggcttaaaaaatttgtctcgcggattagctcttatttatgcaattagttttgtaagtagtccatgtttaatgctccaaattagtgtcaaaatatccgatgtgacatggactaaagtttaattcgtggatccaaacaccctctaaattcgctggtctctttagggaacgaatagacagttttggtcttttggagatagcagcatatcagatgtgaagggttcacaattccgacgaaaaccggtcgaattccgcgaaatttcgatgtttcgacacggcttagaattaaatttcgattggagtttcgaatattaaacaatagatttggtcgaaattcagttaaaatttatcgaaaaccatgatatcgatggggctcgaaatttagtggtaaccggtaatgtaaattctggatgtgatatttcacttcaaaagacgggctcgttctagtcccacatgtcatctctctcatgtgtcttcggtattataaacttttcccatctcttacaaatattttacctggtcttatgagactaactcaatgtctcaatccatctagttcaatctccaattctaaaatgcgtcccccctaacgtgaatgattaatgacaacgcaattaagtgactaacgtgaatgattaatgacaacacaattaagtgggtaggtaaaatggccatgatataatccttttttctatcgttaataaagctctctttttacttaaaaaaataattaagctaaagtgcatgtgttagtaccaaaaacgaatttcataaggcatggagatcgctacaaattaaaacaaagcggcaaaaagactctatggcttttaaatcttttgaatttgagccatacgaaaagccgggttagtgataaggctgtatttgtgtccccatgaagtccctttaggatccgttaaggaggatgagttgtgaacttctcctccccgcaaagaaaacgagataactcattagcacatactccctccatttcatattataacactttctagtattgcctatattcatatagatgttaatgaatctatacacatatatgtatgacaatactaaaaagtcttataatatgaaacggatgaagtaattaattaagtattagctaaaaaccttaaaaatagattaatatgatcttttaaagctgctttcttataattttttttaaaaaaaacgcaccgtatagcacttcggaaacattaaacatatagtaggagaccctgcgtgtcggcgagagcctccgtgcgcgccgcgccgcctcgcccctgcgcgccggcaagagcccccacgcgcgccacgcctcgcccccgctcctgccaccgccacccgtgtctctgttagtaaccctaggaaggaacgaaggacagagaagagataagaacgaaggtgaaaaaagaggtgaagcgcttttggtcttaccacgcatgagtcgcgagtcacgggtgcggaggtggtgggatcatttcgtcgcctcttttttccggatggggttgtcccgaatattgaaggaatattcccttctagaaccatcctatccttccttttccctcaaccaaacagatatactccatc

SEQ ID NO: 64489 - DNA, 4177 bp, Oryza sativa
aatatacatatacatgcatatatagtacaattcatttgctcggtagctatagctacgacttcgacgtcggcgttatgtcagaagaggaaggaccgacgttatgaattgtctatccgtcgtagtagaattcaccgtcgggattaaggacttcttcgttgatgaatcccatcagttgttcttgaacagccgtgataaaatccttgtgtgggagattatccctcatgtgaatacgctatcgttcgaaaaataatgacgtatcaatatatgaaattaataaacaacttaacaaatcgagcaatgaaattttgaatgatttatgtatacgtacatcgagctctcgtgttgtgcatatttggtttgataggcaatgggcatactcgcatacgtagtagccgcataagttagtttcctggtcctgctttgcacactacatgagaaacgatgagagatttaatatactatttatattaactgtaattagagattcaattcaatataattttggatcatgcatgtactcactggaaaatgaaacctccgtccaagtttttctttccaagtcccgcggaccaattgacggaaccgatcccaagccctacatatgtagttgcaagctatgattaattaattattacctgagatcaacataatagcaatagattccccgcgactttggaatagatggcattatattacctgtctatcagtttgaagaccttgtcaaaaatcttcttctctttattcattgagtcgtacacagtgactctgcatgcgtccaagtcgaagaataacaggacccagtggaatctggaatatgcgtgagatgagatatatatgattgaaaatgtacatgctatatgtatgggaacgaaatttgttcgagcgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgcagaccctccgccatcgggccctttgaatctccattctacaacaatgaaaagaaagtattattgcttacatatatgccaggagctaattattgaacgaaacaaatcgaactcaaagatactcacaaaatccatgcgctcagaagagagacgtcgatggcgtccaactggtacagatcgaagagatccttgaaatggatccagagaacatcttctccttgcaagaagttggagtttctgatcctcgctccgaacatctctctacccttggcgctcatttccatgtaccgttcatggaatttgtatatctgtgtcggtagggactgcagctgttcaggtttgacaagcggtttaccgagttcaaacttgtatgccacttccgccttcgggattggtgcgcctccaaccaactgatccacagttagaccggtgtctgaaatgaattccgttatgccaaaatctttgccggtcaccaacggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcagaactccgaggcttgagttgcctcttcacctctcctgccacataagcatcaagctcctcttgactgcaatcgtacggtggctacttgtttttggtggcgtcaactttcgccttcttcgttgcccttgtgcgggcaggcggtggagcttggcgagaccttgtcttgggaggtgcaggcggacatggtggaggcggaggaggcagaggagccggaggagccggaggagatggtgcagcaggaggtggcggaggagccggaggagatggtgcaggaggacgtggcggaggaaccggaggagatggttcaggaggagatggcggagccggaggagatggtgcacgagacgctgcttgtcgcccaggaaggatgatgtaccgcttgcgccatactatgatggcgtggcttgtgtctcgtagatgcgtctcaccatctcctcctgggtagtccaactcgaggtcctcatacgcagcttccaccagctcaacttcgacccttgagtatcctgctggaatcggcctacagtggtaagtcccgaaagggtccgttgagatggccattcccaacgccaccttcaagtgatgagaggttatctattggtaatcaacctaaggagcaacttgcgggatgtactagtcaaaaatcatcaaactacgagcataccttgattgataagttcttgaagggaatatgcagctcacatggtgtccgctgcgtgatctcatcaatggggcaggtggtttcgtcctgggtttgcatggcgtccatgctctgtgatccgacctgccccgttgaggcgcagctgctacgattgcctgatgggctgaccattgcaggatgaatgtacggctggggatcttgggaccgatgtgcggccatacgttcatccaccttccttgccacctcctcttgcatgctgaactcgtagctcgatatcctgtactcaagatctgcaatcttcgcctcggtatctctcttgctcctcatccgactcctgtacgtgtggatgtcctccttaaatccaatattctagggaatcacgcctttccctcgtgttcgtcctggatgctcgggagtctgtagggcgagtgacagctcatccttctctctgtcgggtcggaatgtgccctgagaagaggctaccactgcgttcgttagtcgactagcagcctcgcgtatctgatcactgaagacaagggagccatcaactgggttaagcattccaccgtgagcatagtaccaaaacttcgatcgatcaggccatttagcggtggtcggtttgataccactctcaatcaaacttgcctccatctcctcccacttcgacattgtgacgctatatccgcctgaccccaagtggtgatggtacttcttcttggcggcattgtttttgtttctggccatcatcgcttgcccttgttgccctgtcttgtaagcaacgaactcgtcccaatgatcccttagctttgggaatacatcgaagttcggtgttagtcccttcaagatgtatttcttgtagagatctcccttgaagctctggaactgttctgccattttcttcagagtccactgtttcactatgttctccgtacccgcgggtagcgtgaacgtctcgagcattgtggtccacagcatttctttctctgagtccgggacaaagctgtcattatccccgcgtgcccttgttctgcgccagtacaccatgctgaccggcacgttgtccctcacaacccaaccactgtggcgtacaaaatttttggctgcttctgctggggcactaggtcggccgtcttcgtccacctcagttatgatgtgccgaccctctatcttcttcgcggcacctcgttgtccgcgtgccctcttctgtccagcggagggatgacttccactagcctcctcctcatcgttcccctcctcattcccctccgaatccctctccacgttcccctcctcgttcaagtactggtttggatcctcgttcccctctctttcgttccagcactggctgcttccctctgcgattgtatcgtatagtatctgttcctcatcgcgatcagccatctatgcatacaaaaaaaatttgttaggtatataggatgtatttgcgtaccgtaatattaaaactctgctaatcttatattaaatctctaatattcttatattaaatggctactaatctcatattaaaattgtaataatcatatatatatatgctaagtctaacaatcttatattaaatctctaacaatcttatatttaatctctaataattttatattaaaattgtaataatcatatatgctaagtctaacaatcttatattaaatcgctactaatctcatattaaaattgtaataatcatatatgtatgataagtataacaatcttatattaaatcgctactaatctcatattaaatcgcggctaatcttatattaaaattgtgaataatcatatatatatatatatatatatatatatatatatatatat

SEQ ID NO: 64490 - DNA, 18996 bp, Oryza sativa
aacaaaaggcaggtttacccagtccaaagtgaaaatattgcttaaagggtggtccaaagtgaaacatcggtaacaaaaggtagcccgaagagaagtttactcattatattttaatagtattttcgttttgggttgaaaaggttgctaagtttctctataaatttggtaaaaatttaaataatattaaattttaaaaataaaatgtttcataatatgaaatgaagggaatatagaaaaagaggggacagtttatctgttagagtgctctctcctcattggttgtcatgagcgctaatcatccttgttagcactaacacacagcaaaataagcatggcatttagctgtccccgggtccattttccatttttaagaaaaaaaaagggaaattccatgggtcctgactagagagactatagagtcctgcgtgcatcgatctagggagtaaacgaacaacaatgtttcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaacatgcggtacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatcttttgtttccccctccacattacaaatatcctacgtgttgatctcccagacgatgacatcgtatcattattcttgtccctctgatgttattttcttattaacgatatccatggaacatatttttttccaactaacttaaaaatgttcatcattacgatagtccttaatttattcgaagataaacgtattagagtaaccggattacataatatgattatgaaccattgtaccacaatccgtgcatagcattgtagtggctattatataaggcagtgtacatagcagaagatgtattcataacatatccctaattgttgtggccgtttattttgcctactaatagtcatacattttgacgtgatcatgttttaccaacaataaactatgcccattatatagttttcaataaggagttcctattggaaaatttgtgtctcaccatggacagtacatataactacacgctgcccataccttctaactccactcgttagctcatcgattggactgaagtaacaagtacaccagtcataggagtgtagctagggttgaggaggaagagggagagggagagcacattgatgcctatataaaagatggcataacaattagactatgaatggatgacaaggtaatgtaatagtgtcactgtatgttagacaaaacttaatggattatgggtagacttgatggtgaagctaatatatcttagcaatcagactagagtagcgggtcgattatcgatcacacatcaatggtgactacatgaaggctctatgtgttataaccgtataagcaaaatacccacaacgaggttggatacgtgggtggaggcgtagctatatgaagacaacactacgtaactcgtggcagatcagctcaaaaaggaggagaagctattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagagatggacgaggcgtgggagagggcggtggaggcggcgctgcaggccgccggagaggggagctcgtcgccggcgaggagcctgacgctggacggcgccgtgaagtgcctgcacggacgcgtgcccgcggcggagattctggagcggtaccagagcctggagcacctgtcgatcgccggcgtcggggtcgcgtcgcttgccgggttccctcggctgcggaacctgacgcgcctgacgctctccgacaaccgcatcgccggcggcctcgaccacctcgtcgccgccgggctggcctcgctccgcgacctcgacctcagcaacaatcgaatccaggacgtcggcgacctctcgccgctcgccaacctccgcctcgtctcgctcgacctctacgagtgccccgtcacgcgggtcaaggattacagatccaaggtgttcggcatgatccggactccgaagtacctcgacaagatggacgccgacgagaacgagaggccggagtcggatgacgacgacgacgacggggatggcgacggcgacggcgaggaggaggaggacgacgacgatgacgaggatgaggatcctggcagcggcgaggtggccaacggaggcgtctcccacccgcgcggtggcgtggcgtcgcacccggtggaggtgaacggtgtgatcgatgtggacgaggacgagagcgacgccgacgaggtcgtcccgaacgggggagacgaacaccacgctaatgggtttcggtcgcggccgttggggacgaggatgaatatgtggaggaggaagacgatgatgatgaggaagactatgaggaggaggatgatttgggggaggagatcgatgaggatggtgatgacgaagacgctgttgttgaggtgcatgatgtaccaagtagcagtgatgaggaggaagacggcatcgaggaagaggatgaggaggaggacgaggatgaagaggaggttgaggatgatggtgaggaggctgagccagagagcagcgggagggtcgctttggcggtgggggacgttggagaagagattgatgggcatgagcacggagagggggaagatgaggatgagaacggtgagattggagaggaagatgaggagagattggaggatgatagggtttatgaggaggggaatgatgacgacgaggaggatgtggatgatgaggtataacacattttgcattaatttctcgcaagcgtatcaagatctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgttttacactctgaaatagtgtcagggataatcttctttacctcagttacttagcagcagggataaaatcatttttacctcatttactgagtgtgatacataggagcagttcagagacttatgtgtgcgctctatcattattggctaatgtatccgtgtgatgattttatgagttgtgcattagtactttgtttgatatgctgcagctatgtgcacaatctttttgaaaattccagttagacccaaaaatgacaggaaatgtgagaaattagtgtttcagatatgattagatagatactgtatgacagcagagtttagtttcttcatgtagaagaaagagaaggttttagttatctcttttatgccctattttcggatataacaaaagattttgcatctgaagtttttaaatttggcaattgcttaaaagaaaaaaactgatacatctatgaaacctgggattttatatgttctttttaccttatttgatatccatatctatgtatgcttagtaaatcactagtgtttctactctaatttttattgatatatttctgttttagtagtgccagatgttttgtcatgcatttatttcttttggggctatcttaataatgcattatttcattatatatccctgactgtgtaagtgtgtacagacctgtagttcttctatccatgagaacatgctttagtttttgcctatgttatctggccagtagaagctcttctctcatttgtgaactgtgcaatttattcgctgctaaatatccttgtagatagattttctcctgtcatgcttgttatggcccattgttttgttcattgtgtaacgagaaggccttcctttctgaatttcatcttcttaaatccttcgagaggtggttgatactgcttttttactttcactattgttttagtgtgctattcttgcttataggacatttaatttattgttaagttgatcttttgatgtaaatattgctgatgtttactatggttttgaaaccatacatattttctttcagtggtagagacgcttattgtatttcagcaattgcatggttactttgcctatgtttttcattgctaatttattgctgcatgtatgttaaaactataaatcatggagtaatttgtttgactctttgggcatttcacttagtgagctgtttatgatacacatgacttttatgtttgaggtttttctaaaccctgttccagaatgtccttcctgttaatgactatctctaaaagcagaattgtggaaacacaggtctaatgagaattcatccaattttgcatttcctcaggatgaagacacagaatatcttgttcaaccaattgctcaacctcaggccatggcggttggaaacgactttgatgcagctgaggctgatgatgctgatgaagatagagatgaggttgatgacgatgatgatggtggtacggacctgccctcgtcctcgcagggcgctaagcggaagagagatgatgatccatcaggcagtggagatgacgacgaggacgatgatggtgtcgaggacctgaggcccttcaagcaccactgaccaagcagcaatgtacatggatcccttcctccccctcttctcagctagaaagaaccaagcaagcagcagcaggagcatcagcaaacagaaatggtgggtttccccctgttttttcttagcgtttttcttgtaaagactttggattgagagagagcttcttcatccagccttcctcttcaaacatcagattttaggagggaaaatggagatacctgtgtagcaacttagcaagtagccatggcagctcagtttcagtttcagtttcattgtctccctagcctgcaccatctcttttgattttcttttttccctccagaatttcaaatggtagttacaagccccaggtttccctccaccctttcaaatttctgttacattggcagtgtagccgatgtattgccaactctcaaaactgtagtttccctccaaaggaaaagcccgggaaatgccccccctttcaaatgccccctcaccctcagtagccgttgctccccctccaatttgaatttttatacttttgccctagttggttgaactgtgttgctgtgtgtggtaagagtttctcactggggagtgtggacgacggtgccaccaccccggggggggcttctgtacgcgggcgctgcgtgctttgagataggtgaaacggctgtggttgtagcgatgcggaggcgtccgcggccaaccaacgaaccagccacctctgtgggcgagagggcgggcaactgggctcccggtgctcgcagcagtaagagccatttctttaccaatttttggaccgagcagatgcagcagcacagcccgcggcggctgcgcccgtgtccacggctcacggcatgggtcctcctctctcactgctcaccgggccccactcgcaggcaattctgttgtggtgggggcgggtggtaactggaccgggtggtgaggtgaaccacggcgcgggagtgggtgggtgggtgggtgggtgggtgggtgggtgcacgttgtcggtgagcggctcgaggcgaaggggaggagaggagattcggccggatttggatggatgccttcttttcttccttggatgcttctccctcttgaaatgacggtattgccctccccctcctcgtcgttggtgggggcccaccggcttgaattaggcgcacacccccagctggctccccaactttgacacgtctctctgccgcgggatccgaattaaagaatgggcgacgcgcctagagacgacgcatactttgggtgtgggtcccaccacggtgatcgtcgggccccacaagtcagtgatacgatagctctgcttcgagcggtgaatcacgtgcaccgggtccatgtcacgtacggcgactgggaggtggggccccggttggggtggctacgctcgtctgaccatgtggtccgtgtctacagatagctctggcctctggccccgcgcaggcacgctatgcccgtgatgccctgtatggacggcgcggatcgtggagagcggagatcggacggcgggtgtgagagcagtgacgtgggagatcatccgcctagtgtagaggagacggtgccgggtcgtcgtgccgtgttgctcgcgcgtacagcgtggaccgggcccagagggtggacgtggttggtggggccatgggggtggtgtgggtggagaggtggggtccacctgggcccacttgtcagtttcatgggtggaaggggatggatgggaaacgacgcgcgggcgggcggggtggtgttcggctacgcggcgcctccgccgtgtccgacggggccgttgcatctccgcccctcccccgcaaaccgcttcaattttcaccaagtcaagtacaaagcacaaactgggaagtattttcggcagtaaaaatagggtttgttgtgagatacggagtttgtttgtaaattagatgttttggaaaatctaaatactatcccatctcaacccatctcaaaatatagtatttttattataatcttaacatgcatttgtttagatttatagttataaaacttattatattctagaacaaagttatgactccctctgttttagcttataagacttttttactttggtcaaagtcaaactaatctaagtttgactaactatctaggaaaaaaatagtaatatttttctacagaattagttaaatttagagagagtcaaaaagtcttatatttgaaacggatggagtattttctttccaagtcgatttggaacaaataaattagtatttttcccctaagtgaatcattagttcattaacaaaaaaactggccacatatttttagcaaatcccaaaaaagttctctttctattgtttctccagctgtagcgactaatccgaaccgttggttgtgatcggacggcaaagagataatgaaacgaatggctggctctcaggcaatcgtgctgctcgcgcctcgccactgagctccagtttccgagcagatagagcgagttgtggcgggaaaccaatgccatccaactgaatcagtggaaggcaaccaccaccacggccacggcgagccactgcctgccaagaacgaaagctttagacggtcacctcatcggcgtcgccgcccgattttcccatggcgtcccagccactacgcctcgtgaggccgagcccgctcgccggccggcacgcggcggcgtgcaagtgctccgccgccatcccgctcgtcttcgggcggcagcggctgccgctcctcgtcgccttccctcgcggctccggctccggctccggttccggcgcctcctgctccgccgtgcaggagtcgtcgtccgccgccgccgccacgactggtccgcccccaattgcttagctactgtaaatcctttataagattaggaaagaaacgcatcagtgttgattagatcagtcaaatgtttgccatagtagcaccatgccaatgttttgcgttttgccattgaaaagttgcacttattttgttgatcttttggttactatggatttgtggtgtggtgtgcagtcagtgagaagaaggatgcggccgatgccaagaaggaagccaccgcggaggcgaagcccgcagcgaagccggccgcgaagccgaagaagcctccggtgaagccgctgccggagatgatgcaggaggagatcatccccccgctgaaggcagctctggaggctgaggacgacgtgtcccaagtggagctctccttcgaagataatagggtgagtgtgccgactagtgccggagatgataatagggaagtgatcacactgcatattagcatccctaactgtttcataagtactgttgtctgaagcttgttgattttgtgattactgattagtactgaaacgtgtaaattagcaacttggtataagttacagagttacagatggtataaagcaattcagcatagcatagctaattgttcgatgaatgttaaacaagtcaaatttaattacatggaataggtttctcattgctttttttaaatttgattcagcctagttctgaacaatagcattgctgatgatgtaggaatttctgaaggaaattaaaaacatttgcttaggctgtgatagttttgtacaataaggctacagcctacaaggaatgataatgaccaaatatttctgctttttctagataattgataattcataccaacatttctgctatgctgcgttattacatatatatcgacattattaacccttgctttgatgaatgcagttggagggttccttcataaaggatgaagtgccttattacttctgggccttctttccaaatggagacctcacaggtacaagctacctcctgcacctttctcatttcttcatacaaaaattgctgctttcttgctgagaataccgttgggaggcataagcaggacaatacctcaatgcattcacataacctatatatttcataccttttgaatttttaactgtaaactactatcacttgatattccgtgttctgaaggctgctatgtagcgtattatttaggtataaatccgcattctgaagactacaatatagtgcatctaggtgtaaaagaccagttatgcagagtacagagtacttaagtaggattgcagaagcatattttgcaagttgcaacactgcatcatcatcaaagatatgggcgcatagcttattgaatagcttgaaatgtttacaccagtatcattcatctcgacgattaacgcaggaccgaagggcttcgcgctgtcatcgtatagcacagaagtgagcaccatcgagccgttcctgatcgacgagaagagagcaaacgccaagtatgtggtgttctgggtttacaagaggctggctggccaagggatcctccctgtctggaaggaagaggagggtgagggtgagggggagggggagtcttcagcgtagccactcaaaaacacacacacatgggcacaggctgctctgaatatagtacattgtgcaattcctaattgtgaatgttgtaaagatgtaaagttcatctgctaatatatcacagataatcttgatgttcttttttggagcgaagatgatcatgacgtctgaaccttgcatctatctctttggtgccgtgtcaagtatcagtctatcagcagctgaaaaatggtctcttgctgagtctgcagggtagccactgaaaaaacacacacatgggcagtacaggttgctttgaatatagtacattgttcaaagcctaattggacagaattttataaagatgtaaagttcatctgctaatgtatcacagaaaatcttgatgttctttcaggagtggagataatcttgatgtctgaaccttgcaccattctcttctggtgccatgtcaaatatcattccatcaaaagctgaaatatatatatatatatatattcaacaatagaacttattggatcggagatgtaaaccattccattattaaaaaacagcagctggaaaatggtctcttgctgatgttcagtgccagtgtgctgtgtttggttggggcgatctttctgggctgggccgcaagttcaggttctcttgaaatgcttgtcacaatcatagagtgaatagtacaagatcgagctatggccatgtgtcatctgaaaggtatggtatgtggagtttatcatcccttagtcctagctgtcgccctccgtctcattcagtcctcgccattatctgatgctgagatgaccatatgcatggctcctccacagagaaggacaaaacggaaattgaaatgtagatattatattcgtccttcgcaacctaaggttcataaagtgcaaatatataatatatataaagcaactttggcattttaagagcacttggatggtcttatacggtgcataaccaacctcgacagcctcctatcgcgtttcctataatattttctcccttaatattaacaatattattgtcctttttatgaccatcctagcttatttttaagatcttactcaagtatcttttttctttacaaaacacttcttacatgtagataattttgtgaaattcgtctcatcttcaacatgtgtgtcttttttttcctttacacctactccatccgttccgaaaaaacgaacctagacacggatgtaacattttctagtacaatgaatctagacatgagcctgtccagattcattatattaggaaatgtcacattcacatctagatttgtttttttatagaatagagggagtatgtatgagtcttccgtgtaacgaaagatggtttgcaacctccatgtaatgatagaaagatttggatgagctttgcatacaattttcactttttattaaaagttcatcaaaatttataccacaaattttttttggaggaaacaaaaaatctttttcttcttccactccactgcaaccgtgcaacgctgacactcacttttaaatcgcctcaaaactaactgaatcactgaacacccgcacgcaccgcagtttagccatatcgccgccgccgccgccgccatgctcgcctacctcctccacgcccccgccgccgccgccgccgtggtgcccagcccgctctccctccgctcgccgccgaagacgcccttcctcccgacgtcccccatccgcgtgcccacgccgaggcggcgccccgccgcgttctcctccgccgccgccgcggtggtgcccatcgcggcgtcgctgctcgagggccccgtgctggtctgggccgggaggctctgcctctactacgcgctcctccacatcggcctcgccggctccccgcgcaaccccttcctcgcccacggtaatctgcattagccgcggctggtttcgattcgggggaaaaaaggctgggggttcttgatgcgcctcgtgtcgtgttcgtgcagagattggcgatgatggcgccggggacagcgacctagggttctcgaagtgggcggacaagctgcgcggcggcgcgccaggtttcgtgcagtttcaattcaaaaatcgatttatctctccttctcagttaattttatccatgatttattagaacgcgaaaggtgtgtgggattctgtaatcgttaggagaatgtggatcttggataagatattcctctttgggcatctggatagcgagctttctgctagctaggagagagtgcatgcaattgcatctttggatgggtttagatttgggaccaaaaaggtggagatgcttatgatatgatattgtgtgaaaaagcaagttttccgtcgtcgtttatagtggactataatttttagatgtagaaaaagtaaaagttgatgacttggtggatcgataccattatggaatagaaatgtattgaagatttgtttgctacggatatgggaatcagattctcttggatgtttacagactaatcacagaacatagtgcagtgcaggctttaaatgtgtatagaggtttccctagacttagttattgtattatgcaagaaactcatttctcaaactagaacagtttagcatggatgtgtgcccaaaggtgttatcaagcatttctcaaacttatttagtctgacactttgttacctattatttggtggggttaatccaagttttctacttctggtgtgtatcacctttggtttattaacgaagaatccattgtgtcaattctcactatgccaggatcaaccatttttttatcagataacatgcttatgcagttatgctcaccagctgaatttaacatttcaagtgtcaaattctgtaagattgtgtctaggaggaaagaaacataacattacccaagtggtaggcttaagcagttcacaaggggaaccttcatcattttggtaaatagaacgattttggatccaatattgtagatgttatcattgatatcctgatgaggacatcacccatggacatattgttggctaaacattggatggtggttctagatttctgttccattgcttcgttatgtattggactatggttttgatcaaaagtacttccattttcacacacaagatggataaatgatgtgcgtgttcatctcattcaggagaaaacgaagcccaggataagaggaagctagttagcaaatggaaaccaacaactaaaggcacgctgaagaggacttaccgagttcgttcagtagaagaaggtcggcggattcttaaagaaattgctttggttctctccgaagatgaccactttgtggacgcctccagtcacaaggtgatttttttcatgatccactgcaaatacactttctagccattatgtttagtgtttaataatttaacaacaaggtgcttcagaaaaaatactgagatatttgccatgtttcttgctcttattgtaaagttgatgctcttctaactgaatgttgttgcttacaatcagggttgtcaaataaggagggaaagtgcgcacggcgagagtgtgtgctgctataatgtgagagctctgttcgatgagcttcctacccctcacctagttctggagattacagctttccctgctggacctctcactgataatgactaccgcaaggccgagaggctcgaaatggtgctgaggatgagtgcttccatttaatttcagaacacccattttccatttcagcttacttttgcccaagctgtaaattttctaccgatggggctcgaaatggtgctgaggatgagtgcttccatttaatttcagaacacccattttccatttcagcttacttttgcccaagctgtaaattttctaccgatgggcctgtaaattgattcagtcttgctaagaagttaagaactacttgtaaaacctgagttctgctcaatctttctagaattctaatatttgtgctcagtctttctagaactctaatatcaagaagtctttgtcatagaccttacatttttatggcaccgcacttattttttttaactttgcaactaactgttggacagtggctaattcatgtgctatatctgtttctgttatgtcccaaaatataactaattttagcgttcaaattttgttaattccacatataatttctttacctattttcttatctcaacccaccgcaaccatccctcatttaatttacatttctgcttaatccccattaaaaattttagaagtgttttatattttgggaaggagggagacacattaaccagcagaacgtgttctatgactcaaatttgggaccattctaacttgttaggtcgtcacatcgaatgcaaaagctgataggaactaaaaatcagataaaatgcaagctacaatattcacggggaccatcagtttcagggtttcaacttagagttcagtattagatacagcaagtacagatataagcatccacaaacagaaccaacagtcagttgatcattgcagtgcttttagttacaggaaaacttaaaatggagccacacatgtttggtccatttgaggatgaaactacttttttttttcccataaggtattttcataagccaaggatgaattgccaccagcagggagagagccaaagtgatggtgctgagctgaacccacttcacccctcttcacctcacctcatcatggaaacgcgctggtgaatggcgttcgcgaccagcttcccatctccgccattctgcgctctgaagctcattgtgggaaggaagccagctgaggggaagtggctctgctcatggttaccaaggaattctctgctggttgagacgctcgcgatttcagagggagaggaagctgaaggcgcgctaccggtgccattctgaaggcatgtcctattgccagagctcgcgccaccggatgcggcctcctcctcctgttgctgcttctgctcctcgagctgctttgtgttgaggaagcgccctccagatccacgagctcgcttcatggcatggcgatgccgagattcatggaggtatggctgagaagacaggagaaatgtttttaacttataacaggggtaattgtaagttaaaatgtatagctgtaagtagctattattttgccttgagaaatgaatcacccatgtgattgaggatggtgatcactttaaacatactgagtccaaatattttgatcaatgaatagcataaagatgtactctgagcacagataactccctaagtaacccaaggcaggataatgaatttttagctgaaagatatgtaaagatgcagtgcagcagtcagcatgtatctaagaaaattagggaagtactaacaggagcatctcttttacagtttcatagcagaaagaaaaaaaaaagggtaccaggaaggattgcaacatttcgtattaccttccgacctttcaccaacttattttgggcctccaatttagctcgtatctgtctcctcctaagaattgcatggtactgctttgcgtttacaaatattggctcttctgctgcaggctcaacaggcaacggcacccgggagttagctgtaccattttgctggggatgaacctgggtaaataatacacaaatgacaaattgttgatgctgtgccataagaaaattttaaaaaaatgtactgcgaagatgcacgaaataagtgttatacaatatatcatctagtttctcaggaagacagttttgattgggtggcatcttttagctgataagcttagaaatggtttgtacgaagtccaaaatccatcgatgaagctacgatctttaatctaaaaaagatgcatgaatcaattgcaaactccccacctttaagttttatttaaaaggactctttgttgttttattttttttccttctaaatattaatgaagttcaacaaaaaggatgcacgagtcccctgcaaattcctctcttttatttcaaagcacctgtctactcttttgttttgcttctgaataatactcgactgcaacaattgcttaactaccagaatgaataagatcttcgatgctcatcaaattgtaaatggatgaagaggggagaaaaatgatcttatcaccttgaatcgtcaaagattgtacaaatttgatgtgagaacagaaatggtagagtgaactcacaattgcatgtgaagaatatccagtcaagaccccaccatagtatgcatcagctgtataaggaatacaagcctagaacacaacatagctggtcaactgaaagtaacacttgattcaaagagggcaacaatccacacaattgcatgaacttacaaaggattggctatagttgagctttggaggcaaagctcctggattccccaacgatgatactgactttgttttgtcctgatctggcatctgatgaccatcatcattgtctgagggggaaaaaaggacaaacgagatgttaggttgggcaccggaatgattaacagagataatcgatgtaaattgagcactagaaggaataacaggaaaactcactaatgaaatgacagactcatcaaaactgtcacttcagaatatgcaaaagattactcgaaggtttggtgagaagcatagtaataacaacaataaaggaaaatttgaaacgtgagcattacatacaaaacagatgacatggttttgagttttgacgcatatgaactattatcatgtggaaacacatgataatactcttcgttccaatatgggtttcatgtggaaactcaaatgaaaagttcacataatccagaaaaaaggttgcctaagaccacagcagctcgtcacaatttacagctaccataaagtcacttgcactatagcatagatgagcttgcaaataatcattgaacgtattggtatcatgaatacattcaacttggcactacatccatagacaaacgattgccaaccaagaagcagcatctacaaatgtgttttaaagagacatgattgaagcgaagaatatgttgcgacaataagatctgaaactatactaagaccggattaccattatgacaatacttttaaatatcatgcattaccagattgtgttgaggtatgtcgctcatttggactgctatcattcatggcagattcttcttggtgtgactgtccagaatcgcttgacggggaatcttgatcatacatcttatgacctaactgcttcatctgataatctccagagaaaaaatcctacacatgcagagtctagctggtaaatgtgttactcatgggagtagcaaagccagcaattcccaggttgcaccatcaataactactacttacatagttgggcgtagtatgggctcgatgatcttccatttgtcgcaaaagcattagcattatgagatggtctcactttggtccaggcaccatttttcttcgtgtacttctataattagccttcaagacaagttgataacattaacttaagcaaattgaactgatagggcttttaacctgacctcttcagattggtggggattttgttgcccatcaaaggattagctctaatcctttctatcaaaagatgcctattaaaggtttctactcattaactggaatatgattatgcatagttactttcaggtgttgaattatctaaaaaaaacgacaatagatgttgtaatactgaatagagacagtaggaaataactgaatcatgagattctgaaccataaaagcaaataaattatgatattaccttaatatcataataaggtaatacttaatagtggtactgttcagtaggaacagagtaggcagagtaggttgttaagtgcttgttgcaagagtaggaaataactgaataaaaaaacaaataaatcaacctaaaaagagtaccactacaaataacacacagcatcctaccctaagtagacagacagaaaattcttatatagaaacaacctgatcaagaggaataagcacaaaatgcacattaggtagcttacatcagcctctttttctttttctcgaataagaggtagcctacatcagtctcaggtttacatttattacatgcagatcataaagagataacctacacaacttttagtggattgttctcgagtccaaattgccaatccatatgcacagaagaagtcccttgtcttaatcagaataacgattgaaaagctaaaccactagtaaatcagaacatatcgcagcaagttcacacattcagaatcttatcagagacacaatcgcttgataccgtcacaaattcacacggaatttagcttcaagttaccaaatcctgcaatggggaagtcaaatttccacccactccacggcctaaaacacaactcacagtgcattcgatatacagtggtcagctaacaacaggggatgcattgacttcctcgaaaggatgcatcttgcgatgtctaactacaactccgaagcaagcctaacaaagaa

SEQ ID NO: 64491 - DNA, 25070 bp, Oryza sativa
ccacttgcgggcgcgcgcgcgcgggagatgtggggggggggggggagagcggcaacgtgggctcgaggtgcgggcgcggagagggacggagaaggcggtcggcgtggggaggtggggcgccggcggttggggctcggctccaaccggctagaggaggaagacgaccgacaggtgggccccacctgtcggcgcccgaaggagagagggagggagggagaacttcggggaggggaaaggggaacgggccggcccacaaggggaggccgagcgcggccgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaacttccctttggtttggaaacggtgtactcctctgagcggagtgacacgaagatacacataatcccctgtttcgaaagcgagctcccttcggcggttgtctgcatagcttttctgccgagactgcgcgattctcaatctttccctgacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcctaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaatcctgctggcctttggtgttctgcctttactcgttgacagacgtcacagagtgctacgaattcagctatttcccttctcatgctgacccaccagaacttttctttgagttcttggtacattttggtactgccgggatgaatggaatattgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgtacctcacagcatagttcctctacccatgcgacgttgcagtaactcttcctgctcaaggcatctgctaccacattagccttgccgggatgatagtgtattcccatatcataatctttaattagctccaaccatcttcgctgtcggggattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatggggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctgtaactgttcatcgacttgcttcttgacttccgccaactcgctggctcccattctgtaaggcctcttgtggatcggtgcagttccagttaccaagtctatccggaactcgatatccctttttggtggcattgttgtcagatcgtccggaaaaacctctggatactctctgactataggaatatcctctagtttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggtacgcacgtcctcaggggcgtagcgcgcgaggcggttgaactcatgcaaatactctataactgttctggttccttgttgcagggaacggaactctctcttcttttgtcccacaattccctcgggaacctgtgctttattgaaactatgacgaaactctgtccaagtaacctctgccccagccggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcattatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaattttttttttttaaaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcatccaagggggggggggggcggcgccgacatgcgggccccactggcagcggcacaaggggagagggagggggcggctggcaggtgggccccaccaggcggtggctcaaaggggaggcgagggaggcgccggccgggctcggctcggcctcaaagccgaccggcggccatggcgaccggcggcgacacgcgcggtcaccggcggtgaccggcggcgcgggagacggcggcggccagtgcgaaggcggcggcggcggccgaagatgacggcacacgcgcggagggcggcggcgctcatgggagggagggaaggaaggaggaggagaggggattcctcaccggcgaacacggcggccggcgcgaaggaagaaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaagcggcggccgaggtgcgggcgggctcggtgagcgcgacggcggcgactgcgtggcgcggcggtggctatagtggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgatgtgggggagtggggaggaagagagagagagagagggattcaaatcccccaccacttgcgggcgcgcgcgcgcgggagatgtgggggggggggagagcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggagaacttcggggaggggaaaggggaacgggccggcccacaaggggaggccgagcgcgggcgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttaaccaatttttaaagcaagcaaaggggggaaaacttcagggcgtgacagcccgaagacccgcagtgcgaggatttcgaggatcaagctccagatctcgagcaaggcaagctacctttgaacatcttgagcctatatttgaaatttaattatgttgcttgaaaaatattatgcattgataggatcgcacttaatctgtttgtcccgtctgcaaggcagattggcggacctatctaatttgttgtatttgatccttcttttgttaattgttataccatgtccccttgtaaccatctagttgcgtctcgatattcgtgcaccctgtgcgagtatcgacggacgccttcaaacttaaaatctgaataacaacttgcgtaaaacttgggttttacaaaagatttggaaaacccgacacctgggtcggtgcttgcgaactaaatgaatttccaaaaccgcggaccggggaacgtaccgggtgtacggtttcccgctctcgcacttaaggaccgatttccttggaatttcatccaaacataagacaagtacgaccacatgggtggaatgggacacccttggctgagtaactagcttatcaggggagccttgatgccgagagacatgtggattcgccggggtggtgtcggggaggacccctgggcttcttggcacagtatggtctgggacctaacctgttgttggtctgggactcctctcgtcggcatatggtaaacctgtgtcggctttggaaatgccttgtcatgaaagcttggaggtctcccgacgtggctgatccccacgggctgggtgatccgggttagtaatgtcgtgtgagtaaagtgtaccccctctgcagaggttaacaaactgttcgaacagccgtgcccacggtcatgggcggatgtgaggtgattcctagcgtagttttgtttgactactgcttgtgaaattactgttgtgaaaaggggttcaatgtttgaaaattctgcaggtgatgggatcagctaggcccgggtggccgtttgaaaagtggttggcccgggtggccgtttgaaaagctgttggccgggtgccaaccttgtttcaattctaaagactgatacattgcacatactccgaccggacgagacgcactgtctcatccgtgtcgtttgagaagcactcacctagttgttttagaaaagagttcaaataaaaacaattgcaaaaacaacagcctttccttgaagcctgcattaaacacttatttcccatggcttgctgagtactcccgtactcacccttgctctatataaatgaccccccccaagttgctgaagaagatgaagcggaagctgctgatgaggagttcttccaggagcaagccggctacgatgagttttagggtttcggcctagttcccaagtcgcgcctgtgttgattggtccaagtcctggcttccgtttcccttttgtaatgcagttgtgagctcgggatctgtccgcagcccaacatgactgtacctctactctataataaagagacctctgatgctatgatattctgtctccctgtgataccagcactgtttcctgggactggtatcgattaacaggttaatttggaacgtcacgggctagttccggtcgggactagttcggggcgtgacatggacccccgagattccttctatatgagcggctagatccgtttgaaattgatggtgttaggagagctgaatccgaattaaaaccttatatcttattatcttctatgaactaaaagtgacgtagtaatcttcaaatagacttggggaatactctgatttggtccccaatcaacgttctttttatcatttataaatttttttctcaatctgtttttctttaattaagctagtatccctataaataagaacacacaacatacatttatagtgtaataatgtttgtttaaatatataacacgtagatctcacgtgtaaagcatacaaatttgattgatgataacatacgagcctgccgtgatctccttcgtcaccgtctctaccgatgtgatgctccttggagcgccgcccctaccgatctcgatccctgtacgcgtgtcgagtagacggaccaggtaaaagtaaaaaaccaggcaatatgcatcccacacttctgccacctgtcccgctgtccgtgcaccctcgccccttcccggcccttccggaggaacccagccaccatgaacagaaccaccagcaacttagggccctttgattaaaaagaattcatagaaattttagatggttttattcctgtaggattttttttctatatagccctttaaattaaaggaattgatcctataaaatcctatgaaattcctatggattatctttttccatacaagttttgcaagttttggaggaaatttgacatgagatagaacctcatggaaagaatcctttgagtctttatttctcctcaaattcctatgtttttcctgcggcccaatcaaacagtcatttctatgtctttcctgtgttttgcaatcctctataaaaccagttaccactagctttaccaccagtggccgcacctttcactctgcttgatctcttcgtcgatctcctccattgttcgttggtctccacgcgcgcgatctggaattacaaacttgtagtgccgatggttgcggcgccgtcgatgatcgctgccgtgcccgtgggcgtcgggtcgaccgccttcttgtacttgctgtggccggcctcggcgccggcggcggcgatgatatgatgaaggcgccgggcgccgccggctacgtcatctcccgcgcggcgttcctggcgaacccgcaggtctacttccacctcctgcgcacggtgggcgctgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatataggctcatttgcaaaagcagcatttagcaaagagttaagagtagtaaaacagtagagtaattaattaaaaattttaatcaacactgtacagcacacccatgctgcacaggcccaaccatcctgaacaaccatacccggctgtacagatttaactccaaaccaggagctaagcaaattattaccagttatagcatccataattattgtgagaggtgtgagactaatcacgaaaaacattgttcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggtacggttaatgtttcacaacagtacctcgcgaaccggtccttaattgtcatgagcacgactctcaaaaccatgtgctcacaacccaccattatcaagttttagttggcaagtaattaattaaccaatcacgtttgaccatcgtgagctaccattaaaccatcattaaataataacgaatcataagttatcccaatagtgtgctaatgtttctaagcatggctaagcaatcacatctaatatctagctgaactaatatataaagctcaactagtcaaattataataacccaaggtatcaaggattaaagtaatcaatgcaagcaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgatttcatatgaatttattatgaattttacaagattaaattccaattaaacctattaaagaaaagactattccaaattaattaaacaatttacaaatgatttataacggagacagaagattaaagcaacctccggaaaagattagattatattggtagatgacatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcatggtaaaaccccggtacgacaaacgatagaccggtaggaacctagggttgcacctacggctgcacaactcgactaaaagcagcggctaggtttaagcggcacacaactgcgacacggcggcactagggcgacttggcttggctaggcggcagctcagcggatacacaaagctagggttagggtgacggcacagccggtagcaaccatgcacggctagaacagcagggctatgagcaaaaacgcaaccggcacggctgcggctgtggcaaagcggcaagcagctgcagctaagcggctcagccggcacacgcgcagcagcggcacggcaagcagcagctacgacacagcgatgacgacacacacggagacgatgatgacgttagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggcttttcggcgacgagaggcaacaaccgagggcggacggtcttcacctcgctcctgcgatcccgagggtggtgacggtgaatgaaggcggcgatggacggcgacgaacggcgcggctgaagatggaacggatcggcttcacggtgacgacgggcttcccggggtcttcgacgacggggaagtggaggccggtcttcttctcctcctcgcgaacccaacggcggcagcggcgaccgaaggcgacgaccacagcgacggcgcggggctgctggagcggcgccggcgaaccacgatacgacctcgccggagatagagcggccggctgcggatttggagggcatgcacacgtagaggacgacgaggcgaacccaacggtactcaccacaacgacaatcgacgtccgacgacggccggcgacgagaggaggcggcggcggcttggaccttaccgacgacggcgagctacggcggccggcggcgaagaaggacgggcggccgggcttctccaccccttggcgcacctcttggcgacggcggcaagcggcggcgacggcagaagcggcgcggcggcgcggctgcactcggccggcggcggcgacgaactaaacgcgcgcggcgacgaggctacgaggcactagagagctcgggagagggggcaaacgaaagaggaggactagggggtcctatttatagccttggaagctcgggtccgggcccaaaacgacgggaaaaactcgggaaagtttatcttcgccggaaaaaggaaaggatttgatccgcgaaattggaaaggatttccatataaaattttggggatttcttggggaaaaggaagaggagaataagaggaatatttcccctcaactaatttggaaagaggagcaacgaggaggccggatttggtggaagaaggcggcactgtgcacaggctcggctggctcgggctctgtccagagctggaagatgaacagtgccagggaggcaaactagacttttttcggttggctgagaacagaacagagcacttgacttgggccggcttgggctgcacagcacgcgcgcaagggagagagaagaggaaggaatgggccgaaaatggcccaagcggaggaggaggatttttattactttcccaattaaaataatcacttaaatgatctttgaattgttaaaaatacttccaatgctcaaataatttcaagaaaaatcatgaaaatacttggacactcaaagtatttaacaatattaaaaccagaccatttaatgattaatttaatatgtggattattactgaaatgttctttgtatgattaaaaattaggaattgagctccgaaaaatttgagaagatttcagagagttgacttaatcatggagaatttaataaaaattaaatccatccatgctttatattagggaaattttatttcccacatttaacttcacttgtaaattaaagaacatttaatataaattctattaataatttattaaataatttataaatcctgaaacgaaaatcaggatgtgacaggcgccaaggcggccgccgccgcttttgctgtcgccgcctgacgcgcgcgacggcgccggcgacgtacgtactccactccgttagctattgctgctgctggatagacgactacacacctataggctatagctagctagtaagtactatgtagctacactagtacatagttatcctccacgtacgtacgggaaaaagctgctggttttgttgtagggtaagcagtgtggttgatcgtgttggaattaatgaatgggtcttagcccactcgaagattaattctttggaaaatcacaaaagcccacctcatgggatggcatgcatgtggagtttagtaccacttgcttattctaggagagggggacctccttaaaagggaggataccctcccagtcacttgaagcatgtgtggtggagagaagaggggaaacacgcgcgcgctcgctcgcctcgcctggcctggcctggcagggcagggcaggcggcgcgcgtgcacgacgtacgcgtcgaatggtccgaaaaattggctcctaacccttgcgcagatgcagcctctttttgcagttttgttttgctgcaaattcggattcgtttttgttttcgacaggaatcttgttagtggctcccgtctgaccagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaagagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacgccgcgggactgcctaaggcatggtggggggaggcattgttgacctcaaatcatgtgttaaatagagttcctaacagaaataaggacaaaacaccatatgagatatggattggtagaaaaccatcactttcttatttgcgcacatgggggtgcttggcgacagtcaatgtaccaataacgaagaagcgcaaacttggacctaagactgtggactgtgtttttctgggatatgctcatcacagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtaacagagcgaccctatgggtgtaaacctgtggggtgcaagtgggtgttcaagaagaagcttaggcctgacggtactattgaaaagtacaaggctcgacttgttgctaagggctatactcagaaagaaggcgaagatttctttgatacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcaccatggtgggggtgagggagttattttgtgcttgtatgttgacgacatactgatatttgggacaaatcttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtaagcaagttgagccgatttacctctaatccgggagatgatcactggcgtgcgcttgagcgagtaatgcgctatctgaaaggtactgtggaattggggcttcactattctgggtatcctgcggtactggagggttatagtgattctaactggatctctgatgtggatgagatcaaagccactagtggatatgttttcacactgggtggtggtgctgtttcatggaagtcttgcaaacagaccattttgacgaggtcaaccatgaaagcagagctaacggcactggatactgctactgttgaagcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaatctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtcctgcagagtattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcacgctcgctcgcctcgcctcgcctggcctggcagggcagggcagggcaggcggcgcgcgtgcacgacgtacgcgttgaatggtccgaaaaattggctcctcacccttgcgcagatgcagcctctttttgcagttttgttttgctgcaaattcagattcttccgaaaaatccggtgcgtgcaaacggcgtggagtccagataagttacgcgtgacttatccggttcggttacgcgcagtagagatcgtgcgggcgccctgatcaagcgacccttctctatataaaccgacctgccgtcttcacgcaacacacacgaaatcaatctagggtttgcctcctactctgtactgcgccgtcgctcgtagactactccatcccgctcgccagcgtgcaccggcgatcgggagagcaggtctccggaacctttgctttcgacgtcctgcaccgggagaaggcggcaataagttttttgggaagcgcttcgcgcgactgctccctgttcgttcgcgacggctcgccttcctcttcgctcgcgtgtttcgtgccttcgtagacacctgcgaaaagtttcgaccaagcagccggtctttctgtcacctcggtacgtgttcaatatgttgcgcatatttgatctgtttatgttatactgtatagtttacatatgtagatctaatgatgcgttcatgctagttttcatctgtaatgtcatgatttatttatggaataaattaaatcattatatgtctataatctcaacagatcgtgcatcctagctttgcatggatacacgcccaaatagtatgttccattcgaattggtcatcgcgtactcctttagttcatccttaaaaaaataaactttaatcccttcatcctataaaatatatcaactttaacctattataaaaatcaactttaatcccttcatataaaaaaatcaacttaaagtcattatgtggatgcacgatcgagcaatttattggtgaagtttattggtgaagttagggcctgtttagttcttccaaacctctaaaatggtaaaagtttttaccgttttgaagcatattttgtcaaaatgaatctaaacactagtagtaaaagttatcaatttaatatttgtcatttgaaaatttgaaaatctagagtagtaaattttgtcgaaaagtgcgttgggagtgctctctctaccagaaaaatggtagaatatgcatctaaacagtaactattaaaacttcaacttcaaatgctaatttttttttgtcaccaaaacttttaccacagaaaattgatttaaacatgcccatagattataaaaatcatgaacgaacgagtctgagtcaatgttaacggatctatcgatctggataaaaaatgcatatctaattttatttttaaaagttagatattatcgttagaagttaaaaggtccacggatgtgagtgacaacttatttagtgtgagtgaaatttagttacaaatgttggtgatttttaatttttattttactatattctaaaccaaccaaacaagcttcctttccagatttttagtgctatgttgagtttcatatgttactatgttgttactagcctactactacctacatctatataggatttttataaatgagaatgttctagattttttgtgctacgttgagtttcataccacttcttccgtcctatgaaaaattaatcctttcatcccataaaaaaataatctagtattgaatgtaacacatatagattagttgtactagagttctagattcactttttgttaggatggagaaaactagggtgttactagcctactatactattacctacgtctatgtaagagcaattacaatagcacgctataagccagctataagcatattttaaatagataaaggaagagagaagagcagcgggctataagtctatagccagctgtagcacggactccaaaacggaatgtgtgtatgataggtgggaccaggtattaatagtatagtaagcaactattgtatgaattggctattacattggctatagatgatttaaaactagtagtggactatactattaaacttgctctaagattttttataaatgagatggtttatttgggggaaggagcacactactactagaatttatcgtctgctcacagatttagggggtgtttgggagagaggggctaaactcaaaaccataagtccatatcctagaaacttatgtttttgagagaggggctgaagtctcccaaacacccccttaattactcgggtaaacgaaacgggcatcctctcagtgctgcttctcacttaattgtagaactttattgaaggatcaattaccggccggagtcccaaaaaagcgtgggaaaaaaagacacggctagatcgcgcgcgctagcggcatatcgctaaccagcgacgcccttctcttaaacagttactagtacactcaacagtacatgccttttttttcttcctagagaattttctcctaaattacttatccgatttataatccgattacaccattatggttgttgtaattaaatctttacaacaagatcttacacgaaatatctatgttgtaaattacttttattatatatgtaagctacttttgtcctatacataaattacttttagatttaagctctttaataacttatatcttttaaatcacatattattttcatgatctatttacatcattgtactctacataaaatatgagataaaaaaatccatgttgaatatattcaaacatttcattaatttaaaagtaatttatttaaattgtagtagtaacttagctatgcaatagatgtaacttagctatgcaatagaagtaagttagcacaaaatagaagtaagttgttacaacattagaagtaaattcgagagaaaaatattttgtatctaaaaattaaatttaaagtccataaattatagaattgactaaaaactataataaatataatcgacttaaagcattatgaatatataaaaagtaattaattaaatctaaaagtaatttatatatatgataaaagtaacttaagtatataacaaaagtaatttacaagtataaatattttttcatcgtagtataatcatgtaagatctagttttgaagatttaattgcaacgaacacaatggtgtaatcggattatagatcggataattaatttgagagaaaactttgtaagaagggaaaacaatacatgatgtgtaatagaaaaaaaggcatgcatgtgcgctggcttctccacggcttctatggttggcgtcgcccgataagacaatatcaagaggcctcgctgattagtttttgcgaaaaaaaaaaagcatcgtcccatcgtcttcacacattttactacgagccgtttgatctataccgtccttcaaattgtgatcagcttccaagttccaacccatccccttcccgaggaaaacaagcaaattaatgcagactaaattgcctatatataccacgtctagcactagtcatctcgatcttgggaagttcagaagtagtcgaccttgggaggttgagaccgcgatcgatcgagagctagccatggtgtcgctgggattcgtcgtcggagcggccgccgcggccgtggtcggcgcggcggtgagcctgctgctttggccggtggcggcgccggtggtgatgatgaaaggtccaggcgccgccggccacctcatctcccgcgtggccttcgaggccaaccccaagctctactactacctcctccgcaccgccgccgccgcgtgacgacgtacgacgacgacattacgtacgcacgcattgtgatcgttgcttgtggttctacttctacctattaatgctagatgctttcttgcatggtcgagtatgttcgttcgatcgatcgggatggctgcttgtttccttgttgctctgtaatggtttgaaactaatatatatataaacggaggagtatttcagaaaattttctgttctctagttctctcgttcttgtattgaatgaggccttcttgcgactctgaacgtcgatctatatcccatatcctaagcctcatcttaactatgagtctagacacatattcttagttataaaatttatcttttttacagagagaggagtaatagttgtgatcgatattgtcatactctgtgatgaagccaaagtaactttttgtacatttggagcttagtgtaattttctttttatattttcttatgtgcgacaaatggtttttataatggtagaatgattaaacgtcgataataaaaaggccaacaatgaagcaatggaggcttctcttgaagtttcacagagctgcaattgtttcatcgagtagtagaacaaatcgaacaaaaaaaaagttgacgcggttgagatcaagtaaacaaagagtaagcaaaatcaacgaaatcttgcgtgagagggtcaagattacctccgtaaccaaccaaattcaggttccacctaaaacacttctggatttttattttattttattcgatctcctcttatcactactaggaaaactatttttcgtggcggtcattttgcgttttcgctaacggtatttggagccgccacaaagcaaaggccagtgaagatctaagattttcgctggcagttgcgatccgcttgcgaaaataggattttcacaggcggacgcttaagaggaccgcttgcgaaaatagattttcgctggcagacccttaagagaaccgctgcaggcggatccttaagag

SEQ ID NO: 64492 - DNA, 3347 bp, Oryza sativa
cttcctttttatgaagaaaagtatccaagttcatcctgacaactagtagtagggtgtatcaaaatgataaaaataagagaagacgataccatataaaggatttaagttagtaaaggcaattttgcttctgttgaatattaccttggttccacgaatagggattcagatgtacaccctgtccatctgcattaacatgaaaaggtcccacttcttccgcaacgccatatgcaattgatgagcaacctggccctggaagattaaatgcagtaaaatcagtagtgtgctctcagaactcaaggatcgtagcactgcaaccaaatgaatttcatggagaaactaatgcataatatttcagttaaggttcttaattatcatttatcaataccacaagaaaaaaaaatcagattcaccgacaacatcttgcctcatgtaagaatagaaaagttgtcctggtcatcttgaaatatttaagagagaaaccattttatgccactgagtttactctagttcaacgatttgccatcgactccatctacaatatgccactgactttttcaattttttatacaatacaccattggagtgtatatttttcaaaaactgcctaaaatgcctttcaagacttacaagaggttacaattgattgacctacaaaattttaaaaaaatttgcgtaaactccttgcataatataaaactgtgtgtatatatcaaaattttcattttgcatgtattatctttaaaaatatataatttatgttttatatgctaatagaatactttgtgttaatgttctttttgtacatcatcattcacatgttatataattttttttatgcaactatctttcgtgtatgtgattcctctttcatatgctatataaaatagttttttagaaaaaaaacatgaaagaaaatcttaaaatatacacacaaactttaatattttgtaagaaggctaagtacacaaaaactttcatgtttttagaacttctagtgggtcaaataattgtcttctcttgtatgacctgaagggtattttaggcatttattgaaaagtatccaccccaatggcatgttgtaggaaaaaaatgataaagtcagtggcatattatagagggagacaaagtcaatggcaaatcgttgaaattaaggtaaactcagtggcatagaataaattctctcatattttaactataaaaaattataataagctggctttagaggatgtatatgaatgctgtgtagtggaaaattttgataggtattgctggaagcttggaggttagttcagtaaagcctagtacatgtgaaaacaaaagggaaaaatcacaaaattaaactataagagttctagataagtgctaattgtggtgcccaaatgtgaaatatgatatgaatcaataataagaaaaactataccaattttaagaacccgagtaccatacaaaaaatatttgccctttcgtatctccaaaataaaaataagtttttttagtaagaaatgaaaatgagtttgatccggaaattgtgtagagacaacagcccctcctcatcggaagaagatccactgacgttactgttcaccgtgactgacatgtggacccatcactctcgggcccacatgtcagccactatgtctgaggatctcaatcctcctccgtctgcggatacttcccccctcgaacgaattacagttacttgtgcatttctaccacatcagtaataactaaaaccctcgagatatcaaatcgactaatctccatgtactagtcttagcataatccccaccccccaaaaccccaaattgtgcatccgaatcctgcagaagaaagctgctcatcagataaggaatcaacggaaggtagcgactttcccccaaccacgaacgcaacagctattcgtcgtgcgtctcggactcggatgagaaaacagcagcagcagcagcagcagtacaagtcaacaagagaccaaatcggaaaggcggggcggtggcggcggcgggcgctcacctccgttgagccagagcacgaggggcttggacgccgggtcgtcggcggcctcgaagaaccagtagaagagcgaggcgccgcgctcctcgctgacggcgacgtacccggcgtactgcgcgaacccgacgtcgaagtcctgcccgggcacccgcgccacccggtcccgctcctgctccgcccgccacgccttcccctccgccgcagccgccgcccacggaggcggagcacaccctcccaccaccaccacaagcaggagcacgaggagggagccgatggcgctcgtcgtcgtcgtcgtcgtcatcgcggcgatctcggagaaagtggcttgcgtgctaccaatgggggtaccagtagtagtagtagtagcttgttataatgagctactattcccctcgaaattttatttgattactacttacaccgtttcaggttataagacttttatcaatgtctatattcatatagatgtcaataaatctatatatatatatatatatatatatatataaaagaatgtgggcaatgctagaaagttttataatataaaacggatatagtatttttttaattttaaattttaaaaataaatatttttaaactactcgctccatcccatgataagctcatttttagttcgtcccaaaataagtttgcttttaaagttatatcatatcaaagtctgtgaaagttggaaataattgtatcggaatttgatcaagtatggatgagtaggatgagtgaaaaataaacttattttatgacggagacaatataatagagtttggttttatgagatatattctaatactagatcaaagaaagtgtccctttcattctataaaaaatacaatcctaactacgaatctagattttaaaaataaaattttaagtagcatatttttaaaaattaatacagtacttaataggcaaaattgctacaggacacccgaaaatcgtgtaattggctgtgagacactgcaaaatattggctttgcccacggacattatgaatgttgtgaaattggctgtgagacaccggaggcaatattttataatttccgagataaaagaggtcagataattttctaaaagaccaatccacccctgcgcaactggtatgccacggcatgccggcatggcgtgtgcgcgccgcgtcgcgccgcgcacagacgcgaataggcccgttcctggcgcgttcctgacatcaagctagcaggagattccgcatacaaagaaaatctctcgctcgtcttttccggctgcgccattactgtttttggctgcttcttccacctcaatcctgcacggcgatgatgcaactccttttataatccact

SEQ ID NO: 64493 - DNA, 5119 bp, Oryza sativa
atgtttcatgcgtcctttccaaagtctttaaattttctgtcgatgtttcgccactgcgaaccatcggcggggtgtctcagcatcccgtcctgttgacgctcttcagcgtgccatcgcatcattctagcattccccttgttcctgaacaaaccccttaaccctggtattatagggaaaaacccctcacccttaccagaattctcttcttcgttagctgcccctaacttctcttggatcatctcgtctaatcttggatcatagtgctttgcaaaacggggcatgcttctagattatcgtactcctcaccgcgacataggatacaatcattcggagatgcgtgaatcttctgaacttccagtcttagagggcagactatcttcttagcctcgtacgttgtctccgccaatttgtttccctccagaagaatgttcttgatgagtttcaataaatcgccaaataccttgtcactaacaccattttttgccttccattgcaagaactccagagtggtatccaactttttgtgcccctgctcgtaacctgggtacaacgacgttctgtggtcctctaacatcttgtccaatttatgggcctccttttcactttcgcaatcctccttggcgtcctacaacatctgactaagatcatccgcaacgttgttaccatcagcatccctttcctcctcgcccgtttgatttccttcaaatccagcgtactgagcaaagtccggaatattgtcgtcttccacttcatcttcttccatttcaacaccttgctctccatgggatgtccaacaattatagcttggcatgaaccccgactcaaaaaggtggaaatgaatagtcctggatgcagaatactcctcccgattcttacacttattgcatggacaacaaataaaacccttttgcctgttagcttcggccactctcaaaaaataatgcatgccgtcaaagagttaataaactctttggaccgccggtcagcgtacatccattgccgatccatctacatgacatgaaaaaaaatcgtacacacataattattcgtacaataatgacagtcatacaataattataaaataattacaaactctttcaacagtcacacaataatgacatatcattattcatacaaaaattatgaaatattacaccgaataattatatatttactatttataaagttttaaactaatattaatgtgttgtacttattttaatttttcattttactttattttctattattcaagattaactttcactatattttccttctcaactattttataaaaccttctttagcaaataaactaaatttctatatattctttcttctccacacaaattttctctctcatcaactaacaacaaaattttggagacaaaaaagtgtgcaaaacatagatccaaatgtaatatgaaaaaaaaaacattggaggatgaagttgctaaccttttaggcacctccgatttgtatataatccccagaataaattcactagaaattttggcatgacctcccctcttttttgaagaaattttgaagcttgctcgggctggaggaggaagaagacatatatataggggtgggactttagtcccagttggtgttatgaaccggggctaaagatcgccgggatgtttacaccaaccgggactaaagtatctttagaccaaccgggactaaagatcccgagggggcctgacaggccctgacagcatttgaaccgggactaaagatcatctttcgtcccaaccgggactaaagatcaaatatgcccgttaccctttttaaccgggactaaagatcatctttagtcctggtttttgttgcaaccgggactattgtggaattagcccgaccgacgaaagatggtttctccaccagtgaaccacagtagacaaagtctctcctaattaaaataatattaagtaatatgtcctataacttaatgtgaaatactagagaaagaaatcaattaagaagcatatttgattgtgttttaattactacatggatgaaatattgatatgtgtgtgtgtgtgtgtgtgtcgtatagtaacacatagatgcatgcctgtatatatatatgcagtatgttgtggagcatggaggggagtcagtgcgagcgatgatggtgatgaggttgaaggggttaatggttatgatgagctgtcaaaagtacggatcgaatgtgatagagaaatgcctgacatttggtagcatccatgaccgtctcgtcatcgcagctgacatcgccggtgccggcgaggaccaaatcctggtcagtactacattttgtcatcgatcacacacacaaagacacacaaatacacacacacaaacacatgtacacacaaagagacacacacataaacacatgtacacacacagacacacacatatgtgcttgtgtgtttatgttgatgctaatgttgatgggcatacatatatgcagatgatgatgatggacgagcatggaaattacgtgatacaaaagatgttggagacgatagcggatgagtgggtggtggacttgatagtcacagttgtcaaccgcaacttcttcaggctcatccacaacatccatggcaggcacgtcctcgcccgcctccaaatcatgctcgccgctcgcggttcgtatataccttaattactctcttagtttcattttttttacctagcttacattgttcagttcaattcaattcattatctactaattgatccattagcttgttctagacaattatatatgtataatttcccataaacaagtactagtactaaattgattcattcaattcattgattgattcatgtgtccaatcgttgctgcacgcagagaggaggcggctgctggctcttctcaccccgccgctctactacatgggttaattttagttgacaaagagagtataagctagttgttgggtgaattaatgttgctttccttcgttgtaccatacatgcttgttgtaactacatttcatcagtccggtggtgttgtacaatacaatcagttcattagaactgtagcgaacaagccttttaattttaagcaaattttgctactggacaccgtaacttcgtggtttagctatatcctataggacaaggcacgaagtgacttttgggggaaaacactcccaaaagttggatatttgctggtggacaccgcactcattaaaataataatttccggttgaagaggagagagaaatcatgtgaaatgtcaaaaatgcccttgggcccacatgtcactctcctatctatcttctccctcccatgtcgctccgccctagccctcccgcagccgtgggacctcgcctgccgccatcgtcgctgacaagtgagatgagagagcgaagaggaggagatatagagagaagagagataggggacctgacatgtgggcccaagggcattttcgatctcgttgttgtgttttgccggcaagtatttactcttatatgttttacgtaaatgtatgaaacaaacttccattcctttcaagttgcataatataggttacaattccgggaagcggaaagaacaaggcaaccagttggtcatttgatccaactagggttcacaggacgcaaaatattgtacagcttcatgagaattacccagaactaaaggataagatatatgaggaaaaggaagcatatatcaagaaattgcacaaggaaaagaaggtcgaggaagcgacatacttgggatgagcaatgctctcacacaaagataaaaatgtcttgatggtcccttacgcttttatgtaagcagcaactcttccatttgattattatattcgtagtaatacatcattactagcaaatgtcaactccaattcatctatcttgtttgcagcggctactatattttattcctaatatgtccaaaggaccaattgatcgtagtgcttgacccaacacagtgtgataagcaaagctacatggagttcctcattattctaaatttgtataataaaattccccctcaatacctatttgctattctgaaatttttaaataactcgaacaaatgttttatcggcacattgcacatgggttttacatcacacataatgggctaataaaggatccacaggacaaaactaaacatcaagacaaactagctggtaattatgttcacagtgttttaagcaaatacaataccccctcaatacatatgccatgaacacaaattctttgaatgaatacttgtttataatgaccggtgtgataattatgttcacagtgttttaagcaatcccgagcactaacctatgtggatattatgtgtgtgagattcttaggtcaacgggaagtacacaacaaactgcaaaaatgtaagttcggagattgttctctacagagtatttcatccgcaattcatttcctaacatttattgtcaattttgtccattgatccctcaaatccctcatgtagcaaatcggtttgacaatacatcaattatgaacgtatgcactgacatgtgccacttcatttgccgtcactgctgcaatgccctagaaaaattctatgacaatgagagccaaactggtattagaagagaaaattcaagcccataagagaggagaaatttgcatatgtgccactcaaaaaacatagtttcgctagaatgccactctaaatatgggattcgatcaaatgctcaactcgcgggcattcgttgcaatgccacttttgggctttgttgcatttcgaaattaattttcctcaatttcatattttctcggacgcttttgcccttgggactggttgaattggacgctgagccccgacgaacagcgtgcgcgagcaccagcgacaccggcaccgccccgatcccccaccgtactgcctcctctcccactagctgcgcgcagcctctctccgccagccgttccacttccgctccgacacttcagccatggccagctgccgccagccaccacgtatgcctcgcggcttcccggtccgatggcgagggcgacgacggcgtccggggccagtgggaggtgtcggggcgggggctggtaggcgacgagccgccgctagtggcgcccgccatggcatgtggccttcctcctcctcctcctcctcc

SEQ ID NO: 64494 - DNA, 2430 bp, Oryza sativa
aagccgaggcggcccaggaggaggggagggagagaagatgggccgggaaggagaggagggagggcgggcccagaaggaggaggagaggagggagtgggctgcccgggaggggaagagaggcccgggagagagagggagagaaggggagggagagaaagagagggaggagagaaggacttttgggctgggcttggcccaaaggaggaaggagggttatttttagattttctttttaataaactttgttaattgttgttgttgtttaataattatttccggcgctctgaaaattcaagtaaaatttgagggctcgttttagaccaaggagaatttaacaaaaattctccgggccacattcgaatttttcttgtacgtattttagtgtttgccaatttcttttcgaattttaattaattctattattccttttagcgaatgaattttatttcgggatgaatttatcaggacgtgacacaacccaggccaactattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgataagaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataataataacaataataataaggtcataacaaaggtaaataggcatggctaaataaaacagtgataacgcgggaatttaaataaagcgataatgcaataatttaaatcaacataattttacaaacggggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccatggtggaccgggcgcacgcggctgacgccggccggcgtcgtgggtcccacgcgtcagccgcacccgcgggcgcgggcggctgacggccgggccccacctggcagccgcgggacgcgcccgaaggcggccttgccggcacggccgacgggaggcggcgcgcccgcgccccgatggtcgccggcggcgacctccggcgcgacggagcggcggccgagagaggggagggaagggggaagtgaaacggcggtccttggctcaccccgggtcgacggcggtgacggaaacggcgaccgaagcggcgagaggcggcggcgcggctcgggttgacgaggacggcggtgctccgacggtcggcgggcgaaacggaggagtggacgaggtcgacgaggacgcggcgaagccgaaggaggtgacgccgagacgggaggaggtccggggcgacgacggcggcgaaccggagctcggcggcgacggcggagagagaggacgacagcgcgggcttgattccgacggggagagaaagcggcgagcggcggaaacggagcagagaggctcggggagcgattatataccgtcgggagggggagagagcggccggaggggaaggaatcgg

SEQ ID NO: 64495 - DNA, 1515 bp, Oryza sativa
aaaaagtcaacggtgtcaaatattttaaaacggagggagtataaaaataggatgttcccatcccatcccatgatatctcccaaccaaacccaccctagcagtcccgatgcacttttgcgctggaacttgcagaggttcaaggctcctactgtacgaagtcgaacactagtgcggttgatgggctgaaagcccaccgaaagatcacaaaaacacattcaaggccacagagatcggttaaaagcccatacgtatccaactacaactaggcccaagtacaaaaaatatttatcgatctttacaagttggttaaggcagcacatggcttttagaggcgcggatgttggatgcgcgtgccgtaaatttttcatacggacgaaaatcgattgacaaatagtataattttaatcgagtgttgtttatacacttttttcccgataagaaccagatctcctggttacgagaatagttgtatatgtggcgtgtagagaagagaaaaaataaataaatgaggaatgttagctactccattatgtaatagctagctctacacatgttctaatagaaagaaagaaaaaattgtaaatgcaaccttatagctaatctttatatatattagtgagagcgtattctatacacacaagatttcacgtgttaactttcaataattcagtgaagaaattgaaaacgtcaagggcttgtttggcagagttttaactctagctcagtttcagctctatccaaaataaaagtaagctaattgaaatactcttacaaaataaattagagagatgaaattagatttaaactgccgtacaactttattttatatagatctagtttttacttaaatttaagagtttgaactgttaccaaacaagtcctaaaataatttaattaatggggtacgtggcaaacgtaacctcaattcctcaaataacacgagaggctgcggcaaaaagccgacgacggagcaaaacgataaagcgagagagacctgccgagaccaaactcactgccgtgcgccaaacgtgcgctgcatataaaattcgccggaattccatctacccgcacaaaatattcgcgagatatttttgtttatcccatccgaactgctcattgatccgaccaaggcgacaagcacgacgtcgccatcgtcatcgccatcgccatcgccatcgccaattcgccatctcatcctctttctctctctctcgcccagtttggtgcacctgtccgcgacgcatctgccgcagcttcgcagcagcagcagcatcatgggccacgccgccgcagccgccgcggcggcgcacgtgccgctgggcgcgatcaccgtcgacgacctcctcgccgcgggggtggcgggtggtgcggcggcggagctgcacgaggcggtccggcgcgcggtgggcgcgcgcggcggggacggggatgcggcggcggtgtggggggagctctgcagggccgcgctccgcccgggcgtgccgttcgcggtgcaccggatgctctactacggat

SEQ ID NO: 64496 - DNA, 3089 bp, Oryza sativa
aagatagagccgtgcctgtgcatttgctgcttgtttgtgacaacacgtactagtgataaaccagcttagtgtaaaatatcataattttatggcctattccctctgtccaaaaatataacaacgtttagttatgaatctgaccgaaatatttatactttgggacagatgtactccctccgtcccaaaaaaaaaaagacaaaccctgggtttccgtgtccaacgtttgaccgcccgtcttatttaaaaaaattatgaaaaaaattaaaaagacaagtcacgtataaagtattaatcatgtttattatctaacaacaataaaaatactaattataaaaaaaattcggacagtcaaacgttggacattagtagtattcgcctagttgatttcttttttgtgagaactgcctagttgatactcctacttgatactgagtggctctgttgcaagtagaaaccaaaacatgccgtgaacattaggcaaacaaaaagccatggacacatctggtttggatgagaccaggacaatcgacgaaagaagagatggaatggaatttaagggaggattgtactgagaagttaggaatatgacaggtgaaaattgtaccttagctctcttctttaccactgaaatgagacagagcttcttcagcctttgtttcaggaaaacaaaaaaagattgtgcctagcatccaaagcggaaagaaggagaggagagctccgtttttgtatttaggtgtgtcaccgtttggaaatttgaagtttgatgctggcagtggcagctacgggtcgtcgtgatctcgatctcacatcttgtcctgtggatgtgaatctgcttaactatgacgtataacctccgtcctaaaatgaaaaatattacggagtaccatctaaaattggatatgatatatgatactaccacctagagtagaactagatatgatattacctaaatctagatatgagcatattcagattcgtagttataggtaatatcacatctaattacaggtagtaataccaattataggtagtactccattcgtcccagaatataagagattttaatattttgcttgcaatgtttgaccactcgtcttattcaatttttttaaaaattattatttattttatttgtgacttactttattatctacagtactttactttaagcacaacttttcgggttttatatttgaaaaaaaatttgaataagacgagtgatcaaacgttgcaaacaaaaactcaagatctcttatattgtgggacagagggagtaatattttacgatggtgccatatgtcatccaacatctgctggaaacaccatggcacgcttgtttgaggccctgtttagatgggactaaaacttttaagtccctatcacatcggatgtttgaaaattaattataaatattaaatgtagactattaataaaacccatccataattttggactaatttgcgagacgaatctaatgagcctaattaatccatgattagcctatgtgatgctacagtaaacattctctaattatagattaattaggcttaaaaaatttatctcgtgaattagcttttatttatgtaattagttttgtaagtagtctatatttaatactctaaattagtgtctaaagacagggacttaagttaagtccctagatgtaaacaccacctgattcacggattgaatttgaattgcacggtgaatccaacgagacggcgacgagcacagaattctcactgctggtatcgcgtcaggtcctggcccgcacgttgcctgatcgcgaccagggggaggaagaggaccggagtgcagcagcgccgcggcggcgtggcgttcgtcagtctgtggctctgtgcgtgattcccttgccgtcgcgcaacctacgataacgccgggcccaaagcccatgagcgcacagcgtagagctgggccgaaagcctgcgatgtttcagcgacgagttgggccgaaactgggtacccgccgtggtttatgggcccatgcacttatgggatgctgactttgtgcaaatgtgtaattgtgccgctaatacgtgagccatagcaaagtgagactcgtatgtcagtgactcaacttcaaactgcacattcacttctccgctcatgcagacctagatttggatcaactgcagtcagattcgaatctattgccggctgttagatttgaatctaatggtcaaaatacgtttagggtactgtacctaagaacctaactgtagcaaaaattggtgagtagtcttacattcacactgaagctaactatacagtgttcaatatcaaaatggatggttgcagttgcgtacagtagcgtagcttgcaatctctattgaaactttaggggatcccaatcttacacaaccacagcgtggtgcaccacacttatgggattaagataagccgggtgatgattgcttttgtgagcttaagattctgtgaagattttttttttagaatatgaaaaaaccacccccttcgtattttaatgtatgacgccgttgactttttaacaaacgtttaacctttcgtcttattcaaaaaatttatgtaactataatttattttaggaaaaagtacgaattaccacccccgaaccatcgcggttgtctaaattacccccctgaaccacaaaaccagacattcttcaccctgaactttcaataccggacgaaataccccccctcgacccaatccacggtggttttgatctatgtggcatacgcatggcagctgagtcaacattctatttattaaaaaaaatatgggacctacatgtcatactcttcctctttcttctctctctcacgggcgggaggcggggcacacggagctgcggccggcggtgggggatgagggtgacgcggaggcagcggcggtagtgcggcctcgccggagtcggacgtcattgcggcggaagcggagaggtcacgcaatgtggaggcgaggtgggtcgcgtcacggcggtggagcgcggcgtgggcctcggcgaggagctgcttgagcgacggccggggtagcggagggggaccgaggacggcaacggccgggggcggaccagttgggggcga

SEQ ID NO: 64497 - DNA, 20269 bp, Oryza sativa
ggaggaggccgtattgaccaatgtcggccgcgtcctcgaggcgcgagggagggagttcctcggcgacaagtacaaggatccaatcgctagcttcaccgacttccacaagttctccattgagaatccagaggttgtggaagatgcaaaaatcttgccctcattgatccattgtttgcgattattgctgttttactgttgttagaggtgagcttacagtgtcagtttggccactgtttttcaagggcaggcgtactggaagatggtgtttgaggagatggggattactttcagtgtggagccatcttgcatcctgagggagaacgatgcttaccccggcggcgagtggttgcccggcgccgtgctgaatgctgctgcgaattgcctgaccgcgaagcccggaaggagttccgacgacgttgctatcgtgtggagggatgaggggaaggattctgagcccctcaactttgttactcttgaggaactgaggaaaaaagtttggtaatgactaatggcatttatatctctagagagggcaagtcgggtgtatataaatatgttttgtggcaatctgattccggaatcgattcttcttgttttgtttggagcagcctggtggcaaatgcgcttgatgcactcaacctggctaagggatccgcgattgccattgacatgcccatgaatgtgaatgctgttgtgatctacctggcaattgtgttggcaggctatgtggttgtctcaatcgcggacagctttgctgctcccgcaatatcaatgaggctaaagatatcagaagcaaaagcaattttcacccaggtatttgcttaattcacatttctcctgaaaccattgatgaacatgttgctcctttgctcaatagtttcagcttctatagggcaaagttttggtcatgcggactgacagctttaatttttcatgctaggattacatccttcgagatgacaaggaattgcctttgtacaggtgccttaacctttaaatgcacaggcttatagatcagtgttcgtattattagaatttgtctctaacatcatagctttcattctacagtagagttgtggaagctaaggcccctatgacaattgtgatccctgtaaggggatcaacaccaataaaaggactgcgtgctgatgatctgtcctgggaagattttcttgcaaaagttaaccatgccaagtaagtttgctacattctgatcatggtttcctttttttggtaaaatggccggtggctgcacgtggaatgactggtgtatctgcaaatttttgtcacattggatatgccgttactgcctaaattgtggagcagtcgccaaaattttccagtgcagcacgttcataatgtgtggtgtgcaaactccagaaaatttctgggtagttagcttggaaataatttacactacctctcagaaatacatgtttcttgaattaagtatgtattactatattatgcaataatgtgacaaaattgcagggctgataattataccgctgttgagcaacctgcctatgccttcaccaatatcttgttttcgtcagggactacaggtgagcactagtctagataacatgtctgttttgtgacttttgtgtgctctaccttaaccattcacaaatatttgttgtaatattgtgcatcacaatcatgtcatagtagatcctccttatgattatgagttccaatattgttcaaaatctgatagttgtcatattcaggggagccaaaagcaattccatggacacacttaacacctctgaagtcagctgctgatggatggtgtcacatggatattcgcagaggtgatgttgttgcatggcctactaacctcggttggatgatgggcccatggcttgtttatgcctctttactgaatggagcttccatggctctttataatggctccctgaatagttcaggctttgcaaagtttgtacaggtatggatgcttcatggtagaatgttcaacctcatgaaaatcagtatcagaaactgtgcactatcttttgattttgttcaaatacataataagaattctcctaagtatcagtgtcaaaatgtttccaaaataatttagaatgtgtgaatagctcctgtgtaggcctatgcttttccagttaagttcttttggtagtaataatacagatggatgatgttccttaactttgttagtaggaacaatgaacagcgtagccatgaaatttctgatactctctttttctgtatatattctacaatttttcagtttgaattacaatattttcttatactattttctcattactgaataacttccaggatgcaaaggtgactatgcttgggttggtacccagcattgctcgttcatggaaaagtacagattgtacagctgggtttgattggtcaaccattaggtaatttcttgagtggtttggactttacctcttttgttttagcttgtgtaagggaaatattgtgtatctctttggatgatatggtttgtgactgattatattgttccttatatatagatgttttagctcatccggggaggcatccagtgtggatgattatttatggttgatgggaagagtttgctacaaaccagttatagagtactgtggaggcacagaaattggtggtggatttgttgctggatcattgctgcaacctcaagcattatctgcattcagtacacctgcaatgggttgtaacctgtttattcttgacaacaatggaaatccattagtaagtattctggaatagaaaattagaaaaatttcttgcatgagtaacatagaattagtttctattgtgtgtatctccgcttaagcttgcaaactatgcagccacaagattctgttggtactggagaacttgcgcttgatccaccttcctgggagcttcaacaacattgctgaatgctgatcatcatgaggtgtacttcagtggaatgccagaatggaacgggaaagtacgtgtttcatccctggtctccctaatcatcgttaagttgagacttgagaccactaatccatgtaactgggtgtgcaggtccttcggaggcatggggatgaatttgagcgtactccagatgggtattatagggctcatgggcgcgcagatgacacaatgaaccttggtggaattaaggtaccaaatgccacaaatgcacaacttatttagcaaatttagatttcggcaatccagacattaatgtgtctcgaccaatctcaggtgagttccatcgagatagagcggatctgcaacagggtaaacgacgccatccttgaaacagcagctattggggttccacctctagggggtggccctgaacagctgaccatagccgtcgtcttcaaagaccaaagctcacaaacagaggatttgaatcagctgaaactggcattcaacactgctctgaagaaacttaaccctcttttcaaggttcttataccatccctgtgaatcatctcattgataactactgtaccctacatcttttacatggcacactgcgataacatcactaagcacctgtttcctcccatcatctctgcaggtttcttcagttgtggtagtcccttcgctccctagaacagcctcaaacaaggtcatgaggagagtcctccgcaaggagttcacccagcagccaaagcactccaaaatctaggtagttacaaaaaagcaaaattggttctattgcatcatacgtacacccaaaaggaaaaaacttcggcacagcaaactgtgaatacacatgtctggttaaaaatcactaaatcagttgtatagcaaggcttttgttctctccggtgtgaaatgagatgatagatcaggtcatgatgaggtactgaaagtgttattgctacattttcctgtcatatgtttttcgctatgtgaataaagtctttgtgggacttcagtgaaattcaggtggcctatagtgtattccagtgaaattcctaagctctattccctccgtcccataaaagatcaacctagtactaaatatttttgagagggaaacactgtaggggaagccccacggttaatatattaaacaaaacaaaaggttcaaattacaacaagttaatccacaattttagagagtctctcaaataaattaagcctataaactaagagggagatatcagtcttaagagctctccaagaggcaactgaaggggctagattattaaagattaaaccattcccattcctttgcttctaaatattccaagcagtatagagcaccttctcaacatagtgtgaagacatataagaattcttggcagcaaacaactaagggaaagatcccaaaccacaccaaattgagcccaacattcagagctaaataggcactgaaagaaaatatgcagggttgtttctcactcctgtagcacacaaaacacatcaaggaagcattttgaggagaacagtgccttctgtccagcatatcatgagtgtttaagcgatctattaaaagaagccaaccaaaaactttgaccttggaaacacacttgctctttcagattcaattgatataagctggcacctgaatctacgaaaaatttgtagcttacttctgagaagagaaaattccattaccccaagcatataagtccagctatccttctcatcattaagttgatctataggatcagaagttgacattatcatatattcctgagaggcttgctcagacaaaggcaagacaaaaagttctgaaagatcctttaaggagaacatatgaactgaaatcttgacattcctggaaaaagagtgaatcctaggaaatacagatgatctgagcttattattccacagatccttccaaaacaaacatgatttaccattccccaatattacagtttaaaatttccctaaaaatatccacaaattgcagaacatctctccacaaaaaggatcctttaggggcgacaacatgtggcacttttgagatgtacttttgagatgtagtaagtattccagatcagattaacccagggaattggtaacctattataaaatttgtgcaaatttttcaggagaagggcattattttggagtctgagatcaattacacctaaaccacctttgtactttggctgacacactctgtcccacatcaccaaagactttttgtttgaatttatatctgaaccccttcataaacaatgtctccttgccctatctatactctcaattacagattttggaagagacagaaaacacatataatacgttggcaaagaggagagtactgcatttacaattgtcaatctatcaccataagaaaggagtgctattgttgttgaaagacgtctctccactctatccaccaaaggggcaaaatcaattactttaggcctaattgataattccttcatttcacaatgtaagtcattctaacatttccttacatttatagtctagattcgttaacatcaatatgaaaaaatgctagaataacttatattgtgaaacaaaagaagtactaaatatgatactctctccgtttcataatataagactttttagaattgtctatatttatatagatgtttataaatctagacacgtatagaattatcgtactatgaatctggatcatcttactatgaatctagacgattaagagttcgctatcctggacgttgaagtcgttatccagattccttttttttgccggagggtttagacgagaatcaatgaaaggattcactaggtggggcccttctcacactgggtcaggcgtggcactgacacgtatgtcccaccccagggaactcggggtggggacactttgtcagtcgtccagtgactcgttgaggggattccacgtgtcccggttgccacggtggatcatgccgttagccgattcgaaagtaacgctacattcctgctcataagcatgcatgaccaactcaacatttgaccgtcgtcgtcagctcagcacatccaccggcctcggcttcgcctacctgtggaatgtggatacttaaaaggctcgatcgatcagtaaatccatcttataaaaatcttcccaaaaagaatctgagaagagacggcgatggggaagctggcgaagctcgtcggcggcatcaaggcgaggctgcgaagaaggaagatgctgacggcggcggcggcggagtcgtcgtcgtcgtcgtcgtgctacgacaagatggagaagacaaacagcatgaaggtggagatcactagccgccgcgcgcagaagctcatcgccaagaacctcgccatcgtcgacgccatggtcgccggcagcaacagcaacaacagcagcaaggccaagaaacgcgccttcttcccgtgacgctctctgattaatcccctccctttgctgtcgtggacatagataataatccaatgaccggtaatttgattgagcagtaggaattgcagaatgttttataggtttgtagaggatttatattagggtaaagtttatctttggatctcagacttccgtcgaagtccatagttttagctgcactagaaattatcttgctgtttttatgtcccgttcggtgattgttaacaagttattgtcccacatattgtatacatttttttactcttctttttccttgcatctctgtaatcactactttgtgtgaggaaataagggggaaaatgtgtgacatgtggaaccaatcccatattagcacctaaaacaacataaaacaatgttggtgcttgttactgttgttgtgtgacaaaaaaccaccatctaaaatcagcatcagggtgaaacttgtccgatttcaaaaatttaggataaaaacaaacgatttttatagttcacggtgaaaattggacttcaatgcaagtttgaaggctaaaaatagactttactctacatttgtctttctgcaaaaaagagtcgtcctccatccctgctactcccaccgcgcgtttcgtttgtacgctcctcttgcataatcatggtaagagttcttctcaatcaccggatctaatttttaccaatcacaatcctaacttctctagttacatactctctgggaatgaacctggacacgcatttgtccctccgtcccataaaaaaccaacttctgaggatgaatttgaacaacatttgtccagattcattagtagaagttttttttttaacagagcgtgtaggtacatgacatgttactactactctctccgtcccgaaataagtgcagttttgcactattcacgttcaacgtttgaccgtttgtcttatttaaaaaatttttatgattggtatttttattgctattagataataaaatatgaatagtattttatgtgtgactaaatattttcaattttttcacaaaattttcaaataagacggacggtcaaacgttgggcacggatatccacagctgcacttattttgggacgggggtagtagtaaaaaaagaaaagaaatactccctctgtccctaaatatttgagccgttgacttttttaaacatatttgatcgttcgtcttattcaaaaaatttaagtaactattaattctttttctatcatttgattcattgttaaataaatttttatgtatatatatggttttacatattttacaaaagttttttaataagataaacggtcaaatatgtttaaaaaggtcaacggcgtaatatttagggacggagggagttaattctttttctatcatttgattcattgttaaatatacttttatgtatatatatatagttttacatatattacaaaagttttttaataagacgaacgtttaaaaagatcaacggcgtaatatttaggaacggaggagtatgaaccatcaaatcccaaatgtgcccggcccatacagacccatcaaaagcccaacaccttcccacccaaagtccatccaggcccacaaaagacccaccacctccctctccctctcccgagtcgtccccttcctcgtctccggctcctccccctatccaatccccccctctcgccatccacgccgccctcctcctcctcccgccgccgccggagatgcaggcgacggccgcgctcttcctcgtccgcccgctcccgcgtccccactaccggtgagcgcgcccacgtgcccctcgaaacccttttccgcccctcctcccccggctcgcgtctctcctcctccgcgactgacgacgagctccccctgccggcccctctgtgggggttctccggtgcgcgcgttttccccattgtgtgcaggtgcttgcatgggttgcggggaggcgtctcgctggccccgccgcggcggcggctggtggcgcggggcccgcggtgctccatgagcctctccatcggcggcggcgcgggcgcgggcgccggcggggaccgcgggttcagctacggtaaggaagggggagggagatgcccgaaccctagcgatgctctctcgatgtctcagctgatttgtgttgttctgcgtggtctctgggttgcagagtgataatgcctgtttagctgctgcgatgaactgatcgtattggctgtgtggtgatcccatttattggattaccgatttcataatttgtgccatgaacacaatggagatgcttggtagcacaggctgagcatgcctggttcatgcctagtggagaaatatacaggattagctagggaattaacgtgtctattaccatactttatgcttagaaatttctagtgaaatgatttcaggaaggagagatgcatatgccttatggtgatatagcggcatttctagaattatgatggcgcagatgctggcatggtgatttggtactaatgctaaatcttgtttgttgggttctctaagctgaaagagggaatgctcttctatgggtttggttagacaagatatcaagtggtgccaattagttttcttgtgtaaatctgaagttctgaaccgatgatatccattgtattgatgtttatcaacagtgtctcataaattacgatattatttttatgattatttaatcaatgtcaaacttgttctgtgcatgagtttcttgtccttgcactaggaataaaaggtaatagaaagataactttcgttcatttatcttgataacccatataggtttgcatctaggtttcccacttcccacagattatttgcttgctacttggggttgttattttttgtgattactaagaatactgacatagaacccaactttccattcttttgattgtttttggaaacaacgtgcagttgtagagcttatcttatgtgatcttaaccctagtttctgtgtctccacagagcacgttccagtgtttccaagataccggattcgtgatccctacaagcttcttggtgttgatcgtgatgcagctgaagaagagatcaggagtgctagaaatttccttattcaacagtatgctgggcatgaaccaagtgaagaagctattgaaggtgcatacgagaagataataatgaagagctaccagcagcggaaaaagactaagattaatctgaaaactaagctaaaaaagcgagttgaggaatccccgtcatgggtaaaggcactgcttggatattttgaggtgccacaaatggatatcatttcaagaagattgttctttttcgctttcattgctggttggagcatagcgacttctgctgagaatggacctgcattccaggtatctgtgctttggtttttgctggcctttcaagttgtttttttcttgtttgatgacatatttcaattcatagcagtccaagaaggcaatctagtttgcacgtaaaatgcatatgcttgttcattcatctgaaaatttaaattatccaatgtaaccaacatctcttgttgagggtataaagacaatgcaaggcctaataactcctaaattttaaatatttatgcaatactagcttaatacacttcccatcttgagcacaacttctctagttgactagtttttttttttccttttgcagcttgcaatatctctcttctcgtgcatatatttccttaatgataagatgaagaacctcatgagggcatcaacaactgggttagtgggaattttttcacttgatatccatcggaccgtagcttgcctactttgatatcaatatcatgcttactcttttgttcttccaggtttggagtgcttgttggtggctggataattggctctctattggtcccacttatcccaacattcatcatcccaccctcttggtcccttgagctacttacatcattagttgcatatgtcttcctgttcctgggttgcactttcctcaaatgaaaaccttgtaaatcttgtaaccgtaaattgtagaattgcttgcagaaattttgcaactactgacatctccactatgggtctcggaaaagttttgtagaatgacatcactttgaggttctcctcttcttccatatggtcaagcctcagaattttctgttcagcacttctctgaaacaagaaaatcaatctgtccacaacttcaggtcattttactctatcgtttagccttttttctttttggaacacattaatctaatataacccgattgattattgtggagattgaattgtttcatatgaaaatctttcatgactttcgatcttgtggagattgaattagtttatatgaaaaatctttcatgactttcgaaggcagctgcatatgccatgaccttgtggcagacagtactgcctccagatttgttgttttcccaataaaagaaatggacctttgattctttgccattgacaagatggttccatgtattattggtatgaggtggcaacataataatgaaataacattctccttatataatggttataacatggttttattctttctccggtctttcggggtattttgttcatcaagaccgagatgtgctccaagattagtcctcgcggctatatgcttgctggtacagagacaaacggccaccccgccatcgtctgcgacaactgtacttgcaaaaaaaaaagtgaaatatcaaataaatataaggggtaaaactttgaacctaaaccagctaactcaccaccttataaagttagccataagaccctgaacgttctctcaactgtacttgctagtgtggcatgaatgaactgtgttaaattgacaattgttccgtgcatcttgatcgagattatgcagaagattacacaagaaaagaaaccctctagtatcctgatcagggttaaatttcgaggactgaactaactagtggaaatgagtcgataggagtctggtcttgactaattcattcatgttatgatagctcaagctatgcagacatgcagtatgcagtggtcttctccaccatctcgacgatgatcatgtaaggccgatcgagccgtatgcaccacaatccaactatcaccctcttcatcaccagccccgtcgcctcaccgataaggatgccgggtttccttgtgattttcattttcttatttttcaggtgccatcttcttatgctaatccaccagtatgacataattccgtattggggggggggggggggggggacttttctttttttttccccttttgaaaaggcctgtccttctctcatggcatccattgtcgcctcctcatcaaatgattccgtcctattgagtattgacaaaaactattgagcattgacaaaaagtttaggaggtaggagtactacatgtcatactttgtattatataatctgccactatgttcacctttataacaattaaaaattatgaggccgtttattttaagctaccgcaacaattgactccatatctaatatacatgcattgtttagttgcccgcacaacgatatcatatcccttaaagtttgaacatgaataatatcaagggctgtatacggtcgggcgtccgatagatttagagaaaaatcgggtgctgatgtaatgctggcgtcagcgtccgatttacgtgcaaaactcatttaaactgatttttcttttaaattacttatccaaatcatgatctgattgtactattaaattcgttgcaattaaatcttcaaaacaagaccacacatgcatatattccggcgaaattatttttagcttattattgaattatttttaaatattgcacgatgtaccactaggtatatcggaattgtttcactaagtagatcgaacatgtttcactcgattaaatcgggtgttgtttcaccttatatgaaaacaatgtttcagcaaatagcgaaagaatgtttcagttcactgcaatatttgatccatacatagtgaaacattgtaagtacactaggtgaaacatttttcggtggaacgaaaaataaaccgaattaccttaataggaggtttgcaaaatatgtgggttttttttgttgcaatggagtatttcagttcactgcaacattagatttatatatagtgaaacattatgagtacactaggtgaaacatttttggtggaacaaaaaataaaccaaattcctttaatagagggtttccaaaatatgtgggtgatttgttgcaactacgcgttccataatatcaaaatccactgcaacatttgatctgtacatagtgaaacatcatgagtacattacctgaaacatcgtaaaactactggttgaaacctcaaaaggaccatatgcaacattctaaaaaaatcaataaaaagttaaaatatttttttgtcgaaatataatcatgtgtggtcttgttgtaaagatttaattgtaacgaaattactatttagtggtgcaatcagatcatagattagataaatagtttacgagaaaaaaaaatcttttgaagaaataagagatgctagtatttgctttggctaacaacaatgtcacagcctgatagatagccgtccgatccgcgcggctcgatcacacggcgtgggcggcgatcgatttttcagtgcacgatcggacgtgcggtgctgagcattttcgataatatccgctaccaagtatattaggaacggacactaatgttgtgaagtgagtgtaactcaactgttaggttttttgtggtggaaccagttcacccggatttaaattttaaatttaatacgagtgtttgcatttatgggtactcctattatggctaattatttttttagggatagacgatgtacccatcaatagtaagtcacccacatttgtactttgttaaaaaaaaagaatagacactatcactctactttgtctgtgtcatattataagctgcttgatcaaatatgactaaattagtagttaagtagtatgggagaagggttctaatcaccaaaacttgtttactacatgttaattaaataaatataaaattaataatataaattaatatgtagtatatcacttcataagtttaaattcgactttataagatataagatttttttacgacctttaaaagtcgagtttgaactcatatgcttataaaatgatattatatactctatatcatcattcttctaaaagaataattataactttcgatccctatgtcccataaaaaatttttttaatgttaactatgaatctagatatatatatatatatatttaggtttaggtttgtagctaggattagtatttttttagtggagtagtagttgatgtgcaataattaacgagagaagagttttcccatagtaggattaaccaatgtactagccagccactggctaaacgcctagttgtgaagagagaacgaggctgatccaagatccatggacgcttctgcgatgctggtagctctactaaccatcctcgccaccgccgccgccgccgccgccgccgccgccgtggcgtcgtcgtcgctgcgccgccgcaagaatcagcctccgggctccctgggcctccccgtcgtcggccacaccctcgccctgctccgcgccctccgctccaacgccgccgaggactggctccgccgccgtgccgccgcctacggccccgtctccacgatctccctcttcggccgccccacggcgttcctcgccggcgcctcctgcaacaagctcctcttctccagcgacaagctcgccgccatgagcagcgcctccttcctccgcatggtcggccgccgcaacatccgcgaggtggccggcgacgaccaccgccgcgtcagggccatgatggcccgcttcctcaggctcgacgccgtcaagaactacgtctcggccatggacgacgaggtccgccgccacctccgcgccgagtggggcggccgcgccgccgtcgcggtgatgccgtcgatgaagtcgctgacgttcgacgtcatgtgcaccgtgctgttcgggctggagaggcggggcgaccacgccgccgtgaggcgtgagctctcgtcggagttccagcagctggtccgggggatctgggccgtcccggtgaacctccccttcaccaccttcggcaagtgcctcgccgcgagccggcgcgggcggcgcgccgtggcgtggatcgtggaggagaggcggcgagcgatgccgcgtggcggcggcggcggcggcagcgcgggcgacctggtgacgcacatgctggccgaggggatggacgaggaggagatcatcgacaacgtcgtgttcctgatggtggcggcgcacgacaccaccgccgtgctcctcaccttcctcctccgccacctcgacggcaaccgggcggcctacgagcgggtcgcggcggagcaggaggcgatcgcggcgcagcggcggcgcaggggaggctccggctccgccctgacgtgggacgacctcgccgggatgaggtacacgtgggcggcggccatggagacgctgcggatggtgccgccgacgttcgcgaacatgaggaaggcggtggccgacgtcgaggtcggcggctacgtgatacccaagtggtggcaggtgataaccgcggcgacgatgacgcacctggacccgaccatcttcccggaccccggcaggttcgagccggcgaggttcgaggcggcggcggcgaagtcggcgcccccgccgttcagctacgtgccgttcggcggcggcgcgcgcgcgtgccccgggaacgagttcgcgagggcggagacgctggtggccatgcactacatcgtcaccgggttcaggtggaggctcgccgccggctgcgacggcggcttctccaggcacccgctgccgtgtccaaaccagggcctcctcctcgacatcgagcccaaagaatacaatgaattgtgctgaattgtaataattgtataatgcattttaatcaaagattgtgatgaaaattacattgtatacttattagaaaacccattctactataatctaggcgtcatttcgattcacatgaaaaaaatattccccaaatccgtcggcggtggatcggcgaggaggaggaacagcgtgggcatacacgcagcctgcgtcgacgctggtgacgcagggcgggggacgctgccactctgcctgagagctgaggggagcggccggccggcgcggtcgccaccaccgccgcaagaatcgcagagcgctcgagagaaaggggagagagagatccatggcttcctccgtcgctctcaagggctgcccgctcgccaccctcctcaggcagctcctcgccgatgcgccgtccacccccacagggaggcccgtcaccggtcccgctgccttcagaaggactgctcccgccccgccgcctccgggaggcccacccccacccccgccgcccgagggcgcgtcgctccgccgctacgacgtcgtcgacgagtctggcccgacagcggcgaggagtacgacgacggcgagtgcgacccatagaaccaatggttaaagctcgtcacctctcaagcataagggcaattaattaagttatttggctacacagttacccacattaggacaaaaacgaatggaatggtgtgaaaggcgcgataaagttcaacaacgtgagaaaaagaggcttaaactttttagtagcttaagatgcggagaaaaacctcaatgaatggtgcccttattcgtttgttttccatagtacctacattttttcaaggcataaaccctcaaaatttcctcctagagtggttagttgcctgcgtctttacagtggaaacaatttcaaacgaatgacaggtgggtcccacttggcaggtcggttacactccaaaatcccaccatatatctccgaacccaccacactgacatccggtccccaccgcacggacggaccccacgagacagtgtctgaaccggtgagctattgggccgatgcgttttaattgcaaaagataatactccccctcctcgatttagaaacagaaaaccggattgctttgcgtctctctctctctctctctctccgcctttcccccttccttcgccgtctctccctctttccctctctcgattcccaaccgcaacgccgagcggcgtcgccatggacgacgaagccggggagtgagctcgccggcggcggagcatgatgggtttgggccgtgcgtggtctggccaacctacacgcgtgatccatggtcgctctgcccggatctgtaccggtggcgaggagagtttgcttcaaagtcctgtgtaatattttttcttccctactatgtccccttcggcgctgctgcctccacaggtctgcgcgtgttcagtaaattcagtttaggcgacgattctacggtggatctgattcttggcgccagagatgcagatcaggccgagtctgatggcttccttcgtcggctggatgatgataggtgatacggtggatctgattcttcttgcaccggagatggctccagatctcgttcatcggctggcatctggtggtttcgttcatcggctggaggaggaaaggtgagatctttatggcttagtcggctggagatggaaagatcccatcttgttggcttcccttcgtgcctgtcctgttatttccccctctcccttctggtttttcatcaataagactgcacacattgtcaggcatgagcggccaaatatatgatcagtataaagacttctttgtcaggcatgataagcatataagccttcacacattgtcaggcatgaacaggcaaatattagattagtaaatagggcttcacacattgtctggcacgaacagatcagtatatgaatgcaagattagtaccattgttacataacttggagaaatgaatttcttctgttctacatctcctactcctgaatttccagctgcaagtttttacatgttataagtctgcaagtgccataattccaaactttctaaaatccaaatgttccagtctgctttagttacttttatcatgttctatatctgcttcagtaatttcatttgtaactatgcatgtacaagtgcaaccatgtgcagatgcactattcatactgggctaaatgtgttcagacaacagcatctgctagattggaaaagactgttgagagctgcttaggcatgttttttttttcactttatggttttgatgaggttcgacccagaaaaaaaatgtggtagctgatttgtcaaatatttatttttgtttagtttatctcagatgtttcagttgtctcagatttgtgaaatatatattttttgttttagttttcactttgtctcagattcttgaaaagtcattcaaatcagatttttgaacaataaatacaagccttggatcctactacctccgtttcacaatgcaagactttctagcattgcccgcatacatatagatgttaatgaatctaaacacatacatatgtctagattcattaacatctaaatgaatgtgagcaatgctagaaagtcttacattgtgaaacggaggaagtatttttgaaccctgaagcacaaggttttggatatttctgccttagttttgcatgaagtattagctagctgtaacaagctaaaacaaataccatagctggtgtcctggtggtagcaagctggtatatttgaaagaactaatgaagcccttttttacccgagtttttttaacttgatttccactttatattatatttacatactactccgtgacttttttataacgtttgaccattcctcttattgagaaaaaaatataaatattatttattttattgtgacttgctctatcatctaataatatataatcttaacttatacttttacatattatatactatgtttctgaataagacgaatggtcaaacgttgttcacaaagtcaacggcgtcgtacatattgaaaagagggtagtacttctgtaaattcgtagcaaaacaactgcaatttctgtactgtatcaattttcgacttcttttgaccaaacaaaatttaaagggcaaccaaagcagcactaaggttgtgttcttttggaggggttgggaacccctcccctacgcatggaaaacggagcaatagattatcatatgattgattaggtattagctataaaaaacatgaaaaatgaattaatatgatttttaaggtaactttcctacataaactttttaccaaacgcgtactgtttagcagtttgaaaagcgtgcacgcggaaaacgatggagagtagttggaaacatatgggaaaggacacagccttataattaccttgtccacttcaccacggctttcaggtgttgggttgtcatttacctccatgtgatcgctccagctcacaagtgtcgacatctgcattcaataagtttttaaagtcttgatcaggtccctctaatttcagtttttcataaccgagaactttaatttgatgaaactgctatatatggtggacaaaatgctatatatatggtgaaaaatcttactatactttgttttgttcatatgtaatgctatttttgtatgtaaacaagttcaaaagatgtgtcagaagtctcatgtccagaagtctgtttttacaggaatttcaacataattttacatattacatatgttaaaattgcacttcattttcttctgcaatttttatttaaatgctgagctaaatcagtgggtgttttttcaatcgaggttagcatgcatatatatatagatcaaaccatacgctattatctgttctatttcaaattcagaaacacaagaattataggtgtagaatgcaccaatcctattattaagtccttacaaatgcatgcagcaaattgaaccatgtattcttgatattgagctgtgattttaatcaagaagtatggaaacatcaagattaccagaaaaaaattgtttctttcttccagagctaactagagaaacatcaagattcatggcaaagattgatcccggttaggtgcaaatatcatttgtttgtttgtttgaagttcagtgtaattaccgcatttactttatcgctgtttgcatatgttggagcgtcatctgcccctatccggctcaggttcacaagggaagacatctgcaataaaaaaggtaagttgtgtgttgtgattttataaaaccatactgacttgttcagtatcgtattgtttaagttgcatgttgtattatttctatgctgaattttcctactttgtgtagcatatgtgtgttctcttctgacatgtgacctcaatgtaagaaaaaatgacaccaccatgaacatctaagtgctctttctggcctgtgaccataatcttaaaaaaaaaaaccaaaaagacctttctggcctgtgaccttaatctatagaaaacatgactccttttatatgtacttatctgattttttttatgatgtttgatgtccgtgtggttgctggggatgtctgagttgtgtttcagagataggcactgagggttattttactagttttggaaggacaaaaggctttagtttattgctagagctctagctatcccctaattagcatgtttttcatccttgtctatggttagttttcagaactcgaactcaatgcctgagaattgaactttcagaacatttgtcatagatgatttggagttcattttttaactaggtagaaaagtgctacctgtattatgacaggatcattagcatataggtccattagccttacatccacttagcggcgagcccggcgagtcacggcggcggcgcgcctcccagctcgtggcggcgggcgaacgaaggcagcgaagcgcgcgggatggatggattggggcgccgtctcccgccgtggtggatggattggggattttcttgatctgcaagcgggcccaatcaagacagtcgttggatggggattggatggctgagatccaccgaatgtcacattgtgacatgcttacacaatgtcaccgaatctgagtccgtcatactagggtcagattctgccgaaattcag

SEQ ID NO: 64498 - DNA, 9739 bp, Oryza sativa
caatatctagctgggaaaagaaagacagaaaggctactgaatgtttgtgtttgttgagctcagaatgtaatgaattgtggtgatatatttacatagtaagctttaagacataacaattgctaatcaatgatataatgtttatatgagctttaagatataatattgataatgtactgtgatgtgatatgtttgtacgttgagttttaggatgtagagggtcaatcttgtatataagatatatgttgtaaatataagatattataggtgccgacacccatataacacaagccgagccagcgggccccaccacgacgaggtgacgcgagaggagataaggtttccttctctcgctcccttctctctctcgctctctctctctccctcccttctctcgctctcttctctctcttcctcccttctctgctcgccggcggaggcggcagcggcgaccacgccctccactccgccagatccggtaggaggggaggcggcagcgacaggaggggaggcgtcaacggcgggcagggtggttggtttcggcgtcagcggcgggcgaggtggttgtttccggcgtcgacggcaggcggagtggccggatctggcccagaggggagtcggcgatagcgggaggggcggcaacagatccggcggtggcgtggctcacgggcggcagcggcgacctcccctccgccagatccggcgggaggggagacagcggcggcggcggagccctcccctccgccagatccggcggggggtaggcagcggcaatgacggcggcgggctccccacgggcgacggtaagcacccccaaccatctccttcgcttgcgatgatgtttgatgtgagatgaatgatgattcaatgatgtttgatgtgagatgaatgctgattcaatgatgtttgatgtgagatcgatgaatgtttgaaatgtgagaatgaatgttgccaatttttttttgtgagatgaatgttgcctgattcaaatgtttgattcagtgatttattttgtgagatgaatgttgccaaactttttttcttgcggatgtgggaggagggactgctcggctcgatcgagccgacgcattgagccggctttttttttattcgtcgaacctaaaaggtgccggttttaaggaaccgacacctttttgctacctcccttgtgccggttgagaaaaccggcagggaagggggtttgctaaccggtacataatatcttttctgtagtagtgacaccaagcatatctatcatgaaccttttgctataccaacattagggtactctacataaaaaaatcacaaagatattaatttatattatatgataggatttagaaatagttaatccctccatctaaaaaggttctttttttcctactatataagttgcccacattaaccataagttgggtttacttggacagagggagtttttgttggaagtgacaatgagtgagagacattgagtaaagccccgttttaatctacttaaagggagagcgacttcttcgttaatcatgagtcgctttctaaactattaaatgatgtgtttttagaaaactttatatattaaaagtttctttataaaaaaataaatcaattttgctacttcatatataagaattaatacccaattgatcataaactaatgggccagctcatttcacgtgtagtcagccaaatagctgaaaataactcggcctaaggcatgttgaatatataggttggtttagcataggtacacataggatgcccatgcatcaaccattccatgtgagaagaatgttggtctagatttattatgtgaatccgatcctttttcccttaaaaaaatgtttcgaaagctaagttcctaaacatatcatagcatccttaaattgaataaatttattaattaagtttgaagttgaacctattacagtattacacaatattaaatttagtcgcacaaatacaatattaaatttagtcgcacaaatactcagaccactgtataccagtatagtaaaattattagtacaagatatattttttaattacaaggtaattaagcaagacagcacaacatatattgctgctaatcactcttctcagatcctctcctcctccagcgtgaaatcgttctcgatcttgaacgtcttccagctggtctgctccagcgacggtcaggttgagcaggggccctgatccactgcacacacccatggagttggctgccatgagcaggaggtagtacaccgtgtaaatttcagaacatgcaaaagtgaaaatgaatgtaaatcactcagaaatgtaaaaaaataaatgtccaacgccgtccgtgggattcgaacccacgaccacacggttaaaagccgtgcgctctaccgactgagctaggacggctattatgacgaattgtataattacattttataaaatgttatgaggccattcgcaacaggggacgatcatccatcacttccagaaaacagaagtattagttgaaacaaaatctctactagcatcctcctcctctccaattaatgtagttcacacttagaaacccaccccacctaaaattcaatctttgaagatcaaactaaaatcaacctaaagaaaaatcgaatagaaaaaattgaaccataaaaccattattcacaatcttattacaggcttacagcttacaaacatgagatgtcgctagtcaaaacaaaggcaaaattccgcgcgtcgttttgatcgatcgatttggtgaaatcacggcgagcatatatctatccagcgtcccagcagggcagtgacttggcaaactatgcgcagtaatatcagcactgcaatgttcggacttcaggaaagatcaaattttagcagtttccaaaacacatttttgtgaattctacatgttacttttacagattagtgaaaaatatttcatgattgtagaaataaattaaacattttaaaaataaaattaataaatatatgagtaaatttaagaaaacctcatttttatgattaaagttgtaaaagatcacacgtatcatgatatgtggcacctaacttaagtattattacttaatggttttaaagttttacagaacttcacacttatgcattttgagcgtgaatttacttataatttaaaaacatagtgtatataaaatttttaatttttttagtaattgactaagattgataggttaattctttactactttcaaaaatttatttaagatatgctaaactttatcaaggttttaattttgataaagatggagttttgtgaaacattaagaccatgaaaagtatgattatataccacacgttataatacatgtggttttccacaactttaacataaaacatggtttttttatgaaatttactctaaataaatataccacacttgttaaaatctcttatattttgatggagccttcatttcatatcataaatcactttaacccttttctacctcaaacttctataaccttaataaatttttttaaaaaatattaatattttcaactaaaaaaacataaaaactactctaagactaaaaacagatactcccttaattttcgttagatttaggttacatccaaccaaaattatattcgggaacggaaggattaaatgccagaatcaaattctgagtcctttcctttcgtcgtgagaaaaccgaaaagtcgctccactttgcttttgcacccaccggtttcaaaaactcgccccccaaaattcctcctccttcctctcgaaggcggcgaaccccatcgattcctcttcctcctccgccgcacgcgccccaatccgattcaaccgccggcggcggcggcggcggcggcggtggcggcgatggaggtcggggacctgcacaaggtgtgggagatccgcgcgctcaagagaaagcccgacgagcccgccgcccgcgcgctcctcgaccgcgtcgccaagcaggtccagcccatcatgcgccgccgcaagtggcgcgtcaaggtcctctccgagttctcgtaagcgcgaaccctagccgtagcctcctcctcgtcaatctctgtctcgttcccgatcgattgatcggttttttttgtttgtttttttttttgcggggagattgatcggttttgttgcggatgtctgatttggttgttgggggatcaggccgaagaacccgaggctgctggggctcaacgtcggcgggggagtcgaggtgaagctgcggctgcggcacgcgggacgggactacgacttcatcccctacgaggaggtgctcgacaccatgctccacgagctctgccacatcgcgcggggcccccacgacgcgcagttctacaagctctgggatgagctccgcaaggtacatagattttttattttgtatgattgtgtggtgattgaaactaatttttatgattccatctctagatgtcgtgaacaatcgaacatacgagtagtagatgtattgctcaatgtggtgctcttgtataaaactgggaattcagagttgtgtcgatgctgcatttagggtctatctggcatagaaagtgggaagtatccatagtccctcgcaagttggagaatatcccacagagtggtaattcaggttattttatagaatcaaacatcatccagcttgattgttaatgttttaatcaaaatcatgctaaatcagccataaaatagatggaatcggtctcttcagcacatgtgtagagtgcatacatatactttatatagattgtagaggtaggaaccagctatattgcgttgtactattagtttctgatggagctgggattggagtgggcaatagagcaagtatgcacttagtcgtggtttgcatagaagcacaaaaaagatttacctgtgctacgacagtaattcctgcaaggaaaagttgtagcttaagaactggtgtgttcattgcatcgaatttaactgaaagctcaatagcccatccttattcagcctactgtcttaagcttatgctatttatggaaaaaccattcaggaatgtgaagaacttgtttccaagggtatcactggatcaggccaaggatttgatggtacaggtcggcggttaggtgggtttacagtacacccaccgccaccatctttaaggcaagcaacattagctgcagcacagaaacgggcaaggaatggagctcttttgccatccggtcctagaaaggccctttttttgggggttggggaaaaaattaaatggatattatgagtgctcttagtccaatacaagccgctgcaatggctgctgaaaggagaatgtatgacgatttgtggtgtggatcgcacgatcaatctggcattgatgattcagaagacgttgttattcttgaggatacacctaacttgccaacgcagcttgggaaaagcacaaaggatggcttttctagcagttctgagaatcccagcacatcttcgggatttcccacagcagcacagaatggatcctcttcttgtaggataacaaccgatgcaggagatagttctctatgggagtgtgttgcttgcacacttctaaatcaggtatgttttcttttgtaagcaaggagtttctataacagataaacctttttaaatggggttatttttcactggatagatttcatactgaccttccagcatattttttgaagtccactcattatggtggacttgtaaattacaaatattcgaacggtatccaattatccacatacttaagtgctttgtatgcctgaaagtattacattactgcatagatgtaattcaaacatatgaaaaaccaaattccatttggacagcttctgataaatggcacagaaatgccatatattaatgtatcatacaagagaagggctttgacgttgtttctttgcctgaatgttgagccttttctattgcttttctttattttcgtgtgcaaacttaaccttatttcgtagccccttttatattttgtgcatactgaatacacttttcctggtgtgttgtttctttaccagaggcatttttctcgctttgctaaaatttattgtctgagaaaggttatttgaacattataattattaattctcttcatttctaatacttttgtagcctctggcaccaatctgtgaagtttgtagcgcagctaaacctaaaaccacgaaggccaaatatgcaacctggtcctgtaaattctgtactctagaaaacagtactaagattgacaaatgttcagcatgcgatcaatggagatattcacatggaccacctgcagccacatattgtccaagctatgattgatctacattgaagcttgcattaatatggtaagtaccactacattgtaggcacattaaatttaattttcttttggaggcaattttttgctttcatgttggtggattaaacatatccactaatggtatagaagtacagttaagtgaccttctttctgcactcacctactaacaaatttatcttggcctatcaagctgactttctttctgtattcaattcgtaatatacagtttggtggtgttgcaccatagctatctttttgacccagatttgcttatgtagttacattcattcgctccataaatctctatccacttaactgaattgtattattgtaacaacaatttcatgtggttattgcaggactacagaattttggacagccatctgctgaattgtggatacacaaattcgttcccatcagcagttctatctgttaccccattgcacttctgcataacgaatcagatgtgtaatttactatctaaagcattccctctttcgtggatcacatcatgtgtatagagagaaccacctattggaaacatctgacatatcccaagctccctctgggagcagctaacgcttgaaccattttcaatccttcctgctcctgaagtcctgaagcatgaccgagcacgctggtatgttttggctctgaacttgtgatggcaacacaattgtccttactgcattatctattgcaatggtgttttcacatgcttagataatgcaaccgtgcatgtttaaccaggtactatcatgagtcgctgttgctgcagttgagcgatataagctgtcacttcattctaatcaactaaggtcgttgactttttattcgtcctcgtctaatttctccatttggcagctttgggtttgctcttggttgggtgccaactgccaatgacttgacaagttgacattgtatggtcaaagcccaatgggggagtgagctttatcacttgtgtaacgattaacaaatttcttaaaatcattcccgtggtagaatctcgagagaaaccaacactggctccttttgaaacaaaggaattttacatgttcataggaatttgattcgattcacacaaatcctactcaagattcctttgtttcaaaaggaattcacttcatcacctcgcaggtgcaaaagagtacccctccaatgatctcaagcaacacgatgtgcaaaatctagaccgttccacttgattatccatatagcaacctttttgcaaatgcatcattaacaaaagctaatcaacggagctacgaaacggctaataaaaacatatgcaaggacaatcatattactcctaatcaagaggatatttatagtaaactaaattacaccttgtatacatactactatacggtacagtacgtcgctgtagcttctctccatccatccatcgaaatctccactccatccatccatcgaaatctccagtaatccgaaacccatcaacctcaccaccaagagttgataacccgataatcatcgcggcgccagtattcgtcacgcatctcgttttctctttatttgtttcttctttcgcttttttttttagcatttaactattcgccatttttaagatgtgacaattaaaaatttagttatcatgtttctatgacataaagatctaatgataaatcatttatcactaattgtaagagtggtaaatagttaattatttctttttcttcccctctcaaatctcgttttcttctctttccttttcttttttcccttctttttttcttttcatctcaaagcagagagcatctcatctcatcgatcgatctcgatccatttccgtttgcttcttctcctctcctctccaagaagaggcgagctcgcctcctcctcctctcgacgcgagcggcgatgcgtgcgggcgacatgccggggcggggggctcgccgtcgcccggatctcaccctcccgatgccgcagcgcgacgcgccgacgtcgctcgccgtgccgctcccgctcccgccggcggcgacgacgacgacgtccgcgcctcccgcgggaggggcgatgcacccactggcgtcggcgggggccgcgccgccgccgccgctggaggagctggaacgggtgaggcgggtggggagcggggcaggggggacggtgtggatggtgcgccaccgcggcacgggcaaggagtacgcgctcaaggtgctctacggcaaccacgacgacgcggtgcggcgccagatcgcgcgcgagatcgccatcctccgcaccgccgagcacccggcggtggtgcggtgccacgacatgtacgagcgcggcggcgagctgcagatcctgctcgagtacatggacggcgggtccctcgacggccgccgcatcgccgacgagcggttcctcgccgacgtcgcgcgccaggtgctctccgggatcgcctacctccaccgccgccacattgtccaccgggacatcaagccggtcaacctcctttatgacttcggggcccgcgtcaagattgccgacttgggggtcggccgcatcctcaaccagaccatggatccctgcaattcctcggtgggcaccatcgcctacatgagccccgagcgcatcaacaccgacctcaacgacggcgcctacgatggctacgccggcgacatctggagcttcggcctcagcatcctagagttttacatgggaaaattccccttcggttagaatcttggcaagcagggtgactgggccgcgctcatgtgcgccatctgctattccgaccctcccgagccgcccgccgccgtctcgccggagttcagaagcttcgtcggctactgccttcagaagaatccggcgaagcggccgtccgccgcgcagctgatgcagcacccgttcgtcgccggaccgcagccacagccactcgccgccccgccgccatcgtcgtgactgccaattccatccggtcatcgtgtcaaactccatttccatctcatcaagttcttcatagccaatccattttcgagtgttcttcaaacaccatgatcgttttcatccattgctgctgccccaactcaaggttcttcctctctactgttctttgatgttgttttattcacaatgatgatcaaatattgagtaaatctggtttgtacaaaggatttttttttctacgagatcaagtacagacataatcccacttgttagccaatttgccataaaattcccttagaaacgaaaatttccactgtacaagtagcagattttttttactccatttccacgatattttgcttgttagtggtaagctgcttaatgatgatagtgtgcaagttgccactcttcaaagtggttctttggattctactatgtgttctcttgcctaattgggttctatattgagattactttctctatgttttttttggaggaaaaaaaagaatacactctctttattcattctgtgtaaggataatattatgtgtgcatggttgcttttga

SEQ ID NO: 64499 - DNA, 7263 bp, Oryza sativa
atatacggatccggtatatcgtccagtataaggagaggactcatttaagataaggaaatcaatgagttcttatggaaatattccttaagagcgggaattattagaatactactcgaaggggatagggattgtgtcataccatacagggtctgttgtctccaagttctacttagagaccaaggtgatttgcggtataaatacatacccccggggaggtacggggcatcgaatcttagcgcaagacacccgccaccacataagtaatccggaggacttgaagcctattcgccgatagatctcatcgagcccttctcgacaaggatctcgtcagtaatctcgtagttcggttgttctcttttataatatgtggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaagagactggcctgcaataatgccgtgagtcttcgcatgcggttgggccacctgcatgcaaaaatgttgattttcgcagacacatgtatgcaggtgagccatcaaaccgcatgtcaagatcgttttttgtcgcatagaaaaactaattttgtcatcaagaatttgcatgcatgtgccaaaaagtctttcagcttacaacattatatggtcatagattagtttcagttttgttgggcagcgagaggccgatccataacttctgcctttgtgaacgacagcaatgccaccaatcgagaaatgaacggctgaatggcttggacccaccgtagtgactaatcatgtcagccataaattaataacaccaggtgtttactctatagaaaagatcaacgaaaataatcaccggtggcaaagaaagataaaccaaaactgagcacatccttccccttttgctcccaagtcccaacgtcgaagaatgtatggattgacatcctatatctattcatcctgctatcttcgaacgagaaagtataacatgaaaatcactcgttgatgcagcctaagaatgatgcaacaaacttctttttgttcgatctcttaacataccgtgccttactgcctagagcccactacggtgctctctattgttagtaaaaagtaatctaaaccgtggatctaaggttcagatctatttatattaccactcatttagtggtagtagaaacatgaatgggaattattgtaaaaaaaataggtgcggaagggtataaacatcatttatcattgactaaacattttttcttctttgctaatatgagcgatatcagcgcaatggatatcgatttagttaggaaaaaacataaatgatagttactcctaatcatgatattagtaaattatttatttgctcctaataatattggtcgtataatactaacagtagacaacaccggagcaaaatatactattgtataatgttattcaaattctctcttataaggctatcttgaaaagctcttgctaatactatttgctaaacataaaagttatcattgaataagactataagatctgtagcttttaattttgtttattgtgcttttcagctggagattgttgtttgttttttttctcttaagagtaaatacttgattatccttttttgaagggccaaaatatactactctgtaatgttattcaaattctctcttataaggctatctagaaaaactcttgctaatattgtttgctaaacataaaggttttgtttgaataagactataagatcagtagcttttaattttgtttatggtgcttttgagctggagattgttgtttgttttttttctcataagagtaaatacttgattatatcaattaattggcagctaaatacttactacggtggttatgggatcaaatggttttagtaatgaaatgtgttccattatttattaatatctgttggtattctatctgggatgaaaaattgttgtagaaaaagtcaatgaagttttttaactggtaaaacatcttcagacattttggcaacttgttgcaaatttgccatatatatgactttggattcactcgttcactgtatcaggctatgtacgtattagagaaaaaaatagtagtacgatcgtttgatgattaaaaacccaagacgtggcagtcttgcaacatagtttcgtcaacaaacagacgtaatgtgttgcaaatttgtcatatatatgactttggaatcactctttcactgtatcaggttatgtacgtattagagaaaaaaatggtacaatattttgatgattaaaaaccaaagacgtggcagtcttgcaatatagtttcgtcaacaaacaaacgtaatgtggattgcagattgtaggggacacggtacccgagtagccgaggttaggcctttgggctatattacataaggtgggctaagaagtctaagcccatatggcacattgtaatccaatacttcctccgtttcataatgtaagactttcaagcattgttcatattcatatagatgtaaaagtcttacaatacaaaacagagggagtaaaagggatcaaagataagaatataaatcttatccgatataaataggtggtaggtacccggattatatggggtacgctacctaccgtagccggcctccttatgtctatataacggtaggccggaaacaattagggtgatcatacacgtgttacgtgctattcacacaccgtgttgcgcacactttgatacagatctaatctacaaacaactgaagtagggtgttatctcttccaaggtcttaatcagtataaaaatatatcaccatctctcctcgatcttgtgcaccctataaatttacttgccaatctagagaatcgacacagatgaaaacaaaggaatgaaatatcaaaaatacatcttcagtgctcgcataagttttatggcttttcttctaaaggtcttgagcccaaatactaccagtaccaagctagcaaatatatgtgaaagaaacttgaccataaatagtataacgagtgaattgcactttagaccaacttttgttgccgcggtttcactttggaccatccttaatccaaacttttcactttggattagctaaatttatgtttgttttactttagactactcaaaaccacttctttagcacattaactaaatttatgtttgttttactttagactactcaaaaccacttctttagcacattaactaaatttatgtttgttttactttagaattaacgattgaggacattggctccatcacgttggtaaaattctccacctatgagacggtcatatatttaccggagtataccggtcaaaattggatttggggtggttcaaagtgaaactatggcaataaaagatgccccaaagtgtaattcagtttgtaaaattgacatgaaacaaaacagaagttgcaaattgagttacgaattgcgctgcatgaatgcataggacaaaataaccatacttgtttgattaagaaaacataccagcaacaatagactttttaaatgtctctagcatgaagaaaccatgaagaaaacatcgtgcgtgtaaaatttatatgaccaagggccatcatcagtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggcccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcagatgagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatgttgaaaaggagaaaattacttcctcttgggtgatgttttgctctcgaattgttaaatttagatacaacacataattgaccagtaagttgatgtcctgctaaatgaaaggatcaatgctactgtgcaagaaatgcaagatgaattggttggttcacctctagatagtttcaaccaacgagaaaatgaagaattataataacagtttaaagagaaagatatttaggtgccaaacttccagagttaaacagattatttcacctgacaggactcctcctagcatgttgctggcaaaaaattgctcatgtagacttgtgcgagcatttcaccaagctttacttgtgattcagtggtaagatgcagatgatcttcatttaatgacagtccaaatgcgtccacagttacaacattgggcaggttgataccaagctgagctttcctcactttttcaatgttctttttattcccagatgcaagagcaacctgtttaatgcaaacaaatcttgatataaatgataccccatattacaaatgatatcgagtacaaataaagggtaaggttggttgacacataagatggcatcgtgtgtgtagaaagagtgaaaccagccatcttatattgctaactgaataaagaaaattcaaggttcaaaagaaagattacagagccatgcaaaataaaacatattagtttactagttaaaaccaatcagttatcttgtactgggggatgtaaaagagggcctgatgatgtattaaatcgaaactattaacttcaactttatacatcccttaaagcaacatctaggcacatgtataatcgtccaaccttttttttttctcttatgttttgaatgactgaatgttatcactgttacgaataaatgaggtatcctctccaaagtgtaataagtaataactgaacggtaacaaggccatataagtcacttcctaaattcacgcacaagactaagatgacttatatttagagtaacatatagtagtacagcaaaagcacgaaaacaattggttagtacattttagtacaactctagtataaatcaacaaaacacaaatgtaccgatgaactcaagaggggaacaggtaaagttcaactttaaagattttttagtattacagatggaaaaatgttgcaaccaactttactttataaagattcgtttgtgactaaagttattctaaagaaacaatatggtactcttgcagatggtagcaccttttgaaagtggtgacagaatatagcggtcggttacctcatacatgatacatagacattagggacattattgcaaggctgagaataatgctttccctgcatatttgctcaattataattaccatagccgcaaagatagtacacgaatacgataacttgagcaccggcaacaccaattgaatattgaatatgactaaaataaagtaattcaccatcaatatcctgaattcattctttgtgttatcggagttcgcctactaaactgtacaactatggggaaaccacttctactaaaaatattgggagtgttttgattattttccttttgcattgcctctcatttaggtcaacgcagtcaagaaacatgacacggccaagaaatccccaaatacatttcttgaacaaaattatcgttggctcatcgcgtccagttaattctctaaatttgagagtcaaatcaagtaggcaaccgagatatgatgaatatcatcacctggatgaatggcagttgaggcatcccaagatcctccctgacattggcgatgagcgtctccaggttcccggcgtacgcggccgtggcggcgtcggactcggcgtcgctctcccc

SEQ ID NO: 64500 - DNA, 1707 bp, Oryza sativa
ttcgaatgtggcccggagaatttttgttaaattctccttggtctaaaaggagccctcaaattttacttgaattttcagagcgccggaaatatttattaagcaacaaaaacaattatcaaagtttaataaaacgaaaacctaaaaataaccctctccttccctttgggccaagtctggcccaaggttcctctcttctcttggcccgcggccaaagtctccctctcctccctctctttccctcctctcccgggcctctcctcctcctcccggcccactcttcccctccccctctcggcccactccctcctccaccctctccctcccgggctgcctctccctcctatcctcctgggccgcctcggcttcgcccggcccaagccgagccgcgcctccctcccgtgccgcgcacgtgcgcgtgcgtgcgcgccgttgccgcgcgttgaccgcgcgcctcccgcgtgggtcccgcctgtcaggcgcgtccccggcctccagccgccggcctccttcctctctctcccgtgaaccctagcgccgttcctcctccaaatccgctccattcaagccggctctttccaaattgattggggggaattaatccccattgattcctctttgatttcccccgtttttccccttgaatggcgcccccaatcgcccggaacggccgcgccattcccggccgccttccatggctgccggccgtgtttcccgtcgccgttccgccctctcccatgcccggctcgcttccctccgctataaaacggaatcccctcgctccgttctatcgttttagcccactcccgcgatctcccgtggtccctagccctcaccgccgtcacgcgcgccgcctcttcctcggtctcgtcggcacccactccggcagcccctttcgccgtgccagtgcgccggccgacgtcgccgtctccacctccggcatcgcagcgtcaaggacgccctcggcctcgcctccccttcgaccgaaccccgccggtgttcgtcgtcgtcgtcaccgttcatcctcgccggctcgtcatctcgcggcgccgcctccgtcgtcgacatcgcagcggcgtgttccacgccatcctcgcctccgtgcagccgctgccggctgccctcgtcgtctcctcgccggccccggtcgtcgtcgtcgtcgtcctcccgtcgttcccggtcgtcgtggcgttcgtccctctgtcgagccgttctcgtccgtcctcggtgtttcgtcaaggtcgctgtagccgtcgtcgtctttgtcctcggctccgcgtcgtcaagcctcatgccggccgcgtctcgccttcgtccaaggatcgccgccgaagtcgttccctcgccgtccgccgcgcccgttcgtcgttgttgttcccacgcctcgtcgcgtggtggtaaggatccgtcctctcgctgccccgtcctcgtcctttcagtgtcaccccgtacccgttgtgcggttgtcgaccccggtacccgtgtaccggtgtcggtagtcgttcacgcgtgcgggtggtgaccgtgtagtgtctgtgttagtgtgcccgctcggtagccgcgtggtttccacgtgtgcaggccgtgtggtgtctagtggagtccgtttgtcggccactcgcctcggttgacacacgggatccgcttccgtcgacccgtggaccgtctctgtgtacgcggtctaccgcggtcctttttgttgacatgtga

SEQ ID NO: 64501 - DNA, 7021 bp, Oryza sativa
  unsure (1)..(7021): unsure at all n locations
agagtttgatgactggctgtaggaacgnacaagcatttagttaccaaatggcacgagacctagtcaacgtgtcacgtggatgtcacgtaggacaaaaccaccggtcaaaccgctgagggactcaatttgcaccggtttttgaagatgggggaagtgttatacccggtattgcagttgagggagacgattcaatcaagagcaagaatagagggatgtaaaatagacttattccacgtcaaaaggatcacacgggcctaaatggaagcccacaatcttaaaatattatgggcctaaactttagactaaaatccaggtccttccatatatgggccaaaaccatccggcccatcaagcgacagtagcaagcagctcgctcaatcgcttcttgcaagacaagctacctcttctgcccccggatctccgcggcttccagaagcaaatcgaatcaaaccaactttgtttcccagcatttaaagcatcgtcttcctcgtcgagtcgtcgtctccccgccgtctcgtgcccccattcgccgcagaaatccctagcctccacgatccgaagaatccctaaccactccacgatcgatcccctcccttctcccatcaatggctgatcagcttcggcggcgatgggcggcggcggacgacggtgtcctgtacgaggtcgcccgccgcatcccgtgcgagatcgatcgccgccacatgggtcgcgtatgcaactcctggcgcgtggcgctcgtgaagctcaaggccccggcgccgccgcctccgctcccgtggctcgcccttcctgagtccgacgatgggctgcccgccaccgtcttctgcgtcctcagcggctgccgcacccacgccttctccgtccttcaaggagcacgcggcgcgcgctacttcggttcgtacgatggcggatggctcttcctcgccgtcggcggccaagctcaatgccaagccctcctcaacctcaagatcaacggctttcagaccctcgacctccccaacctggcgcccgtcaactcagtgaatccgaaccgtgaccgtgagatggccatcgtcgccgccaccctctcgtgccagccaactgaacaaggatgcatcggcgccggcatcatcgaatcattttccaacctcgtcgccgttggccatgtcacccggagcattgcgttctggcggatgggcgatcaggtggtcttacctgttttgtgggcactggaggaggacaacccattgatgcggctggaagaagtggaggaccttctatgccaccatggagccttccatttcctcacccgagcggaagacgtccttgcgtgcgaagaaccaccggtcttctacagagattccgtgagtctggtcccggcaaacatgttcttcctgccgcgcgtccacgacgagaacgagactgttcttgctcgctacctcgtggggtccggcaagaagctgctcatggtggtcaggctagctagtggccggggtcagcgcacgacgtcggcgttccgggtgttccagaagaaaaagttcaacaccggcgaagaagacgagccgtcccagaatcgctctgctcattttgagtactactggagcgagctggacgagctcgatggccggatgctgttcgtcggactaggctgctccagatcctacaaggcgggtgatggcaggtaccccgacatggaggagggcgtctacttcttggatgatccgagcatccaccagatgatcatcggtgatgcacccaaaccgccgtacctctgcagtgacaacggtaaatggtcgagagcaccaactgatccccagggccaggtcgagcgctgcttcccggagcgaggcccatcgatccactcgcctccggtttggattctcccttgagttgagatcgacgacaggtttggttttcgatcggcaaacgttgcgcgatatatcaacaaggtcaagttaattagttccatgccttgatctagctacattgtgtcgtttgcttcttgttgctgatgagttcaatggtgttgtcatgttgaaactgttgctgattagtactagctagcgtttgtttgtggtgtaaccatgtaagcagtaagatgaacaggattcatttagtgcaggaatgctacagatgatacttgctgtttgttcagtaccattcttcattgcgtttcagtgcattcagctacactctgtcctgttcaattcgcaattccgtttcaagattatgtttccgattactccagtagatagactgaatggcctgcatttgtttgtggtgtaagttagtgatgaagcaggaatgctgcaaaatgataccacctgctgttggttcagtgctattatttcttcatgtgatgtgggtgtgactcggtgcattcaactacactttactctcttcaacttgcatttcagttcaagcttctttaaattgtactgaatttttaatctgcatctcaactctgtggaatattatagatgcgacaatctgtgatacctgcagattgtactgcttctttatgataactacttgctggcattatgatcatattacactgctaataatctacactactgaaattagcttgtactatacattatttagtcctgtaacatgtgcccaatgaagcaaagtgtgtgtgaagaggttgaaatctcaagattaatgcagttattataccatgttattgaccttgttccgcttccacggttgctgtatattgtacttcagagactgattaattagtcttcacttcaacggttagatgaaaaaaagactacaggtttccttttccaacaaaaatcactagcaacaaaccatcaataatcatcgatgtgttaaaactgttaatcgattgctgcacacaatttgctaccttagcaagatgttagcatgagagagagaatcgtgtcctctgctccgtttaaattaagtgaacttgcatagttacatgcagtgccgtcctttgacgtcttgcccatccccgtcgccagcgctttctagttagcgtgtttggtcgtcgcacggttatcacgagaataggcttaagtccttgttttcagcgctttctagttagcgtgtttggtcgtcgcacggttatcacgagaataggcttaagtccttgttttcccttttttttctcctcgctccccccattccctccctctcttctttgtttgccgtttgtgtaaattttattcctcttaaggccatgtacaacgcgtgaccctagcctgtcgtctcaaaactccacgtcggagccgagccgagctggcacgcgtttgggtggtttcgcagcctgtcagcgagcttgtagaggaaccagggcaagcgccgcgcctgggctcgggaggcacgaagccacaagccgaagtctcacgttggaggagtcggagctccgcgccgttgcctcgtccggtccccccgtgccgtggtcgtcgtcgcctcgccagatccaccacagccgccgtggtcatcgtcggatccagcgagcccgccgccgccaagctcgccacgccgtcggcgagctcatctgcgccgtcgtggggggaagaagacggcgacgtcgagggacagccaccgcgttgtggccgccaccgcccgatccggcgagcccgccgccgccaagctcgccacggatccggcaagctcgtccgctgccaagctcgccacgccgtcggcgagatcgtccgcgccgtcgtgggggaggaggacggcgacatcgagccatccgccctcaccgctgctccccgccgccgccagatccggcgagtccacgtccggatccggcgagcccgccgctgccaagctcgccacgctgtaggcgagcttgtccgccgccaagctcgccacgccgtcggcgagatcgtccgcgccgttgtaggggaggaggacggcggcgtcgagccatccgccctcaccgctgctccccgccgccgccagatccgccgctgccgccaccgctactccccgccttcgctagatccgccgtcgccagagctcgggcggcaccgatctgccgccggaggcagagagaaaagagagggcgacgaggggaggggagaggagaagagaaccgagcaacgctgtcggtggagaagaaatcgaagagagagagagggagggaataaaaaagagaggggatgggaagaggctgacagtgggtcccaagttgtttaggggtgcacatatacttcttttggttactatagggttcaaaatataaagtttcaataggtttgataatacaagggctgacatataaatagataggggctgacatgcaaaatttgttttggagtggcttccactgtgggtagtgtgacttttgtgtagttctatcctaagtggcgtcttgagaccacagttgcgtgtggctaccattgtacatgtcctaatacaaaagtgcacaattcttttacgtattccaaagaaagttacctgcagtcaaattttgctcattaacatctagcacactactgtccctctgcttgaatgattttatactagtactagagtaatgctgcacatactattctttttttacaaaactcttacaaataaagatcataaccatttgatcgagtcaattggtagttattagaagtcaagatgcaatcagggtttgccatatcagctttttaaagagtttgtaagaatttgtgttgcatgtgaaacattttaatttatgctgcgagcaccttatatgtgctcctaatattgtcatcacactgcaccttaccagcaatcggattatctttaagcaggtcggattagagaccgggacacgctaagcatccaatgggcctgtcaggaagccgacgatcttagcgtatcatgggcccagaatttccactaaaatccaggccattttacataggaattagtccactttgactcccttaaagtggcttgaatctagtccataaccctggaccgcaaaactggatatcttgacctcctaactattgaaaccggtgtaatttgactacctcagcggttttagagggcggttttgtcagtgttgacttggtcttcgttccacatgacgtttatgtggcattagaagttaaaaaaatatgtgggacccatttattattcacagccaaaaacaattgtgggatccgtatgccattctccctttccttcccttgttccccctccctctcttccttatctctcccttaccgttcgtgcgccactggttcgacggccgcttgatggtgcggtctccctgaagatggctctccaccgcacccactgcgcccttcgtagtccacttcatccaataagaatgtcgagcgggatgtcatcctcctagatgccttatgagtgattaagttataggtgggtggcgacggtgagtggcccatggctagcggtgagcacagaggaggccaagcactcagtgtgtctagaagcaatagagaggggtcaatgccatggcgggcgagtggccctggccggtggctagaggcgagcatggagagtgagcactcggtgtggcgtggggaggagagggaactcgatgtggcgagagcgtgaagagacatcgaaaacgtcaacatcacgaagtagagagcactgcgcctgagagtgcgacgagagggaggtttattttgggtgtagcaggaggaaatgttgaggggcccgtggaggggacgacgatgtctacgatagtgaggctgggagcatggggagacatgcacggtgcttaacaccgataatggggaagatgagcggcctgcgagtggagagagggaagtggtggaagaagaagtttagaggtagtcacttagatgtgggtttaacgtctaatttttaaattctttaatgactgaactatcacatgaatcccaagtcaaccaaaccagtcttaaaatagttgagggggttattttacactgattttaatacattggggaggtgatgtacctggtttcatggctgaggatgcatagtaaatttgatcaatagttcagagttgaatttacattttgcttttgaaaaagaattttttttttgactaagtacaattgacggagcgtggggctcctcaccgggagaccgcgcaggcccccctttgccggttcggccgggggcgctaagtgagtttcttcgccctcgatctgaggaacgtcagcgagagaggaaatgcacaagacacgggcgacgtagacaggttcgggccgctgagaagcgtaacaccctactcctgtgttctggtggatctgtgcatgaaggaatacagcgaggccgagagcgagagagagttcaggctctaaaaaccattcgccagagtccccactcccttctcccctaggcctgggcctcctttttatctggtcaggggtcaccacatgggcctctagctgcctaagaagggaaacatgctttttacaatgagggctagtctacagccggaagtgacctctgacaagcaaagcacacgcctcctgccccgctcgcctgctttcccggtggacgcccatttcaaccttcatttaatggctagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggcagcctgttgccacctaacccgcgatctgaccggtctgtgaccggtcacacaccccggaccggtcacagacactatcagcatgctctgcgccagattaaatagccagagtcaacactcatacaacctgctgtaaatgccgataggagcacgaactatgctaaaatgaaatttagaaaaccatactatttacaatggcatcaaaaatcattaaatccttgggaatagatttaacaaaagaagtgcaacatgtggacactgggaactgggtgagtcattgatgaaaggaattaaaacacaaacaaatgggaaagtaaatgtcttaatgggttggaagagttaatactgtttaaacgtccatacccatccaaaggag

SEQ ID NO: 64502 - DNA, 1493 bp, Oryza sativa
  unsure (1)..(1493): unsure at all n locations
acagcattaaactttggatgatcatatcttggtcatacgagctctgaatcgacccgttcaagtctcctaatgtttgttataacctaaagaaccgtatgctttctttttatgtattgttattgtttctttataggcttgtagctttgcttgtgtgcttcgcgtagcttctgtcgttccggaggttccagaagcgtggttcgcggtcgtcgccaaaggttcggaaggccgttctctctgagcaaggcaagtcacatcatccttgagcatattgaatcccagtttataaaattattttgatttaaattaatgcattatcgctttatataaattcccgcgttatcactgttttatttagccatgcctatttacctttgttaagacattattattgctattgttattattaccttgttcaccctagaataaacaaaaccccaactagtggacactctattcatggttccactagtatgaatttaggtagatgcttcgctgtttaattaggcaacattaggtggttttataactttagactttgggaaatctcatatcatttggacattatggaattgttggattatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggctagtgtcctgctgctaggggctcaatcctgcctacctgtcccggaggttccggccgtaggttgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagcctagcaatgtacccaagttagtgttttaaattcttaaaacctgcttaacaactaaaatgtggaatggttggcctgggttggcttgggacgagctgggaccctgtcgcgtcctaaaacgactctaaaatacatcctcgaaattgtgccgagaataattaaaattcgtgtgaaagcctccaacaattaaaatgtgcaaatataaaagtcaaataaggcttggaggatttttgtgtatttcctaaaagcctaaaatgcgtaaataaattntagtgaaattttcagagcacaaataataattgagaagaaataaacaaagttaaaaggggtttataaaaagaaaaatccctaaa

SEQ ID NO: 64503 - DNA, 5207 bp, Oryza sativa
agtcctacacactcgaaatccaacaaatccgacacacgcattctcgaaatccatcaaatcctaaaccctcgaaatccatcaaatccgacacacgcatcctcgaaatccacagaaatcacacccgcattctcgaaatcaacagaaatcagggggaagcagcgttggaaacacagagatcagatttgttgcggagttgtgtacctgggccttgcgcgcctccaggctcttgctgtggtcccggtcccgcttctcccgggatgttgatcgccttggcgccctcgcaccaggcggggtggctcacggcgtcctcgtaggtgaaccgatcgaaggtgtcgcacctatggcgccctgcggcgttcggcgagcatggctgcggcacccgcaccctccccaccaccgcggccatcggcttccccgccgcctcacgcactcacactcctctcgtagatgttttttttttcttcttttccttctctttgtaaaatgtaatctgattttgctggttgcctagtcgtcccctgtttatataggcacgggtaactctctggtttatataggcacgggtaactctctggctagaacctactagaaattacaaatggttttaacccttctgagagtttttaactttttttaaaatcaaccgtgtaccatgcaattttttttacacgtccaacaaatcaacccgttttgagtggataaaattctttctactaagctgccctaataaaattcttacaacccgtttagatgtagggaaatttaactatttaccactcttgtgatatggcaattaacgatttgccactcactatctatgacatgtgggccctcatatgtctatgatatgtaggtctagtggcaaatcgttaaacaccattctaagagtggcaaatatttgtgaccatgggttagaaaaacctgcggtaatttaggaccaattcaaacgtgcgttggattaagattaaagtacgtgcactaaacaaaaaaagtgattagacaatgattaattgagttttaattattttaaacttgaaaaaaattgatttatatgatattttatactatctttcacaaaatgcaccgtctaacgggttgaaaagcatacgaacgaaaaccgagaagctagaagctagaagcaaaaaagcaagggcctagaagctagaagttggtgactgctgatagaactggaccgatctgaatattttaaagtaaaaatgtctagttcttttaattcgtgtattttcaatcaaatcacaggcaactactaaccgttttgaaagactatttttctctttacacatattagtttttcagaaactttagttgataggtagggtataagttacctaaaacccttgcatatttgccattatattcatcattatgattatgaataaaaataagtaatagccgatggataaaagagctacacaaaagttaattatatgtgggtccatctttgagctggtcttcatgttgtgttgctttcatatttggcaaatttttgttgagttggttaaaagttttatgaagtgaaaggaagtttatttgaaaatactggacggctgatctgtggttgtgcgactgtttcgtgccgtccgatctacgagttctacgacgaacggcccagatcaaagcaacggctagccctagccgccaccccccgccgccggcgtgcctcctcgccgttcttctcgttctcttctctttcgctgacctggccgccgccgccgccgccgccgccgccggcgatccgagcgggggtcgccgtccgctcttcttcctacttagtcctctccatcttttcccgagatcccgacacgtcccctctctgttcgcttcttaatcccacctctccctccgccgtgtgtttggttggttctccgctactgctacacggaggtggaggtggaggtggaggtggaggtggcggtgtcggtggagagttgaggttgtggcagcgatgtagtggctgtcgcggtggcgagcggacgcgccgctgggagtggtctccgccgagaccgaaacctgcgaagaggagatcgccgtcacatcctggaaacacctgccggcgctcggttgccatggtcgtcgcacgatctcaccatcctctcacatatcaggccaagaaggcagcgatagagagtcctaaggtacaataatttcaaagcaggtgagaaattacaacgctctgttgtttcatgctgctccttctgagctagttggtctgaaaaccttcctcgtgtgctttaggtgtttcgatcagatccaacaagtagatctgtttctcttgtaatttcggtggttggaatgtgcgttaatgagaacaccttttgaatgttgccatgtacgtttgtaagtgtataatgccttcaattctgctagatcttcaggatttagtctgttgcttatgttatttcagaatggatggggaccgattctgttgttacggccatgttgtaatgtaaagttagtctgtaacctattctgcgcaaatttggaagggcaagaatttgggggtgattgctgtggctgttgtgcatctgcagccaatctcagttgcagctgcggcggtggctacaacagcaagcgcaaccgatcaccccctttgttttcttcccactgttgtccatgaggacacatgttaggttgcatatgtggcaaagtaatatgctgcaggcctacatctttggttttcagcagctaacaaagcacactcttcctagtttcttgatgtacctacgtagtgatgctggtcttgacttagaaattagcatctgataaccacattggtttttcgcgattggtggatagttctgtcactgatcttattctcggtttctgatgaaggattttggctgtaaacatttggatatgtctacaatattagagtatatataacatgtgcaggctaaaccttactttgtttacttatacatatcagcctctatatttgattcaatgtgtgcaatctccaatgatgcttgaagatgcatgttttctttgcagtgttgtgtaggaaagtttgttagtaaagaagtgcttccaactgctcgaatgtgctcttgatttaggttgcaataatacctagttccatgtttgggtcgccaactcgccatattacataccacatgtacttatttgtgtttttggtttattcatgcttctgaatattcaaatttggttacttctgtaacaagttctctggactgtttacacttggccatttttcctctattctttcccttcagtattttttcctatgattatcaagggtaaacatgacccatcctacgatgttctctatttacaatagagagggagaaaaaacaaacgatgttttgaaaatacagtgtatctgtgtatggtttagagatactgatcctaatgtgtgtgtatggtttagagatactgatcctaactagttaggtgcccatgcgttgctatgggggaaatatagatcaaccttatcaaagctcaatatggttgtgttgtggaaaacaaaattagttggtgcatcaggaagcagtcaaggacatgacaacatgaaaaactgaatttacatcattaaatgtaaggataaaaaacttaacttatatgatcaaacccaattcattaaagacatgaacggatacaagtaaatttctggataatacactaatgctcatagccatctcttaagagcttctcaatacatcgagttgtaagtttgcataaatatggtgagcttgatgaaacatgaacgaatcaccattaattaggtactgtagcaagctgacattgtctgtttgctgtgaatcaggcgtcaaaaatcttcaaaaatcacagcactgttcacctctgacattattgcaactaaaacaagaggatccttgtccaggtgattgtctctgtatggtaggattgccattaatctgtccaattctcaaaccctttatacccgtatctgcatcaagctgaacaaaacaatcaactttgcactcttcaatttttttgctagtagcctttctataaacaagaggacgaaaaatcaaatatgcaaatgcaaactttccggatttagtgtaaacttatagagcccaattgcattcaattattagcgacaacaatgctgataagtcactgaaaggaaaagacacaccataatgactatacaacaaatgtctgtgtagaatcacttgaattgcttatatagaaagtatgttgatgacaacaatatacagtaaaatcagagaccgctacatagttcatgcactacaacatatttattcttatcctacactaattttgattattcagaagtgttttagcaatggaattttctttgcaagcacatgacatgggttaagttttttaatgaacatacaattgcttgatatgagggagttcacagttaacacaaagccatgaggactcacctgtttcgctaccttgcactgttatccacaaaaacatgcacctaaagctgtaaaaataagatggaagagaccgagagagaatgattagcttgtcacaagacatttggttggcatacatgagtgcctaatcctgagaaagggcagtgcatgttagtagaggaattgtccatgatgagtacctgaattagttcaaaaggtaaaaaagtttcagagaacatattttccaagtatttatctgattccttagttcagttgtcaaaaaaaaaatcagatatatagactacaaacatagtggacgggaattaaaagttttataggtctgtcaaatatgatgacaaatattttgttgatccttgaagcaaaatcctgcataggcaaaggattttataattgtaagtagcagaatccttcaagcgaaaccccacataggtaaaggattatatttggcaagatttacatgttaagtatcaaatagagaaaagattagtgccacaaatagattataattgtgaaatataatttactttacaattaacatcttatctttgagtagcacacatctttaggactacttatatactatcttttgctgcaaaatagcttgacaaattgataaaattggtgcaattctgcttgactatattagaaaattaactaatcagaaatatcgatcagaaaactaacaaatggttgtacgatgagttgattcatagcggatcccaggctatatatcttcctgaaaattcctataagctttctgattacttttgccattaggattttcaa

SEQ ID NO: 64504 - DNA, 4411 bp, Oryza sativa
ccgtcccagcgccggtggtggacgccgccgcggccggccatgttgctctggccggagagcacgaagatgcgcatggcggcggggcgtgaggcgtttgggtgtgagctgcagcctgcagtggggcaggtggatcgggggggagttgggacgtcgttttgctctcatggacgagcaattgcttgcactgttcaaaaactaagccgtcaagtactcaagcaatccttttttacaagttacattattcaatcaggcttaaataaactacaacaataattcgagataaatagaaaaacacataaggtaaacaaaatagaattgtcaaccttctgtcgacaaaaaatacatcctaaataggctagattttaaggtaaacaaaatagaattgttaaccttctgtcgacaaaaaatatatcctaaataggctagattttaagccatcagatatgcttcataattcacacggtgattctcctccaacttcgacgacctcctcttcttctttggcattgacaatatcatctcaaactccaatcgagaacctatggattagggttccattttgaggtgggggtaggagagggtaatggaaagaatagggagattatcgggcttacagggatagtcataggaggcaatggaaatggatgggtggcgaggtggcgacggtgtcaatgaagccactggatcaggatctgttgttgggcttggtgttgatggcgggggcaaagtgggcgatggattaggaggcagcggcggatggtgatggatctagcatgcgaggagctgtcgaagatgaggaagatgacaaggtagggcaaccttgtcatcattggtttgagaatgcgtaatgggttgtaagttcaagtgccttaatttgattttggtgattaatgacaaatctaactatatgagactaatcatttttatgagcctttctttgactagtctcatttggatatgaaagtaaaaatgatgagaggtatgtattaaacttcacatattctaacttggtctctcttgtggatccaaaatatagtgtgagcttgctatttaatctttattgattatgtgcatatgcgttccttcatatccatatgtatgcatatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttactttggtaatagatgataaaccgatgtttatgggattaacctctcttttgcataagttgcctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtcttatttacattgagaacatggagatcatgaaggtatatgttttatgttggtctacatcattactacatatgccttctctatatgtataggataaacccccattggttattctctaattatgcatacacttgcatctcttgtatatttatttgtatcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagttaaggatgacaaccgatttgttgagactaatgttctcctttgaggtgtgaaaaggaataggtcccactacgatgagactaatgaatgacaccatgggttagtggtcaccaagccaaggacatcgtcatgttggcaagaatgaagtcaagcttgtgatgagaataaagtcttgacaaaggatggacaaaacctcggcataaacatggttcaaccggatggtcacaagtgttgatctcagctcaagcttgaccccaagatggatggcgcaaggcaaaggtataatgtagctaagaatgttttcttagtcttttcccggtcttggtgtttggtgtagaccggatttgttagataggcgccgtactatcaagaggggtctatgaagcgagcttgtggatgatcttgtgccatattagttcatatgcatgtaggtgcattttgtggacttgtctaaccaagtgtgatgagttttctcaactcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgtcgttttactaacggtcggttgagctgacaagtgacctacggtctgaccgtgggccttaggccggtctgaccgggtctgttagccggtctgaccggcgtggtaaggccggtctgaccagccccactagtctgttgcactggtctggtttttggtggcgatacagagccgccagagccgcaaccggtcaaaccgagccgacggcggtctgaccgagccgtggacgatctgactggccactacactgcggtcagaccggccaggttgagtgggctcaatgatttccctgtaacggctagttttctagccattacaaagtagtccggtctgaccggcctcacaacggcggtctgaccggcagagcacaaagttggggatttcggttccaacggctcgttttggtggttgggggtatatatacccactccctagcagcaagggtaaggttttggcactccattgcattatcttgaacccttgcaagagctctcacacccttgtgcacttagtttatctagtgaagtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccgtcaccgtttgtgagtggtttggagttcaccaccttcggagtgaaggaagaactaccccgagtgatcgaggcttgggttgtcctctccgtgggccggctcccgccttgcccaccccttgacgaagggggcgtgaggtggcttcgtggttgagcggtggagttgggctcgcctcaacggggattaggaaaccggcgagtttccgaacctcgatgaaaaattccttgtctcttgtctcatttatttgttgtatttacatttgtgctatttatattcatagagacatatttgagcccatatcacttaggtttgcaaaacttaacttagttgcttagttaaccttgcacctcaccttgcctagcaacttaggttagttttgtttaagtgtcattaagttttaaaaccgcctattcaccccccctctagtcggcctccttaatcctacgtgggtttaggaggctgattgtggggtcttgctggcacggttgaggtcttttggccagttgagtggtggcgtgctgggctggtggcaatggaggagacagcgatgacgagaaacatgcagtaggtgatagtttaggcgtgtcctgctaaggaaaaaagtggaaggaattagggtttgagtatacgaagcaattgttcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcagatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggggcccctctctctcgcacgctcgggtgacctagggagtcacccagagaggcggcggcaataaccaccagatccgctccgctccagccggatctggcggggacaggaacggcgtaccggcggcgt

SEQ ID NO: 64505 - DNA, 6092 bp, Oryza sativa
ggacggagggagtatcatcatagctgatattaaatttgatcctactgcaacatatcatcaaaatagtcttttaaaggttattttgttcactaattagcagatgatttaatgtatctttttcaatggaatagatgagtaattatatcataataacatctctggttacttgccacttagttatcagcatattcactgtgtggtagctacactctaaaaatgggaacatctctgtttgtcatcagatgaatccacaggatattatttacgtttactggtttaggtatggcttaatgtagacaatgtctcatatttagcatgatttcataaaatattgttgcatcacatgaaaattcaggatgaaatgactaggaactactttacagaaaggatcgaggattggactaaggtgatggttggtgatgaacctgtgttacaccagcaaaaagcacaagaagtttctttttgatcagcatacaagtgtatattttcatgagcctctgaagcatctccagctaaacttttccagttacaggcagtcataaatacattgtttaaacaatgatctggtttgtattcgtcaggtccatgcaggcctaaggaagagggctcgctattaatgtcagtgctgagattgctgaatccatacagatcatatggaggcataatacagatcaaaacccttatttaggtgaaaaccatcaggttttctagatgtatgatttttttgcatgttcttcatacaggtactgtaactggtgtgaactgcaagtggctagcaccacaacctggtgtcgatggttttcttgtcagcggtacttcattgaaagtaaacattatataaacacagtagaatgattttgtaggcacagttacatgcctaattcactaaatacagtctcctttcttggctgtgtggcctgaatttaccagcatcattaattctgccactgcgaagtctgcctaagatcttcaccctgttcacttcggcatgaagatgtgttcaaagaggaacatacctttctctgtttggctctaaaagatgttattcggctattaaagcttttgtttattttacaaggaaaacaagaatatatttgacatgccacatttggccagcaaacttttcagatgaaatatgcaggaatcatgaatcaataatggcatgattagcaagcatcatgatgatcattttatttcaatttccacattgacatacctatgcccttggatgcgaaacacattttattttagttctgattagggtaattgattatttatggctagctaattatagtattgaaatatcaatatcctatatactttgtcgcagattctgattcggatgtaggagtattgattttgtgatagctgccttacctcacaagacctgggtcatccttgaattgaaccaccaggggtatctaggttattgtgaattcgtcatggcaatgcaggttttcctactctattaaatgcctatactgaattagtgatgggtttgctacgattgttagcttgtctgtttggctcgagtggaggatgggatcgctgaagcgtgatggttgttgctagccaccaatttagcttctttgatgagttcctaatttcctatttacttctactaattagtttacactggtttctgacatacttgggcaggctgaatcctctagctgtggatggttttggatgctctatttttagtaagtttactatacctcaatagaatagaatatattaagctctgctgcacaacacaaccttgcaacaatgtgatgaattattgctttacagagaccaaagcatcatgctaagagagtgatccagatattgatggtaaggaatgcatccttccatacgtactcatggtgggaattagttacgagcctatgacaacaatttatacttgtgcaatcctgcaggattttctcaggctcaatctccagtaactgagtcaatggttcagctgaaagtcgtcaaataaggtagtgtccatgtacgatttatttttttctctttcttttcgtgctctgaacaatagtacactcgtatgaaccttgaagctcttgcaaaattttagtgagttcgatttgcattacattcagttttgctatttcaaaagggaaagtaagacaattaaggagtttgccgctgagttatatgagtggtgaagacattgatttaaactttgctatgcaatttgttgaactagaaagaaacagtacaaaaccccttgattcaatgtcttgtgatgaagtaaccccgtaaggctatggtactcaataggaaggtatgatatatcaacacttcttcatttaatttatttgatgatacgatgaacatttgtttgccagaccaatgaagctactccaaggaagatttatagaacatgattttcagctcaaaccatgatcaatttttagcttatgcatatttattttaggagtagctcatgttttcctcttgttttcagcaagctaacttaggcgtttgtggagacaaagaggggactgataatttggagaactggatgtacaaaagagggttccctgcaacaagtatacatggagatcgaacatagtaggtacatcaaatctctgaatcatccgcgtatcatgcttacacatgcgtatcacaaatggattttgggggaaatcaattgtacccaatttatacttgatatgtaaaatagcaaattatttaacaactattgaatcttgaaatcactggaatacctgccaattaccggaacagtcattaattttattattggccatgagcataaaattttatagaacaacccttatttaatttgaaaacagaacccctatactacctttttgggtttactttagcaacataactgactttagttctcttttacaagaggcaactattaaaaaattaacctgataaatataaaattctttggtagaagatatgttaatgtttttatccagccttatgtatagatttggttgatcaagtagcagtagcttatatctatgctttttaaattgcctggtttacaaagatgcatagaaatttgtcattgtttcccatccgactaataccggttcatcaaagatctcattggcaggagagagggagaggtgaacaagggcttggcgccttgtcctccctcatgctttgagattgttttttattaatgatttaaaaatattgatgttatatactgtggtttaagcgtttctaaattaactcaacactagcaaaccttcttaacaaattcagaaagcatatgcaattgtaaaaaagaccttttcaactgaaatgacatagaataaaccctgttgatattaaaacccaacaaaaattataggagtatggtgtttatgtctcatcattcatcaaatgcacactggcactcaaggcggtaccaacaggttttcagttgcatgccgccatcagccactgagctcaaggaaagccaacagttaaaccaattagccacccaataattcaaagtttgatgctgcatttctgaatcaaaattgagatttgaatgttcactactgaatttaagttaagtactatttttccctcgtaaaaggatttcagaattttgctatcgatatgaatttttaacatatattgttgagacaaaagttcagtgctagattttttaaattttaccattattctgaatttctgaatctgtaccgttgggacttgaaagtcactaaagaagtagacaaagcactaaatttctaaattttagcaattgttcctgaatttctgaatatgtacaattggacttgaaagtcactaaggaagtagacaaagcagcaggtaacttagatgaccacccaatgattcaaatttcagtgctgaatttctgaataaagttgtgattttgaaggtcagtactagctttttttcgttataaactgaaattttactttcattatgaatttctaaacatgtgcagttcagaattgatcaggtaatggtaatgccaactgaaacgtacacataactgaattcattaactatttataaatgaggtaaagtaaagtagtacggagtacttggtactaattgatactggaacaaaacataattaacctaatcttaatcatgcagtattattagtagttggaacaagccagaacggcttgtgcacacaagaggcgtgctcgaacggcggcggcgccacggtctcgacgccgccatcgccgacgctgagcacatgcaggttgtagtcatccggactgaaggagttgaaccagtagaggcagttcgcccgcaccccgcacccgctcgccgagcacgacgcgccgaagttgccgccgccgccgccgccgaggacgaacgcccggtcgccgccgatgtccgccgtcctgcgccacgccggccccgccgccgagaagtccatccggtagacgctgaacttgtgcggcggcccttcggctcggaagccgaggaagacgacggcggcgaggtacaggtcgccgcgcgactcgacgaggtacgtggccgcgatgccgctcgagtcgggggacgggaaaatgtcgtcgatgccggggacgctcacggcgaccagcgccacctcgccgtcgccggtgaagtcgagcgtgccgaggctgaagtccttgtcctcgcagaagtagaacctcccgccgacgccggcgacgtcgaacaggtgccgcttcttgggggcgcggtactccacggggaggctgaagtagcccatgtcgtaggtgtgcgtcgaccaccgctcgccgccgacgcggcagaaccacacggccgggccctgcaggctgaggacgacgacgccggcgccggcgtccggggcgttgtcggacagcacgcacttgcgcgccgtcgggagctcgctctcgtcgagaggcggcaggccgaccttcctcccgtcacgggggtcgaggaggaacgtcgacatctccggcgccgacgaggagctcaggacgaggacccagccctgcggcgtctggaggtaggtgctggagtgcatctcgggaaggctgacgtcgtcgtgtgtcttcccgtcagacaggctaaaggccatcgccggcgagccggcattgcttcgctgcaccagcaaagggtaaccggcggcggccgacgggctcgatccatccgccatggtttgtttgctcaactatcgacgacgagacgattccggagtcgcaaactaaaatctcgggttatctctacggggaaaaagctcgttaagattcggttgagtgtatcacgttacgataggagcccttaaataggggatacgtataccggcaaaactctgtttaactcggtatcggcttcgcgtttcgcttttctgttccggaacggacaacaactgcattgacacggtgcagttttggggtacacgtgttccacgtgtactcggagagagtttctcgtaactctaaaatttgatttcccaataatcggatttataaaaagactaaaaaatgcccgttgcaactgaagtattttctcgtaactctaaaatttgatttcccaataatcgggtttataaaaagactaaaaaatgcccgttgcaactgaaggtattggtttagttaaggtgaaattttggatattttcttttaaaaaaatcatgagctgtagttatcgtctcaagttagcacgtgagtttttttaaagaaaatttcttatataactccttatgtattttcaaaagcgaatgagcttaaaaaccaactaaatgcatatatgtatttataaatgcaaacgaatttaaaaacatactcatacaagaatgacgtatcgaagtatcgataaaaacatctttaatttttataatagtagggatagggatagggatagagatagagaattgagtccaaagtttactccatcctttatatttaggacttgtttacttaattaccccaaaaaaattcctgccagataatacaaaataaatttttggtaagataggatatggatggctgatgtttagtttaataacttaccatatttttttggaagtattgagagtaggaagtttcagaattactaaaatttgatacacttgtgttgataataatacgataatgctgttggccggtcgcccggtgcgg

SEQ ID NO: 64506 - DNA, 17939 bp, Oryza sativa
aggtggtgtgaataatgcaggtactttttcggtatgcaggtggcatttcggagcttccgttgtggatgctttggttgacagggtctctggggtgaaaaccttgctccgctccggtgctagtaacagcgatgccctcgggcaccattcaccttcttgaaggcgttgcttttggagccctcatttcaactccactttaagggaattctctgggtgaaaaccttatattcgttaggatcggacgttgtcaccgttctgtcggcgttaccttcttgaaggcttcgttctagaagtttcttcccttgttgggctattgttctttgcgttcagtttgttaatgtcgggttttcgtcggttttcctgaaattaactgtgctgctgtaaggtttttgggtccgattttctttataaactggatcaactctcttcttctatagtgaaattgcaggagctccctgcctatcccctcgaaaaaaatcggatgaagatgaggatagaaggatgaactagtacaggggtacattaatttgctacagggtacattaatttgcttgccaacttgcagatgaatgacatgcacacacatacatacattagattatatcaatagcagtacacggtacagcagatgagtccactactattacacaagcaaatactggcaaatatgaaatgctaatacatgctattagcaatataatcacagaccgtatccatcacaaccttgctctcaagcgcatggtatgtgtgatgtgctggagtgacatctggtaccgggtggatatgagtatggtacagagggtttgtagcgatatcgtttgggtcgatagtatcaactataaagttgttcaatgccatggcggcatgaataatcttgttgtgcgcacgtggggtgcacgccggaatactgtccaatatttgccaccgagccttaatacatccgaaaagtccttcgaccaagccgcgcagagatgagtggtagtaattgaaattctcccccctgtctacgggtggtgccaccagttcaaattgtggctgctagctctacacgtcaggataaggagcgagaaatccctggctattcgcgtaccccttatcgataaaaaagtatttacctaaaaaaaaattactgtcagtacataagaattacgttaatatcataaaataataatgtaccataaataattacctggtggcagcctagggaactgatcaggatacttccttattggacttagcagaacccggtggtcgtgcactgaccccgaccatccagttacatcaaaaattacacggtcgctccagtctgacatgaccaacacaatttgggtagtttcacctacccggttatggtactaatttgctaggtgtgcagggacgacaacttgcacttttgttcatctatggctccaatagagttttcaatttttttttacctatcattatagcggacacatggatgggtagtactggaagttgggtccaccggccgaactatatcacctgccatacgggctatcgctcgaagcaatggtaaaaatatttggaaatagttgacccgatctttcgaacctattgtttgctctcctattagcttcaccccctgacatagttcacaggaaaatgcctaccgcttccgcttccagtgcgctaacctcataagacactaagttgtacttgaactgaaggatgtcactagcctaggtaaaatcacctaatcaggtcacatacagaacatgctcctgcaccgagcaatattttgtaatgtatgcatcacccactgttggccagtcagtaggggcacgcgacgtggtgcccttttgcggtcgtacaagtccagatgtaatgaatccttcgatgaaatcctcaatgtattcttcgatatcatcgtcggatatctcccccatcgaacatttagaatcatcgctgctcctagtgctcattgcttcagaactgcacagatatgattcatacagacacataagtaatccaaaatcaattgttgagctaacacatataacattgtgaactggacgtttcaataaatctaaaatgcaaatgtgaactagactcatgacataaaattgttacaacatgacaatcgcagcacaacgtttgggaataaacgaactacacaaatccaaatttaactagacgaaatacacatctctgcggcaatactcgcacgtgatcagaaggtagtagtgccgcgagaaactactggcagatattggtgaggtaaacctattggagctccactgcagagaagcaaggaatgggaagctagcagaagattagcgatagcgcggttcctcatctacgacgcttctcattgcacgcatgtcctctgcctatcgcttcctcatcatggaaaaggcgatcctttctcattgggtgtaccgcctcaccatagatagaggatacaatctaaaatagttgaatctttagttgttttatatttggattcttacattgtaatatacaacttgaattatatctggattcttacattgtaatatacaacttgaattttatgggattttgatcgtagagtttaatttttttcattcaaataagctggatacgttgttgaatataaaaacacctttttttcatgtgttgtaatccaaataagtaaataagaccaatcaaaaaaatttcattaatgctttctttgtatgaagtaatcttggggcaattgtttatttgatcctattttaaagtctaacttccaatttaaccctacttttttagtttgcttatatgacctcgttttttccaatcaaaaataaaaggttgacgaccctatttcgtgaagacatgataacggtgttaactaaggggcgaattgtcctggttgcccttgctcatatgacccaaatgtatcaaagttttttttgtttgttttgactttttaacataatttaacgagcataactttgatatattagagataactttgataaatttggattcaatttgacagatttggctcaatttgataaatttgactttaatttaaaaaaatgacataattatggcagatatacaaaatttggacaacttttctcctatttgtccatcccaaatccaagtgatattcatatccaacataaaatttctgtccaaaagcatgtccatcactatgtgacaacacatacaagtcccaacatcacaccaacgaccaccacagccatgctgggcttgggatgctggacgagctagcagcggtgatgacggccgcccgcagaaactttttgagaacaaacgcataattttgtagttggaaagctgggaaacgaactcagtctacgtttgttgctctatgttaccaacccctctctctcgtattccgcgtgcatgcttttcaaacctctaaacggttttgcaaaaagtttctatacaaaagttgcttaaaaaatcatattgatccaattttttttttaaaaatagctaatacttaattaatcaagcgctaatataccgctccgttttctgtgcgtcggcgctctatctcattatcctctcgttggcgcgcgcgctctctctctctccagcctctcatctccctctctctccagcctctcatctccctctctcgattcaaagggacagtggcgaagccaccgtaggggccagggagggccaacacccccctaacctctatgtgacctcccctcccctctcttatcccaaggatgattagcacttataatctagctattaattatatcattagttgcagatgagactaactatataggacaggacaactagctagctatatatatataggacttatgaaatgacttagctaaatgatttatcattttagaagtgattgcaagactccaattaatgaaacaaactgttcaatcatccatatattaaaaatattactgaattttaaattggcaaatcatgatatatgggttcttgttctctcttgtagctaatcgctgtaatatgtatgatatcgagttaccgatcatacatcaacgctacaaaatcactgttcactaaaccttaagtgagttgccatgtctcgtagatggcaccctccatctctaaatcttggcttcgccactgcaaagagaagccgtcatggcggtgatggcggcaaggggagctggcggcgatgaagtgtacgcggcacagtggcggtttcagtggtggtgaagcatgggacgcggcggcggctcgaggaggggcagcacgcggtgaagcatctaggcccccggtgttaattttagtaattaatgacaagcgctaattgtggactaaccgttgtctttgagctatatattttaagttaggtcgacgtcatgtgtgcgcatggatgactatcgatggattaaaatttgatggcgcgaagcgaagaaaagaagacggtaaaactagtgctttaatttagaattgatcgaggtgtagggcgatcaaatttgctagtttattttttagtttcgccgtactattaagaggggtaatgacctagcaaagagatgattttaattgccacattaggtcattgcattttcacttgtgctcacatcttcatagcgcgcacacacaatatttcactcggctcggcctgaccaggggcggtctgaccagccacatagtggcggtctgaccggcgtgccctggccggtctgaccagccgcaagaaggcggtctgaccggcgcataaggccggtctgaccggcggcacatgcgcggtcagaccggccccttggaggccgggatggtgctgcttggggtggccgatacagagccgatggagccgtagtcagtgagaccgagccgatggcggtctgaccgagccgtggccggtctgaccgcccactcaatgccggtctgaccggccaggccgatggggccctctgacagctcttcaatggctagttttctagccgttgcagagtagcacggtctgaccggccacatacctccggtcagaccgacagagcacaatgatttgggatttcgcccccaatggctagttttggtgggtgggagtataaatactcccccaccagcagcaaggggactctcttggcacccaattcaattgcatacatcctttgcacctctctcacacctacttgagttttgtgttcatccatctagtgtgttagaaggttgattagccaagagtcaagtgcattgctttcatttgtagagctagtgtggcacttgattgatcatctccacgccgggtcattgcttgttactattggaggttgccacctcctagacggcttgtggaggagttgcccggtgacctctccgagaagattgtggaggaggcccggcgccggtttgtgagtggtttggagttcaccaccttcggagtgaaggaagaactaccctagtgattgaggcttgggtagtcctctccgtgggccggctcccgccttacccaccccttgacgaagggggcgtgcggcggcttcgtggttgagcggtggagttgggctcgcctcaacagggagtaggaaactggcgagtttccaaacctcggggaaaaatctcttgtctccttgtctcatttgattgtcacatttatatttgtgcaatttacatttctagagacatacttgagatcatatcaccctaggattgctaaacattgacataggagtgtgatttactttcctagagatataattgaaccactatcaccctaggtttgcaaaacataacttagttgcttagttagagttgaccctcaccaaccttagcaccttaggttagttttgattagttgtgttttagttttaaatcgcctattcaccccccctctagtcgacatctcgatcctacaagtggtatcagagcttggtctctcttgattgggcttcaccgcctagagagaagatgtcgaacgaggtgaaccatgtagggaaggctctcatgtttaatggcacaaactattctatttggaaaattaaaatgtctactcacctcaaagctatgagcttccatatttggagtattgtggatgtaggctttgctatcaccggcacgcccttgacggagattgatcaccgcaacctccaactcaatacccaagccatgaatgctttgttcaactctttgagccaagaggagtttgatagagtgagaaaccttgagaccacatatgagatttggaacaagttggcggagatccatgagggcacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagggctctaccggagaagtatgagacccttatcaccatgctcatcaactccgacatgtcaaggatgacaccggcaagcctcttggggaagatcaacaccaatgacatgtacaagttgaagaagaaggagatggaggaagcctcaccttctaaaaagtgcattgccctccaagccgaagttgaagactagggcaagggcaaggtgaatgaagccaatgaggacttggaggaagagattgcccttcttgctagatagttcaatgatctcttgggaaggagaaaggagagaggaagaggctccaactccaataggagaagaaatagaagacccaacaagactctctccaacttgaggtgttttgagtgtggtgagaagggacactttgcttcaacactttgcttccaatgcccttccaaggatgatgatggagacaagtcatccaagaagaagagtggaggctacaagctcatgaagaagctcaagaaggaaggcaagaagattgaggctttcatcggggaatgggactcaaatgaggagagcttcgcatcatccgggtccgaggaagaaggtggtgatgatgcaagctccaagaagaagaagatggtcgttgttgccatcaaggaggctccatcactcttcggtccactttgtctcatggcaaaggactcatctaaggtaacatcttttaatgatagtgagagtgatgatgattgtgataatgtttcctatgatgagcttgtgagtatgtttgaggagctccatgcttataatgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagctctaactcttgtgtttctatttgtgatgcctcacttgttgttaaaaacaatgagcttaaggagcaagtggctaagctcaataagagcttggagaggtgcttcaagggtaagaacactcttgacaagattttgagtgagcaacggtgcatccttaacaaggagggacttggattcattccaaagaagggtaagaaaccttctcaccgtgccactcgttttgtcaagagtaatggtaagtattgctccaagtgtcgtgaggttgggcatttggtgaatgattgccccggtggtaagcctcctaagacatgcatgtttgattctcattatatgcttaggaaggctcatgatggtagcattgttgatagatatgtgggttcccctatactcggtggtaaaaagaatgccatttgggtgcccaaagctttggtctgtaacctccaatgacccaaacaagtttgggtacctaaaagagcttgatcttcttttgtaggtgaactactgcaccggtgggagccattaggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgctttcttcccgcaagaagttattgtttctaaccttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgttggcatgaatcaattgagcaaactttcaaaacgtgatctagttgtggacttgaaagatgtgaagtttgagaaagataagctttgtagtgcttgtcaagccggcaaataagttgcatgttctcatcctactaagagtatcatgtccacatctagaccattggagctctttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaggataccaaaggatggcatagtagggtttcatttgcataaacagcatttaataaacatttcagaatttaataaaacagttaagtaataattaatcaatattaaaccaacgctatacaacataccctgttgcataggcccaaccattctgaacaaccatcccggctgcacagttctatctccaaaccaggaatataccattccaaaccaggagctaaacaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacgatgacgtcagcggcgacgtcacctccggcggcggctcggcggctcagcggctcgggcgcgcttgctcgccggcgaacgacggcgcgacgacgcggacggagggcaccaggacgtagagcgcggggcggcgaactcaccgatgaccaaaacgtcggcggaagatgaacggacggcggcggcgacgagaaagaagcggcggagaccttcggcttgacgacgacggcggtgctccggcggtctacagcgacggcgaaggggcggacgaggacggcggcgacttggcgaccacgatggcgacctccccgagcgatgacgacgaccggaacgacggcgaagcacggctggagcgacggcgacgactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccacgaacttccaaagcgatttagacgatgattccaaaagagaaaaggtagaggagatcccgaagattgtttcccctctattgatttcaccggatcgggaaagacgcggccaaatttggaaagcggcggcggcgacttggcgctagggtttcgggcggcggcggccggaggtagacgaagactgacaggtgggccccacctgtcagtgggcggacgcgcgcgcgcgagcggcggctgctgctggactgggccgactgggccggggagagagagagagattttgggccggctttcggcccaaagccaaaagagacttttaaaaaacctttttcaatttaaattattcatgaaatgcaattccatttattaaaaatacttccttagctcaaataaatcccagaataatctaggaatcatagaattaagcaaagtatttaatgaaattttatctagccccattttatattggaatttattaattaaaattagatcttctcttctaggcttttaaaataaattctaataattccaattaaacaacaatttatatattttggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacggataactcgatttctggttcttctctcatctatttccaaaatacggattggtttctcaacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcggtgccaattttcctttggtgtgaacacgatgaactcctcgaagaggcgtgacacgaaggtacacataatctccttcttcaaaactcaaatctctgcggcgattgtcggcataactcttatgacgagactgggccacacgcaatctttcttgaatgatctttaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccgaagtctaaagcacaagctctcaacatatcttccaaaatctgattcaccctttcggtttgtccgtctgcctgtggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgccaaccgacttccggaataagttgtctttactgggatgaaatgagccactttggtaagtctgtcgactatcacccaaatagagtcatggcctgatgacattctgggtagaccagtgatgaaatccataccgatttcctcccatttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacattttggtactaccagggtgaatggagtataaagtatcatgagcttctttcagaattgcatcttttaaatctttgttgtcggggacgcagattctctcacccaaccatacagttccttgctcatcctccaagaaaccgatagcttttcctcttctcatattcttcttgatttcttgaatatcagaatcattaatttgggcttctctaacttgatcaattagagtgggcttcgcttctaaggctgcaacaaaacctctactgacaattcccaaatttaatctttcaaattccttgcataattccaatggcaactgtcgtcattccgtagcattgcaatagcctttcctgctaagagtgtctgctacaacattagcctttcctgggtgataatgaattcccatgtcataatccttaattaattccaaccatctccgttgtctcatgttcagatccggctgagtaaagatatactttaaactcttgtgatcggtatatacctccgtacgagtaccgaaaagataatgacgccaaattttcaatgcatgaactactgcagctaactcaagatcatgagtagggtagttcttctcatgcggacgtaactgatgagatgcataggcaaccaccttcccatcttgcatcagaacgcaacctaacccaagtttggatgcatcgcaatacacttggaaacccttctttggatcaggtaaaatcaaaataggagctgatattaagcgattcttcaattcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaactgtctttggttgttttcaattagttacggattccacattgctaggatcgacggcaactcctcctgctgagatgacgtgaccaaggaacttcacttcagacaaccaaaattcacgcttactaaacttagcatacagttgatgttctcgtagcttctctagtgcaaggcgaagatgttcctcatgctcttctctggttcgggagtagataagaatgtcatcaataaagaccaccacgaacttgtctaggtattccataaacaccttattcatcaagttcatgaagaaagcgggggcattggtaagtccaaaagacataacagtacattcgaacaatccatacctagtggtaaaagccgtcttaggtatatcttcctctttaattctcaactggtgataccctgatcgaagatctatcttggagaaaacggtggcacctttaagctgatcaaacaaatcatcaattcggggcagcggatacttattcttgatagtcacatcatttagtgcacgatagtccacacacatcctctgggtatgatctttcttttccacaaaaataaccggagctccccatggagatgaactcggtctgatgtatcctttctgaagcaaattgtctacttgccttttgacttctgccaactcattggctgccattctataaggtctcttatggatcggagttgttcctggtaccaaatctattctgaactctatatcccttttgggcggcataccaggtaaatcgtctgggaacacatcaggttactcctggactataggaatctcttccaaagttatttggttcagtcttgaccttaaagactcagaagacaatgcatgaacagttacaactcgaccatcatcactggtgagaattacttttctgttagcacagtctatcacacctttatatctggctaaccagtccatccctaggatgacatcaaggtctttggattctaacaagataagattggccagaaatggtactccttgaatttctattctgacagaggggctacgttgcaaagagagtgcctgattacttggggtactaaccaacaaaggacgtctaatatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcaacatgattgacacgggcctttgatgctggtgcggtagagttgctctgggcagggacaaccttcacacgtcggggcttcggacacttatcagcgtaatgtcctgggtctccacagttgaaacacaccacgggattgctgccttgctccttcttggcaggttgttgctgtgtcgaagctgcaacagggcgtggagcttgattgcggatgttgttgccagcattgttgttgaagaactgacgctgcggacgaacaacggacgaagaacctccctgtggcatggactggggtcctaaagtaagacgcggcctctgattattcccctgttgtgtcttgaagtgagcaatccggcgtttcttctgctccatgcggttgtacttgtcctcctggcgaatagccttatccactaacttctggaaatcaggataatctccagtcatgagtggataagaaagctcatcattaagtccttccaagaacttctcctggcgctcttcatcagtgcgtacatcttctggagcatagcgagccagacgattgaactcgtgcagatactccgtaacagagcgagacccctgagtgagcgacctgaattccttcttcttgagagacaccactcccgatggtatatgcgtcttccggaaagcagcggtcaagccaagtgataggttcagcagtagtcctattcaggcggaagtgatcccaccattcagatgcagggccatgcaactggtgtgatgcaaatgagaccttctcctgatcggtgcactgaagcaaatccaacttcttctctatggcatgcagccaatcaccagcttcaacaggattagtggtactagagaaagtgggcggcctcacacgaagaaattctgctaacttgttctggggaggtgcatggttatttccctggttctgctggttctggagttgctgcatcatcatgttcataagatgtgcctgttgagccaggacttgggcaagtgtgggattctctccattgttgttgttattgttgttgttgttgttgaggccattcccgttgctgcgagtgagcaccatctggcatgggcaagagcacaagaagagaaaccggggaaaactacttaggactgagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgaggcacacacaaccaaacttaaaacaagcaaactaacacaacgatctaagacaacggtttgacaaggctttctaattcttccgggcatcggagttgattgaaggctcgttcggctcgtcttcatcatcttgaattgctccccactcgatcttggaatgggtgcgcttggattcttctacttcatcatcacttatgttgacgaccggagaatccgctagggctggggtaacttttttttccaccacacggacctttggcgccaattggtagcgatggacaaatagagctctcttccttgcggtaagacgaaccctggccttctgcggtggtgcttctcccttcaacgcggctagttccttctccaaacgatccactttgtcttctagcttgcaaatcttaccacgattccgatcttcacgatcttgagctgctaacacagtctccacacggctttcatccatagcccacagcatctcaaccaaatgccttgtggtagcatcattctcaattccttcagtcttaaggtagctgccacggtcacttccctgtggttgacggggatggtagcgatactcagtgtcggccaactgatcactgtagcgatcgcggagctctcctatggcgatccttgccacctcctgacatgtatggatgtagtttcttcctccagcttcgaacatcactgaggggatatcttcactattactgttcaaggtgactttgactccgcacttctcttcgtgacgatcatgaggaatctgggcataaaaaggagcagtcccaaatcctatggcaaaggacatcgtacgcaactcctggacaaatccttcaacaccaaacaagtactcaggcttgtagcgcggcatctaaagacaagtgaaaggagggaattaagacatttatccaattaatagcacaagtttctggattaatttgaataaagttagaaaatcaaagtaaaaggtaagtaaataaagtaaaccgagcttgcaagataagttgaaacagttggaaacgaggtcacaaattttgtacttttgaacaacaggttccaaaagaaataaaagaaagttataaaatcaacatgctaaatttatttcattgcagcaagattaaataaaacaatgttgtaaaacttttgctggtaaatgagctattagtacagtaatagatgtacagcactaataacactggaataaacttttgaatacgaaccattaaaaaaaatattatgaaatgcatgtgccattagtttggtttaattaaaagagaaggggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgccaggggagtatatgacatactcagcaagtcacgcagcaaatatgcaagtgcacaggataccaaaggatggcctagtagggtttcatttgcataaacagcatttaataaacatt

SEQ ID NO: 64507 - DNA, 26518 bp, Oryza sativa
cacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggacgatctgacaacaatgccaccaaaaagggatatcgagttccggatagacttggtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcacccaacctgatcacaaaagtctaaagtacatcttcacccaacctgatcaaggttgctctggtttttggttgggttttttgcaggtgcctaacatcaattgttgtctctttgggaaggtggtggcctctcttttgtattctttatatctcctcccctttttctgtttaatctgtaatggcttgccgctggtatagcccaatctctgtaactcagaactatctttctttggcaatgaaagatttaggtgaggaatctctcccctccggtgattaatcaaataaaaataccgttacaaatcggggttgaagtaatattcttgctatgtatcagcatcttaacccccttcataatacgtttgattagttgttctgttgttgattcctcttgattgaacacatggtggtttctctccttcaatgttcccacgtcagtagaatgaaggttgtttttagcccttgcttgtggaggcgtcgatgtgtttcctgttccatattcccacggtcccaacaatgcagtacaccagtagtgttgtcactaattctagggacatttaactatttaccactttttagattaagcattttactatttaacacccatatatcaataacacatgtgtccacatgtatctataagatatgggtttagtgataaataattaattgtcccatctaaaaataacaaatagtttaatatatcgcttctcccagcgccgcgttgcctccccatcccccgcgcgcgccagctgcgccttgccgcttctccttccccagacgccccaccccctacgccgccacgctgccacccgtctgttcatcttcgtttccaaatagccgatgcttctattaatttgtttgtcgcctcctcatcccatcctctcatacatgtcacacacatgttgctgtttgctgctaatgatgatgcaggacgaaaagcagtgcaaaccttggtgctgtcactggtggagaaatcatctttggtcggtcgaccaaattcgacaatagtccaggttccatttaaaactgggactaaatacgattttttagtcccagttaaaaaaattttgatctttagtccctgttggtattaccaaccgggactaaagatgatttttggtcccgattcatcccctgtcagaggcatgtcaggaggccgaggatctttagtcccggttcatactaccaaccgggactaaagattaccactttagtcccggttaccaaccgggagtaaagatcatttagatctttagtcccggttggtattaccaaccgggagtaaaattaaacacgtagtatataatctatagtccttatcctctcctctactcgcaaccactacctcacccacatatcgatcctcctctcttctacccctcctcccttctcctatcttatacagatcctccccttcctccttcattcccctccccttcctcctccctcacctggagatggatcttacacagatccttccctttctccttccttcccctccccttcctcctctctcacctggagatagaggaggccgcgccgtgcggacgcggtggacggacggacgcgcggcgtgcggcgcagacgtgctttgcaggggaagcacatgcgcgcagtagtaacgatagcggcagccggcagtagtgggattcatattttgtgattgatttcttgagtagtagcacatccgacagcttgttttctctctttttttttttgatattttgtgattcactgagatgtataattttgtgattcattgtatggatttaagatgtataatctgtgttatatttgatttgtgtgtaaattttttaggatttgtgatgtattatattggtgtgtataagtgactttaagatttgtgatgcggatttaggatgttactttgatttggggatttggtgtttgatttgggatgtgcatgccatccgattcgggagaaaataaaaaagtaacaaaaaaaataaaaggggaccatccgggactgtccctatcctctccttagtcccagttgataacaccaaccagaactaaagatgcctctctttagtcccggttggtaacaacaaccgggactaaagattgatctttactcccggttatttcaccgatctttagtcctagattcatagtcccggttagaaaactgggactacaggggggagtatagggggtttacaaatcgggagtaaagacagtttctccgccagtgtggtgcccatctgagcacgcatgttattggatccatctgctgggccaacagggaggttttttcacttcatgttgatctctattgttctgggttcatccctaatccagataagtttctctttctaagcaacattgattggcgtagtctgagcagcaaactaatctcttcgcaattaagctatcaatttcgaacagaattaagtatccccatctagctcgctcctcttttttttttctccgcacatacgtatttgctcccgcgattattcactcccttcattttcttcacaggattaatttatcatattctttacatatttattgctggatttagtagctatgatgttgaattgttggggcaaatttcttttcacggtatgcatacattatatcttttttcgcttgatgcatacattgtttttttagataattgaaaaaaatatctttttttttcacttgatgcattcattgtatttgattgctaactacatattttttttccaattttgccttgcagctgtccaataactactaatatatgtattatactgttttagtattctgtattgcgcatggagaactctgagtagtgaacatgcctattgaatcagtgaaattatttgatctgcagatcattttgtgcaatgcagctataaaatttcaatgtatagacatgagaaatattatgtacctataaaaacacctcacatacaaaaatgaaatacttcttgtagtgatttttttagcacactatgctaagtggtcaataaagttgagttgataaaatgataaatgataaccattgatatttaatttctattggatggttgtgatgacacatggaactcttattttgtgggtggtgtgattcaatactccctccgggctgataatacttgccgttttaaacaaggtttgaaggtcaaactttagaatctttgattataaatcatttttaaaatatttgtctttcaaatatggtgattacatgtatagattagtcttaaaaagtactttaataaaattatatatttgttaacaaatttatacatattataatgaaaaataatggttaaacttgtttttgataccgtgttcttatctaaaacgtcaagtattattaatccggagggagtagatatgccttgtttagttgtctcgcgggttagtaggagatcagtttcagtgcacatcatgataataagaagaccaaaacatgtctcagtactctctcaaataaacgggacgacgaacgtacgacgatgattaatacaagtggtccacgagcagtgatcagatctaggctacacggtagtaggtgctaaagaaaaccttgcacaatcttatcttcctgacatcatgtgatatctggaagaaatgaaattagtgagtgtttagacacaaagaacttctaacaacaaggcttatcgtaaaaattagaaggcgaagacttgaatcattgtaggagtaaaagcattaggtgggtataatgccttatagccctcctttttttttattttaaacctatatagggcttcactcgttcagttttttcgtgttatatttaatgaaattgatacatctgtgtggggttggataaagataaagaaaacatgggtacctttgcttgcacgacactacagtagtactagtatgtttagttcactagttcacattaaaattagaagtttagttgaaattgaaacgttatgatcgaaaaattaaaaatttatgtgtgtaaaaaagttttgatgtgataaaactgttagaagttttaaaaaaaagtttagaaataaactcgaccttggtcaaagaaaggacgacagatgatgcactactgttacggctgccccctcacagatttttttttggcccggtctagttcccgactttttaaaaaaactttcaacttttctatcacatcaaaacttttctacacacataaactttcaatttttttcttcaaacttccaattttagtcaaattttcaattttggcgtggaactaaacatttgtgtgttttttctgaggctatgggtgtgttaatttgcgaaaataaaattttttgggtgttacatcatacgtttgaccggatatcggaagagattttttttacatgaatgaaaaaactaatttcataacttgcctggaaactgcgagatgaatttattgagcctaattaatccgtcattagtacatgtgggtactgtagcatttatggctaatcatgaactaattaggctcaaaagattcgtttcgtgatttccatgcaaactgtgcaattagttttttttttatctatatttatactgcatgcatgtgcgggtagtaagatatgactgatgtgtaaagcaactattggctagaaatgagagagaaagtgagagatgggagagtttaatattttttatgctcttattactagatagtagtgctattgcctggtataattactacctcctctactacccacccctacaatagtaaagtagatagtaagggggtcttactacccacttttcatccacattgcggacgccctaagaagcgcaagagcacactagacgcaggagactctcaggatgtcaactagtatacaaacagtaagtagctagcaagactggacttgcttgtacacatatatatgaccaaatatgtgggaaagtgttttcatccctcgaggagatatctctcgttttgtgcgtgttatctaaatagttatgaaaaaattaaaaaaatcacaagatagattattatgaaatatatcactccacaaacatgtatgttaaaattcaacatttacaaattgtagcaaaaataactacgaatgtacgagaactattttcaaattaatttgttcttttttgcaactggcagaaatcgaatttggccttacatgctcgtggactgatatatttcatattaatttatattgtcaatttttttaaacttttttttgataaatatttagatggcatgcaagcaacgaggggatatcccctcgtgagatgaaaatccacatcccaaatatgtttatatattgaagtgaggggtgtcacaagattaagaaataaacatatgatatttattgatgtcaccaaattttcccttaaggttgcatatgcaagtaaaagttttacttataatgacgtgaacaaaatctcatacgttcatctttttcttcatacgataattttaggttttcacggtacatggtttacactgtatagtttactattcaagtgggcgtatcagctgcctgttttcctcatcggaggtaaaacttaatactcccttcgtcctaaaatataagggattttggttggatgtgacatatcctagtactttgtgtcatatccacctaaaatcacttatatttttggacggagggagtacgtaacatagagcattgagacatgcgcatgcctgcaccaaacatttaacgataaaagtaactgaacacatacacatcaagtgttcggatcggaggctaaacatacacaaaatgaaattccaaatgcatcactccgcaaaagtaaaccctgatccataaaacttggccgagagaaacttatcaagactatcggccatctctggcgtgacgtggttcacccaatctccgatgactcccttcctaaagaaagactcatgtgggtactcattggccatcatatgtagggagcctgtgctgttggcacccgaagccttcatcttctcaaaactgcaaagctcgatgatgctctcaacgatcccggcttccttctcggcgtcagagaatggctgggacccgatgaattccgtgattttctcgatgttcttcgtaggatcgcgtagaacctcctcgtactttaggaatagcaccttgtccggctttgccttactcgtgttccaatacccaaggatatgctcccagattgggcctcccaagtatgcaccctcacggatggactcccacacatcagataatgacatggtgatggactcccactgatcatcagataatgatgaggtcttagccttagaacagttcatgaaatgccataaagaaattgccatgtctttcggttgcctgcaattaataatataacaagaagaagaccataaccattaagactatgctttgggacgaaatggttggaaaccataaaaaaaatagtcccaatgattttaataaccatattttcttagaaaacaaagtaaaaaaaggcagaggcggatataaaaatggtattggaaatacggaaaattgaaaataaaaagatatggaaaaaaatgcatgtatcgatcggaaacatgactatgtaatatctgaaacaataatctgaaatcacatatttaacttgacatgattatataatatgaccacgtgaattcaaacttacactattctaaaaaaaagaaattcaaacttacactacgtaaatcacaaaccatctcttctttaggcatgtactcaaattaggaattgggttgaaaagttgatgggcctctagtaaaatagagacatggtatttagaaatatggtaattaattacagtattataaaaactataattttcgtgcaaatatggtaaataagaaaatggcaagtagaacatcaaaatcattttcgtttccgtattttcttgccttttgttaggttaccatttccaagctatgttaccccgatacgtcgctgagtgtcgcgtatctgtatcggatacgccaacggatacacgctccgatatgcatcccgtacgtatctgacattttctcgattttcaaacaaatgaaagaattacggatactttgctgattcgtattgatacgcccatattttcacatgactcactcccggtctccccgcatcgtctttgccgtcgccatcgtcgggcgcagcaccgccgtctgtgcagccgcaacgcctccttcgccggagggcactgcgcctccaaccccaccgtcccgcggcgcagccggcgcatatcctcctccgccgctggcgtcaggggctaggggatgctggggccgccgtccccagaacaacgcctccgcgcgcagccgtctatgcggtccgcggccagcaccacagtagcgcctccacctccgagcagtaggcacaagaccaccaagcagtttttcctttgttcccctgtgaggctgtgagtaaatcactgcatgtttgtgtttgggtgtcggttgaactaccattttagagcaagtttaatattatcgcccactactagctctaaatcatctatagccaatgtaataatcaattcatacaatagttgcttactacattattaatacatgccccacatgtcatacacacattacgtcttggagtccgtgctgcagctggctacagatctgtagcccgctgctcttctctctctttctttatctctttaaaatatgtttatagctggcttatagcctgctattgtacctgctcttagtgaaatccggtggttggttggtggcttagtgctggcgtgctgctacttgtgtactccctccgtaaaaaaaatgacaaaccctgagttttcgtgtccaacataaatattaatttttttacgattaatatttttattgttattatatgataaaacataaatagtactttatgtgtgactaactttttttaattttctcataaatttttcaaataagacggacggtcaaacgttggacacggatttctacggctgcacttattttgagatggaggtagtattaaaatcaaaattattatttcttgtgttgtcaactcgtcacccttctccgcgtgcacgctttcaaattgctaaatgatatgttttttcttaaaaaaattatatgaaagttgctttaaaaatcatattgatttaaaaatcatattgatttatttttaaaagctaatacttaactaattgtgtgttaatgaaacaatccgttttttatatggagttctcaccttcacctcccgaatatagcctaatagattgcttttcagtgaaactacgtgcacatatgcatgcataaacgggttaccggcaacccgtaaaaatgattttttttttggaaaaagtataaattaccccccccaactatcgaggtcgactgaattatacccccgaacttgaaaacagacattctacaccccgaactattgaaaccggacaaataacccccgactcaatttggagcggttttggatccacgtggcagtccaatcagcactttttaaataaaaaaaatcagtgggccccttttgtcagttctccaccactctctatctctctctactctatcccagtctctccccctctctctctctcttctcacctgcacggcggcggccgcgcgagggcgggagcaggcggcgctgccggcggcggagggcggctgagacggaggcggagtgggttgccggcagcttcgctgtggtgtgggctagcaaccacctcctcggcgacggccacatcgcggtggtgctcctccagtcgtggtcggagttcgcgcgcacggggacgttcgccggaggcctgaaccttgactggtcggtgctgagccgtccccactccccgccgaggtacagcgccgccgtcgacgggatgttcgtgccgtgggaccacgagcacgagttgaacccgctcacggcgagccgcggaggcgagcttcgtcgagcggctctactacgtcgaggccgctgacatcgccaggctgcgcgaggaggcgcgcgcagcgcgcgacgagcggctctactctttcttgttcgtagctaattttgctttcagtttttttggcggaggattttgggttggaaagacaaggtcgggatctcttttaaagtttgtttttcttttcttttccctcttgatcggtggatcgatgtactatcagtatcagtaatcagccatgccatgccatgttttgtcgagctcacaagattggaatctcccgctagggaatcaattttcaactgtaatttgccccgctttctgcggtgagatttgcaggtgcgcaatatgtaattcaccattttcatcgctcatcgctctcttgctcatttcacccggttgtccgatgcaaagtggcaaagcatagtacaggagataaacatgtctggcattgaaggggcgcccacagccgccggcgcgcggggctcggggtggtgggaggaggggacggcggagggcagtgcttggggcggcgaaggggcgcccacagccaccggcgcgcggcgcgttgaggcagcggaggggatgcttgcagccagcggtgctcagggaggtggagggggcagcgggcggagctccggcggcggaggaagcgcccgcagccatcgccgcgcggctcgtcgaggcgctggagccgtccgctgccgtcggcgctcgagccgcaaccgccatgatttgagagagagaggaaagggaaagagagagtggagagatatctgacaggtgggtcccttcgttttttaattaaaaaattgctgactggaccgtcacgtagaccaaaaccacttggaaaactgctcgggaggggggtttcatccggtatcgatagttgagggtgaaaaacgtccggttttaatatttagggggtaattcatactcaaccaatagttcaggggtagttcgtactttttccttcttttttttaaccagtgtatgaactgagtgagtaactgaatgtgccaaattcaccttgtttgaaacattgtttatggcaaggttactgaaattttgaattggaacattaatgaacagtaaacatttactaattacagattaattaggcttaataaatttatctcgtggtttaccgacgaattctgtaatcagtttttttattagtgttcgaacaccccaatataatacccgatgtgacacgccaaacctttatgccctagatctaaacacccccctgatcagcacttacctgcagatgtagatgattttacagcggtcgtcctcggtgatggaggccggcaggtttgggtacgacgcgtgcgtgctcatcagccgcggcgttggcgcggcgtcgagcttggcctcctcctcgtccaagtagatcccctccaggaacgggacgcactcgtgtgggttgagccggagcagcgggtgccggccatcaccgccggcggcggcgggcgggtacacgccgcgcgccgccgtggcgaaggccagggccttgagccacgtggtgccgcacttgggcaggctcgccaggaggacgtcgccggcgcgcggctcgaagcggcgctggagcgccacgatcccggggacccacgtacgcctcccggaaccaggcgccctggtactcgcgccaccgctgctgcggcgggtacagcctgctcgggagcgccgccacgacgtcgccgtactcctccgcaaccggtcgccgtgcgacggcgacggcggcgatgtccttgaacgggacggggcctgcggcggcgctggtcggctgcatgtctgaattctgatcgaacgaaacggccggggagacggtggagacgagccggccggcacatgagtcattatatagcgtggcagccagccaggcggtcactgatcttctacacttctattttaccaagggcttgtttagttgacaaaaaaaattgtccctgaacatcacgtcggatttatgaacacacatttaaagtattaaatatggtctaataacaaaataaattacagattccgccaggaaactgcgagacgaatttattaaacctaattaatccatcattagcacatatttattgtagcaccatattgtcaaatcatgacgcaattaggcttaaaagatttgtctcgcaatttacatacaatctgtgtaattggttttttcctacatttaatactcgatgcatgtatccaaacattcgatgtaacaacgtaaaaatttttattttgagaactaaacatggcctaagataaaactttcttaattcaccgtatctataccctataattaaccaactcactcttacatgttacatacttcatccatcaaatccaacactctgtattcgtctacatccgatcgaacggttgagattacctcccccatcacccactaagccactactcatcactctgccctgatcccacgcaccctccccctatgcaaccgctctcctttcctcgtcgcatatttcacgccgccctcctcgcatctcctctctcagcgccacaatcaccgggagcgttccatcctcctccgccttcttagccaccgcgctacggaggcgacgcccttcaaccctctgccactcccctcgccctcctccgcgccgtctgcgccgccgaggccccgacgatctttgcctcgacgaccggctctgtgccaccactcctcgcgatcccctctcatcctccttcgcaccactattgatctctgccgagcgctgctgttccctccgccggaagctccaccgctgccccacgccgagacatcgacgcccgcctcgctaatcccgtcctcccgcatatttttagatagacccataatcccggccccgcaaaggaagtcgtgtgaaaaacatcacctttccccgccccccacaggggacccggcgggtgaccggggcctgcatcatccggatggagctaatacttcataaaaatattgcaatacacttaataatattacgataaaattttaatagcccccggttgtgtgggttggttgaaggaaggaaaggaattatggttgaggagaactagggtgttgagcttttatatgtcaattttgaatgggtttattggctctacattattgcaatgagctacttttagataagtaactcacatcggtggcccctccaagtcacgcgcggattaattccaatccccgcccctatccccgaaagtttgcggggccctgtccccactcacccgcgggtgagaattctcctcggtccccaccggatcccggcctcaacggagaaattaccaaccctaccaaacatcacacaaaattgagcagatcatctcccattcagactcatccacccaaccaaacacaccaagttaggacttcggatcgttttgatgggcctcgatctcggcccatttaggttagccagcctaaccggcccgtatcatgcttcggtttcagcccgtttcgcacggggaactcacgcgacgcaaccgccgccgtcctcctccccgcgccaaagcccaacgccggtgagggttccggttccccaactgcggcggcggcggtccgggcgctcccggagcggagcggagcccccgatggcggagggggagagggagctccatgtccgggccctcgacgggcggtccaccgtcgtcgcgctcgccgccgccgcctccgtgcgggatctcaaggccgcgctccggagctccttccctcccgcgcaggtctcccccagcttccacctcttcctcaaggtacgcccgctcgcttctcctttgcgtgcgagcttgatcgtgctggtggatggatgcggcctgcgggatgccgtgtgtttcgtctcgcttcacgctcgcggcattgaggggtttcgatagggtttagggtggtttcaccatttatgttcatagtaatggagctccgaaatgtgctaaccactagtgttctcgtgatgaagggcaccaaattgcgcgtggaggccgagattggcactcttgctgttggtgagggggaatttattgtccttgttccattcgcaaggaagtcgcagcagtgttctccggtggcaatggcagaacaagggcagattactgaatcaccaagatcatcgcaagtgtcaactggggcgaattcagctcggagaggcattacggataacctctcatcaatcccaagcagcccacatgctgaaacggcgtccagatatttttcgagtggggctaattcagcttggcaagaaattatggatgatctttcatcgatctctagcagcccacaggatgattctgcatccaaaaacttttgtgcccaaagcactatcccttgttctgggaattctgtagaggatgtgtcaacagatcaaaggttacctactgggaattcaaataaaaggaggaagccatgtaaggaaaatggaaatgcattcaacgaaatgcctacctctggagcgaacagtgctgctggccagcctagcatagataagaaaagtagcattgccagatctgctgcaacatcttgccatgtaggtcactctgccgttatatattcccctgccaatttcactttttgactttcacattcatagaagaaatccaaattgcagcctttgtgttgcactgttccttgagggaggaggcattaaccacaacatatattacatgtttgtttgttagattgctttgagtaatacgatgaaaattgcagggcacgtgccatttagggcctgctgaaatggttgaccatctgaaacaaggacttggaaaggagggacaggtattcactcaatgaacttctggaactaacaaggccagtaaaaccatagtatttatgttgttgggattatattttcagattgtacatattgaagagataccatgtcgagcggcatcttttgcagaacttcctaatcatctttcagaggctacgagggaagcattaaaaagtattggagtatctaggttgtacagccaccaggtattatagggtgtgccatctatttggtgcattcagttgtagaagctcaccgattatgttgatcatttacttgattgcagtctcgagctatacactcttccattgctggaaggcatgttgccattgcaacatcaacatctagtggaaagtctctgtgctataacattccagtccttgaatctctctgtcaaaacctgatggcatgtgctttgtatatatttccaacaaaggtctagacaggaactttctgttttaggcttgattgtctgaaatcgggcagaaattcatctgtttgttgctttgcaggctctagctcaagatcagctaaggagtttactcgagatgaagaatgcacttcacactgatattgatgttaacatatatgatggtgatactcctagagaagaccgtacgtggatcagagataatgcccgtctggtaaacatgtgcttctgaagatatataattataaacagttcgtttcttttttaaaaagtgcatttgaactcaccatctacctccttctcagttaattaccaatccagatatgctgcacatgtcaattttgccatgccatggtcaattccaaaggattttgtccaatctcaggtggaacttattggccttttgtagttttgttttcttgatagctaatttcatcatctgtggtcaattatcttttaacttttagatgaatgcttattatctccataaagagtttccatttctgcaatactatactcaggtatattgtcattgatgaagcacattcatacaagggagcatttggctgccatactgcacttattcttagaagattgaagcgcatttgttcaaacagtatgtataccatgttgaaccagttcttttaattgttagttgacatgatgcttatatatgctatataccataactgtgaattttcttgtttttgcaaatgtgttagtgttacttcagttttcttctcaattaccaatcatcagctacctaaaatctagtaatccctgcaatttctaacttctgagttatatcttggcaaatttatggaatataagaagtatgatctactgatgcaaattaacatataattcttaaaagcatttgcttgttcgatttgcagtttatggcagtcatcctactttcatattttgtacggctacttcagcaaacccgcgtgagcatgtgatggtaggcttgatcttctctttatgttagcttagaaaaaatggttgcacacaagaaaaaaaaaaccagctgttgttaactactgctctaaagcacaagctatcctccaaatgtgtttcttttttctgaagagaaatattattatcactgttgcttatgttttcgtgcacatactctttcgagaatattggccgaacaacaagcatttttccttttgcaaaattctgttaatcacaggagctagccaaactggataatgtagagctgatcgagaatgatggaagtccttgtggttttaaatacttcctcttgtggaatcccccgctacatatgacgaaggaggggagttcaaaagatagcttattaactagacgctcaaggtattgacactttcttttcccttgaattaagctacttatttattttcattgtatttttacttttcaaatttgcaaagttccagatgattttattatagctcaataactgttgtctttcagatatacgcaaatttgttcactggccatcgatgcaggaattctaagaagttgtcctattaaatagtttcttggcaggatgatttgatagtcaagatagagaatacttctttgccaacctgaatttgaaaattttgggccaggggccatactgctttgccaacttcatctctgtactgtcctgtgatccttgagtggcatgttaatttccaacactcaacaacggatccttttatttgatgagatacagtaattgttgtggacttgaaagcaaaagttatgagttcatcacagtacaaagggacgatgtttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgacctcatttagaatttcatcggtgctctcgaactgtatggattcacacaaactgcaatgtatattaccagcttttgttttcttctaaattccatctagtagaatatatatcatctgaatgctgtagacatatcaaagatggtaatgttactaccttctctacttaaaaagaactaagaacttctgttactaatgttacagtgtacatatgcaaatcaagctttcgttttgtcctcttgaagagtatgctgtttgttatgtgaggggtggtgcattgaagcgcttcccacaaaataaagttgtgtactagccagaaactgactcattttctgataaattgagaaaattctaccttctgatatttgcttgctgaatctgaacattttacggttcttcatgtgttgactgttttgttcctgttcatttgaaaacaaattatttcaggacaggagaaaaattgaggccaacctttttcagggaaaacttcttggtgttgctgccaccaatgctcttgaactagggattgatgttggccatatcgatgcaacattgcatcttggatttcctgggagtattgctaggtaagtgagaggtggtctctccaatggatcctatatttctgtctgaagccctactaagtcatagaaacaatttaattttagcctgtggcagcaagctggaagatctggaagaagagcaaaacaatcattagccatttatgttgcctttgagggccctttagatcagtatttcatgaaattcccacataaactatttggcaagccaattgagcattgccaagtcgattcacataatcagaaggtttgtacatcagattttgttggtaaatttaaatgcataaggatctaaaagcttccttcttaatttgaacatttattacagcttttggaacagcatcttgcttgtgctgcttatgaacatccattgtgtgtgcaatatgatgcggattacttttgttctagcctgaacagtgtaatgatggccctgaaagacaaaggctgtctcataaacaatccctctggacctttctcatcaagcatgtggagttatgttggacctgaggtttgttcctttttatttgttatctttacaatacaactcttttggttattatgcaagaagtattttggttttctgcagaaaagaccttcacaggcggtgagcatacgggcaattgagcatgacaaatacagagtaatagacaagttaaataaccggttactggaagaaattgaggaaagtaaggcctttttccaggtaccatgttctaaactgttcctcaactcaaacgtgtgatgaactgtcatacttgttggatctttgaacatactctaatgcccgtaaagagatagataaatttatgagtttgttgaagaaagtcataaaatttatgaactcataagcactatatactgtattgttacctaattgatatactaattatagactgcatctgccactgtgtgttttcatattggtaacttgctatctgaattttttaagcattttcttcattcttaggtgtatgatggagctgtatacatgcatcagggtgtcaattacttagttgaggaacttgatttgtcatcaaggacagcattctgtaggaaagctgatttgaagtattacacaaaaacacgagactacacagacatcaatgtccttggaggagagtttgtaagtattcaaaaggattgtgcattagcctcatatacattctgcttataatcgtctatcattataatattaatccctgccaaattttattattagcaccatttttttgtttaaatctcttctatcctgattttctaggccttatcctgctcattaaatctgaggattattcatctagtctgtcttagcactaacatcttcttttccatgccatgcttattttgactttttaaaactgttttttgagttgttttaactcaatctagttttattcagcctattttttcatctttgttgtacgttttccctacattttttagaagcccatactctcttgaactaatgaaacaggataggacaaatgtttatggtactcctaccacagtaataggtctactaaaatgttttaccatcatttagtcaagaaactttccttgcctgacatgtgcatgagtgatttccatgctgatatttaattaccaatgatctcttctactctaatacatcttgaaggctcatcttccaccaagtatgtgtaaaactaacggggtgaagacaaccgcccaagcaaatgattgcaaagtgactactaaatggtttggtttttatcgcatatggaaatcaaacaacaaaatatctgatagcatagagcttaacctgcctccatattccttcaattcccaggtttgtatctaaaatatatttgtgtgaaccttatcaatatcatggtgcattgccgtccatgattgataccctcatttttcttctgcgatgcctaactaggctgtttgggtgcgaatcccgcactcggtgaaaactaatgtcgaggaaaggaaactacagtttcgaggtggctcgcatgctgcttcacatgctctgctgaacatagtgcctctgtaggtttttcagttttagctgcatcataataaataatcattaatgcagatagttgaatgtgcatacatttgtgcaggcatatgacgtgtaatgcttctgacctaggaacagaatgtgcaaatcctcatgaaacccgtggtattccagacagaattctgttatacgataaacaccctggtggtatcggcatagcattgcaggtaaaatgtttgatgatgtgtagcatacccaggaacctagcgcggttgtaaatatttaccagcaatgctacctctgaactatattatctcgtttatgactatgagatgatattgttcgttgattcggtaaaggttgaagtctagattttcatttatttaatggtgtagatcaaatcactctttggggaactactacttgctgctttagaacttgtttcagaatgcaactgtactagttcagccggctgtccaaattgtatccaagtaagttccaatgctgtactaaactcaactgttgatggaaaaaaacatcttcaagatgataagtttctctcttttttttcagacactaacatgcggtgaatataatgaggttttggacaaggaggcagcaattttgattttgaaggttaataatctgtgcttgctaaagttacctaaccatcttccatcctacacctttcaacgtaaaattcgcttgctctaagatatatattcatgtgcagggagtaattgaatatgaaagatcatattttgaaaaagaagatggttccgaccaaggagtgagatgaggttttaacttttgacgtcttcgtgaagacgagtgaatttggttgacacaggagccatattaatattttcttcacaaggctttctccattggaaatggtagaattgtttggttatcatacggaaatgtagctctaaccagagttcccattcaattataaattatttctggttcaattgtatattttattttgttgccatcctgtaaccaccacctctgtttatcctgaaccaggtcatgggatccccaaattgcctgccacctgcgatccccaagcttctgtgaagaaatatgtcgaaagatttgaacctgtgattaagatatctgcagttttcccttctgatgagatggaagaaaccatcaatttctgctgcgggtactgcaagaaccacatcatcacgtgtaatctaaacaagcctttgaagagttggttgcaatgtttttataagttccatgtttattatctggttcttttaatctctttttgggaaatctgggtgttataatctaggagattaaccaaccacagcactaaaattcaaacttctcagaaggataatacgttgattgctgattaatgaaggatggcgaaaaaccatgtcatagagcgggtggacctgttgcttcatgtggtttctgcacggcagtgcccggcaagaaatgggcctgttcggttgtcgtactgctgcagctgttgtcgatgctgtagagattggtagcggctggctgtattgccgccacatttaggcctatcgggcaggcccaatatatactagccgtttaatagcaagatggttctggcatcaaagtttgtaaacggacgatgtaatgggttaccactaaataaagcaaggttgaagcatgaacataaaacaaatattgaagcttagtattcttagtttactacctttcatttttgttttgttgtattcctcaattacgaggcttcaagtttaggtaatatttggctgtatgtatagaggccagatttctatatattatgatcgcaaacaatgttaagagaattgttttagttggggtgcaccacgcttaggctgtagcgcaatgcttaaatgacactagaggacgctccctctcaaaaaaaaaaaaccgaagtaagcatatgctctctccgtcttaaaaaaaacctaacctattataggttaggtttttttagacggagggagtagctcacatgtaccgataagaacatatgctccctctttctaaaagtctaaatcctatttatttttcaccaaaaccaagtgtagttaactcattcatcatgtgataaaaccaatgaacatgcaaacaataaatactaaaatgacttcttggtttccgataaaaaatttaatatagcacagtgactacagataggacttagacttttggaaaaaccaacaaatgaaataggtcttagacttttaattaaaaggaggagtactacatttgatcttagtgaaaaggccgaaaaagatatgagtggtaccgtgtaaccacacggcctcttgtagtgtgcccctccctgcttgaatcgtcgatgtggtactactcatctccgcattgtccatggatgcgatacgcgatacatatacgacccgtgtgtgacgcgtgacgatgcgatgcacctcctctggtttttcctttttgtttcttccttgggttcctggctacagggaactaggaattttttctgattccaaacgaccggccttgccaggacaggctaggctcttggatccaaacgcaccctaagggaagctcgatggcatatgccactaccttaatttgcatgcagcttttcgcggttcttcgttcgttgacctccatcgatcgaggcgcgacgtgttttagttcggtcgagtaaatatcatcggtcggccactgataatatggatgcatgaatgcagccacccagacgtatccgttgcatttgcatttgcatgcatccatccaagtttggctggcctagctagctctccacatacgcattcgatcattttgcatattgttcgtgcaaccactgcatatgcaccgagcatttcatttgatttgatcgatcgatcgatgtggtgcgctgcccattttgccgtatgcgatcgagtattatatgcttcgtccaccacccaggccgtgatcgagtgatacgaccgctggcgctacctagctagatgcaatcacacaactgcaagctaatactccctccattctagctagttccatcatcatatttcaaaaaaccgaattttcaaatttgaacgttacattcgtagtcggcaagccgttgcatctcgatcgatctcgtccgacgtgctggccgtttcaattcgcacgcgaaatgggagcactccgcgcgcagaagcctgttgcatatgcatgcgaaattaatagcatttatagttgactacaagatagttggttctgccgcgatcgtcatgcatgcatgctggaccgttgacctgggagatgatatatatgtacatttgttatccttggtctttgcatcaagtcaaaatatgatgatcaaacttaaatacactagaagataaaaacgagtgaaaacggcatcatgtctataaaagtagttcttggttgattgggaattttccgtatgtactaatctactagttatttagggacaatatcaatatgacaccgatagatttttttttaaaaaaaaataaagttagcattcctcagtttagaaaaatactacatgacggtataccgttaggacagtataatacctctgagatatcggccaatataccccgttcagacgggataatacgtctgaggtatcgctgatacttgataggtatcggctgatacccaaatattggacaatatttctgaggtatcacgttcaaacgggatatcatcacgtagcattttccgagttacaagcctttgcacaattcgcctctgctctcgataaaacaagtcagaatcaattggcaaggggtcgacgattacgagaattgtttagaatcggagatggtactacttttgcgaaacgacagtcggttggtggagaatttcctccggtgttccattacgtgcaagctaacgttatcgttggctggatgaattgagcactagctagcaccaggctgctatatagcaccggagcagctggtgtttttctgcgctggatcgaggccgtgcagtggtcaaccaactcaaaggcaccggccactgatctatagtacttactttgttgtgctcctttgctactagcatctgccactgctgatgatcgatgcagttatctagctagctagtcctctcttgaatatctcgtcaaattacactgttacagaaggctgaaaatgatatcgatcgacgtcgtcgtcgccatcaaaatggtctgccgtgtactgttcatatatatagtggttgacctgtccatttatttttcttatggtaaaccgcaacccccttaattttcgggggaaaagatatacgtgtacaaagaaaatttgcaaatgttttagatgttgatgtatcacacactgtaagtaaaatcctgattttctttattacactttcaactaactaaatcgaactgtcaagatctttgtttgcaagaaattgttcaagtatatatgtatatcacttctcttaattttctccctggatcaactcaagcatgcttgcttgtagttgtagaaagtctcggatttttcctttgctttgtacttcttctacctctaaatacaaagaattttaattataattacaaatatgcacatgtccagattcaaaaaaaaggtgggcaagcgaaaattgctcttgcaagagcaacatcaagatataggtaggtggtggcagtcaggtaaaggtaggggtgaaaacattatgaaaatttcccgaccgtaccgatacctttcctgtaaataatacaataataatatttttatcgactattacagtttctaaaatttagtttttctaacttctatcaatgttgcgttgaaatcaacactaaatagtaaaattcataaatacatatatttcttgaccgtttcggacttctcgaaaaaaaataatattgtttccgaccgttttcgtccataggtagaagcccttgctcagatctgactcaaaacaagccccagatgctgccagtacaagcaagcaagcactattacatacaggtactgtacctgtcatccaattagaccggggagatctttccctggccaatggaatccagcctcacttgaccctgcccccaaaagcccagtggaagaaacttccacagtacacatatcacacacactagtgctcactcaattcaggcttcatccatccttatcctccctgcctttttgcctggccctttcctgctgcctacttgtctgtgactgatgaaagctaagtgcaactaactacttactactctatacttacttgctgataagctgattcatgccatgctatgacagggaggatatacagcaacaagaaaagcaaagaaaacatactgcatggtgacacctagcttgagaattatatatataagtgcttaattaagcagcattaaacttttatgttagcactgcataaagtatatgtagagggtcaggtggtgactgatcacagatcagcaatttggatgtcatgtcattgcttgcgcattaaggatgtgcatgcaggtagcctctagcctctctggatattttattttatgctctcactagtcactaatactgtatattagcagtagaagatagtactaggtagtaaaatttatttattcattttccaaaggttatctgtgccgacacctgagatcacacagccgacactctgaattccagaggaatccaaaacagcatatatatagcaccaatcaagcattctactaatatcaattataaccaagcaaaaaaacaaaattgggagaaataatgatggagaaaaaaaaagcatccatcgtctgtttggtcaccacagaacatcatggatacctactcatcagtaccatgccaaaataaactgcaccatcaagaaaagtcacccaaattaactaattaagcttgtttaatcatcttagcagcccaaacaaatgaaccatgggatcattattaggagaatttaagaagaagtcaatggaagcgaattagtagagaatttagccatataattgactcattttagcacattgagaaaaggaaagataaaagagagagaaagaaaggtaaaaaaaaagagtgaaaaaacagagattaagattaattaacccgacatgtcctctgattaattaattaccaaaacaccaaccaagaaagcaagctcatagcctgtcttgccggccgtatcccgacgacggggagggcccgccgccgccgccgccgccatggccatacgcacctttccctcccatcaccatctggtggtggtggtggtggggcggctgcggctgcgcgtacccagctgacgacgccggcggcgagccgtacataggctgtcccatcatcatgatcatgccgccgccgccgccgtacatgccgtatccgccattgttccgggaagcatcctggtggtggtgcgagccggagccggagccggagccgccggaggaggcggcgccaccgccgccgctgccggcggcgccgatggccttctcgccctcgagctcgcggaacttgtggaggtagagcttgagcgggtcgatgtagtcctcgaagccgagcgtggtcatcgcccagaggaggtcgtcgccgttgatggtcttgcgcttctcccgctggcacttgtcggaggcctcgccggtgatgaaggagatgaactccgagacgcactcctgcaccgtctccttggcgtccttgctgatcttggcgttcgccgggagcgccctcttcatgatcctgctcacgttcgcgatcggcaggaacctgtcctgctccctcgccgacgcgtactcccccgcgttgctcggcccccctgactcgttgtccgaatccggcatcgcaacctcgatctcctcgatcgaagcagtcgaagcgaagcgaggaggaagacgaagaggagaggagggcgcgggggatgcagtgggatgaatcgtggggataagaacgcatcggggagagcgacgtggcagaagcgaagccgtttgtttttgtcgataagcggtgtggg

SEQ ID NO: 64508 - DNA, 66687 bp, Oryza sativa
ccgtgccacgctggatacgtcgcggccgtccgttagccacgttggatggcctacgtggtggggcgggggtgctgacgtggcctgggtttatataggtaaattaaggtcatggagccgtcttggcccggttttgttttggtgtgaggaaggagatggttgtcgtgttttggtgcctgcactgacacacctttccagtcacatctcaatcaaaattaaggaagggaatttatattggtttaatgtgattattctccatggcatttgtttctttttttttcttgtcagaaaaaaaatcttatatgagatgaccttatgttagttagtactcctaccgtgttcaacatttaaccatcgttttattttaaaaaaattaaaaaatcatgtataaaaatactaatcataaagaaatttcaaataaaataaacagtcaaacgttaaatatagaaatccataaccacacttaaaatgggacgaaggggataatgtattatagttttcaatgaacattttgctaaggcaataatagtgtacatttgctatttactcctaatcaaaaaatggtaaacgttccatattgttttcttaatttaattatagatgaaaattcaaaagacttttggacgatttcattctttttctccggttcttctaagtttatcaacttttagataactaccattctcaaactacgatttcttcacaagctttccgcgtcatcattgttttagatttcttgaagttactttaggtctctggcatataatatttgattcatctctacaaacaattatacatgatacgtccaataataacgtgacctaagtccctcctagacaatttcagatgttgaataaatacattatgtcccaaaaaaaccatgtttagtcatcacttatatatttaatagaagtatggaattcttatattaaatctgatcatcgataattttttaaaatatatatgttaaaagcaatggattaagatcctctgcagtcgactgcaccgcgcttttattattgacatgcggtgcagtcgactgcagagcatcctgatccgtaaacagccacatcggtagatataacatcactgggtctagataggagtaaaaaattgtgatgggtgacactaagttaagcacatggacagcgcaatcagccaacaaggttcactatcttcagatattggcgaattcagcatgtctccatccgagcccttcacacgtcagccgggtcgtcttaggccactaattaagcaaaccttagatccaaaaataataaccttggcctttcgccactaactaccaaccactctgaaaagaagccttctcgagtgatgcgaaagcagaaatcacgttgccaaagcacaaggtcaattaggctgtctccaatgggcagctcttagctagctcatagaggtttttaagcgatgaacaggatgcgctagctcttcttcaagcgctaactcgcacgctcaccaaggcggtgccctctcacaggcatgctcgcccaggcagtggccggcactgtgccgagcgcgtatgagctagcagccggctcataccgctggtgaaggccttggctcgcataagtactactgacaagtggcatcgagtcaagttcccaagtgccctctcttttgtaatgccttttttttttaagtagtatctagttttatttttttgagaaaatttttcttatctagttgtagaaaaaaattaagtaatatatactctctgatcttttttaaactcctcttttaaggtgcttgctccactagacctacatgacatggcatttatacctacaacattgtgcaacttcatcagaattttttagataatggacttcatcagacttgaactctgtctggttgttttcttagataaggaaggtgccagatcctcaatagagttttttgttttctttgcatatgaaaaacatggatgcataaattgctgaaatttgtggctttacattaactgaatatgtcatgaagcaaaaggtgacattattgcagtgatgctgatgcccatgatctacctagttaatgagaagaaaagggattaagagatgcctgccttgtgtataggggttacacttaacaatggcctgtccttgatcgatacatataggagctgattgggatgtgaaactgacactgttctattcgttaattgtcgccatctttgctcttaatcttcgagttcaagatctctgacggtgtttctttctctgtagattacagtgccatttcgaagctcatgcacatgttaattgttgttattaagctacagctagcttgatcttattccgatcatacagataacgagtggtcaagatgcgatgctcctgtctgtgcaagaagaacttgtactgcaccaatttgcagttgatctgtcagttcttcagatcttgggaaccattcatgcttagccacatttgagtcaatgggaatgttgcttaagtagaatctgtactctgttgctgcaaaatggattcgagcgagattgatgctatatatgtgggcccacatgacagcagctacgtgtccaaaggtgacagaggtggcatatgcaccaggaatctcctccaacaacggcacccatatctgtcatgaggattacgatcaaaaacagaatattgagtggctaagggttaaggtctagtaaccacataactccttttcaatagttcatttgttgttctacatatcgagggctcctttgattgaaaagatgaaggaataaaaaaagacactgtgttttgataggaaaggatcagaagtgtaaaacagagattacaaaacacacaaaaaaaacatgaatgatcatttaaatcaaccgtagaaaaaacagagtaatcatatgaaagagatagacccaaaaagattttttttctaataggttgaataatttgttaattttcctctaaaacccctatagaattgaccattccatgagaattcaaagaaaagggtaattaaggtgcgctctgttgttttaaaggcattccttcaacatttccttctaggataaaatccttgaagtttcctatatatttcttacaaatgaaaggggacctaaatagtctaaaggtttatccattctatgccctgtagatcattgtgtcatttaatagtgccttgatcagtcaatagttgactgaaaaatcagaatctttttcaccctggaaagagggaaaatatgcatgcacatcctccatccctaatacaactatttctagcatttaaaatttctcataaaatataaatattttagaatattaattctcacccctgctcgagtattgtgttactataacttaaccaccctcctgttgcagtatattatttttttccctttatgatcagaattccttatattttagaactgatgaagattttccccacttgttggatggtagagggtcatggtcaggctagctagtagtgttaccacacatgattgtgaaccttgtggttaattaacacaggttaatttccctatcaaactggctgtttttgctggctgatattttctgagactcaccatggactgactgactgactggctgattgatttttgttttagataataatgggactgactgattgattagtgagttaattaattggtgcttggatgtgtttcatgtgtgaggtgactgtgccaatttgacaacttgagatactacggcgatcgatcgacgtcgtgcgggtgacggtggcggccggctgccggacgaccggtgtgaggccgtgcgtgcgtggccggcgccggcggattaatggcggtgctgtgcgacgacgccggccggccggccggttgaccggtgcaaccggcaactgcagccatgcaatgatgccactgcattctttgcaagaaaacgacttgcattatagttgatgtttggggttgggacgttgggttgacttgcttttcgatggatgtgataatatatttttttttttgggtgacgatgtagcgatagcttcaaccttaaatatcccaaatgaagtcaactttatcgtgcaaaaataaaaacgcaattctcatgagaattgaatttcagtaatgtagtagtacgtattttagctgatctagcccttttcatccatgttcaacaattgacctgatactctgataggtatatacagtgtcctgcttctgtggtcttgtacattttccatccgattgtgatggcccatccgatcaacggctagcgacgagccgacgaccacctcacaaaagatttttccagtatcaggccacacagccacacaggggctatagctcctagacctgatctgtgttaggggaaccaaacattattaaatcgttagtttcttaagtggagtggaagaatttgctctagaaaaatatatacgaaggatgaagctaatttttttcaagctacacaactctagcttgggagtactccctccgtcctataatataaaaaatttaatattttatttacactgtttgaccactcgtattattaaaaaaaattgtgcaaatataaaaaacaaaaaattatgcttaaagtactttggataataaagtaagtaaaaaaataaataataattctaaaatttttttgaataaaacgaatggtcaaacaatacaagtaaaatatcaaaatcccttatattagaggacggatggagtagtagatttggagccctaccaaacatgtctcccttcattctaaaaaaaatacaatcccaatattaagaaaaagacaaattagtacaaaagaaaatgtcctatatacccctcattaactcagagcatgttggaaataggagtgtgtttagggtaagatagggaaattttgaatgaggagagcggttggaggaaaaaaaagaaagagtacttttttgacaaaatttatatgtttggattgcattctttttaggataaataagtattttaagaaataaactttaataaatatcttagaataagttgtgagaaatcatactttcaataagttgtgagcaaataatatgcaacagttatttggtaaaaaaaaagcttaaaaaactagggcagaatgaaaagaactttatacgatttgacaaatgtagtactacagtaggtctatatattcgggctgacttctttcattggtttttccaactcacctccctcttttcccatgcacgtttttcaaactgataaacagtgcatgttttgcaaaaaagtttctatacgaaagttgtttaaaataattatattcatccagttttgaaaaaaaaaagctatcgcttaattaatcccgcgctaatggaccgctccatttccagtgagcaggatatgggttccaaacccaaatcaacgaagacagcctcaaaagtcctgctttctaaagaagcccctatattgccactctctctacctctctgatcagcgtagcatatatttttcctagaaaaacatctactccctcttttttataaaaaacctaatcttagatttgaatatagatatactcttgtccagatttaaattcagaattagatttttttatgggacggaagaagtaccttacaagatgtagtgacggccatctgacgtacgtctctttcacgcccggccgatcgatggaggcgtggtgccctaccaagttggaaggctgaaaaacaaaaggataaaaggataaataaacagagagctttatcgaagacggcttaatgatactaataatcgataagtaatggagcccaacgggcactggaccgaccaaaatagcgatgctcacacgactcgttgccgtcgccaatcatcataacagtgacaagggcacctccttcggcctcatatccttcgctccgccattggaatggtgcagatcagagatattcagagctaattaagctcatcattgccaaaattttgctcacctgccattatacccctattggtgtgataaaaaaaaagaagagagagaagaaagacgttaatttggtcgtgttcgttgtaccaagacgattcacgtgaaaaaagtttaagctggtgagaaaagacgggcgatgactgtcgcgctctgtgaacacatgggtttaggccatgtagaaatcatcatcgtgcatcatggcgtgtgcatcgatcgtttgctagctagctagctagtgcacgaattggcgccctgtcggctaccatgtgtaaagatatgtaggtgatggttgacttgcaaatttgcaatagatcctggcacttgcaagccacccaagcttggttggtggaagaccttttttttttgtttgaaactatatacttagggtgacctatctaaatggtacaattgtgaagaaatcgttttaattagtcaagtgtcggatcatcagtggagaggatgtgggcagtgggccccctttttttcttatcggaatgtagaattagttacttcctcctccgtttcataatgtaagtcattctagtatttctcatattcatattgatgttaatgcatctagatagatatatatgtctagattcattaacaacaatatgaatgtgagaaatgatagaatgacttacattgtgaaacggagggagtagcaaattgagaatgcttcattggtaattcctccgtttcagaatgtaagtcattctaatatttcccacattcatattgatgctaatgaatatatctaaattcattagcataaatatgaacgtgaaaaatgttagaatgacttacattgtgaaacggatgaagtggcactaaatgaacttaggatttagcaagtggtacagtccgatcattagtggaaaattttattagttaataattaagagtgcttcacaaaattaatactccctccggtttcataattcttgatgttttggataatgatatggtattcaaaatatatgtttgaccttatttttatattacaatatatacaataaataaatacatgtttacttttattatagaattttgaaagacaaatccatatgagttgttttctagattttttatatttaaagttattgatagttttgagtgaattatgttttgatgagatagtccaagggaagtactgtacttcagtgtactgttcaccactatcgcagcattatttatcgttcaaaagattagagatctttaaggcatttctacatcatgagagggctataacacaaatatcccccagcaatgggtcaactgaacttaatttgaaccgtccgattgagatccaaaggccagtgagcgttgagccctatcaatccaagccgtcaaatctcgatcgagtggcagtcgtacgggtttctccctctataccaaaattaagatacagtgaataattgagttcaaaaaaaagatacagtgaataatttaatagagagcgagagcaactccgacttcattgacgaaggtgctagagatgatggagaaggtgtaggatttagcagtcgagtttgcgactacaaattaaactttgtttgataatgttttagggagtaactatatttatggcgccatatttttcaccaaaaaatagtcggcatgtatttacattgtaagtccctaaattacatatgtaattttagtgtatttacaatgtaagtcctagaattacatagaattacatatgtaagtcctaaaattacatatgtaaatactaaaattacatactaattacatatgtaagtggtgtgtaagtgtggtgtaacttgtataagagaaggtatcagtgcaacgttcaacgctaatcaataaagaagattagggcttgctgcaatgccgccgtgcgtgaaaacatccaacgaccatcgaaaactcacggagcaatcgtacggctagcgacaccgactaaaatcagcccaaaaaaactggcgacatatttttagcaattccgatgttttattgttgttcctgctctgacagctggtcaactggtagatcggctgttgatcgactgactaattaacgggccatcatcatgcatgaaccggcaaggagcagtcgccagagaagaacaccaagtccgtcttggtcacaatcacctgaactattcgggggaggatggcatgattttttaagttatatcggtcttcttttgattttctaataattataagttgttcgcatcctaaccatacagaagttagaagttaggagtgatattagagtaattattatatcatcttgtaatcgtctgatatcgataaagctttctttatcttaaaaaataggggcagtgtatgagacatctctaatgttgagcaagaaattcagtgtgccaaaagaggtaagattcagagcagcaatgggaaatgggatggagcaaaattgactgaacaaaattgttgaacaaattcgccagaactcttgagggtttgggctagaaaccaatctgatgcaggcgcgaagcccaacaatttgacatggatctattatcctttttctggatcatatttgttccagcctcatttggacaagatgtggcagaagcccaacatatttcatccatgatccaaccagttcccagtgcaaacatcttcacagccttttggcccttattaattcggagcccacttcaggggaaaaaaaaaggaaatatccaccaagaaacctgcaattttctccaaataacaaaacaactagtgatttattaaacgggtttactatagatttctatcgacaaaaaaaagagaattctttttcattttttttgaccatcagatgtgcttgaagattcatgaagggcttgagagagaaaaatcatgtgaaaactcaaataggcttacatagggatggaaccccgatctactccattcgtctctaaatataagatattttggttggatgtgacatatcctaatacgacgaatctggacaggagctatgtcacatccaaccaaatttcttatatttagggacggagggagtattactcacaagtaggtttacatagggatggaagcctgatctcttattaacaagccgcacgcactagccaccagagccatcaaagtggttttagaagtggaaaaggtacaaattacatccttgaatcagaaaaccagacagcgcttaccttgaactttcaatacaggacgaattatcccccttgacataatcccgagcgattttattctatatggcatacgcatgacaatctagtcagtattttttttaaaaaaaatggtggagtccccttgtcatactctctcacctcctcccctccccctctctctccctctctctcacgcgcgtcatcgggcacacgcgtaggtcgagcggcggcgggcggttggcgcaaacggtatcgcacggggatgggtggtgagcggcagcccggacaaggaagcaagagctgtgaactccaagagggagccggagttgtgggaggccaccacgaagtacctgaactgcggcgtccggttagcctagacgacaagcaaccgccccctcggcgcgccaagtgtgattgtataatacaattacaatatgattgtatttggaagattttgaaaaggattttttaatagaaagtttaactttcaggtaatccctcattaaaatttaccatccttaagatggatcagcacatgttgttgtcgcttgaaagctgcaaatctccaaatttccagcgacacacgcacgtcgctgcggttggacgtcgcgggccacgcggtagaccgcgacaaacacttgccaccttctttgtgtcgccttatccctcgccacgccgtgcgcgtggcgcgcccggaaggcgagagacatggcggcgatggcggcggcggcggtgccgagcgacagaccaccgcttccgtggcgcgcgcggctgctcgtgggcgccgtctccgttctgcactcggcgtcgctccgccgcgacggcaccgtcaaccgcttcctcctgtcgctgttcgaccgcgtcgtgccgcccaacccggcccccgacgccgccggcgtggcgtcctcggaccatgccgtgtccgacgacctccgcgtcaggatgttctttccgggggcagctgccagggatggcggcggcgatcatctgccggtggtggtatacttccacggcggcggcttcgtgttccactccgtggcgtccgcgcagttcgacgcgctgtgccgtcgcttcgcctcggccatcccggcggtcgtcgcgtccgtcgacttccgcctcgcgcccgagcacggtttcccggcgccctacgacgacggcaaggcggcactccgctgggtcctcgccggcgccggtggcgccctcccgtcaccgcccgccaccgtcttcgtggcgggcgacagcgcgggcggcaacgtcgcccaccacgtcgtcgcccgcacgccgagcagcgtgtccgggctcatcgcgctgcagccgttcttcgccggcgagacgccgaccgcctccgagcagcggctccgcgacgcgccgttcgggtcgccggagcggatatcctggctgtggcgcgcgttcctcccacccggcgccacgcgggaccacgaggcggccaacgtgcccgccgcgctccggcgcgacgccgagcggcgccgcgcgttcccgccgaccatggtctgcgtcggcgggtgggacgcgcaccaggacaggcagcgcgactacgccgacgccctccgcgccgcgggcggcgccgaggaggtcgtcgtcgccgagttccccgacgccatccacgcgttctacatcttcgacgacctcgccgacagcaagaggctgctcaccgaagtcaccgccttcgtcaaccgccgccgcgccgccgccgccgcctcctagtgctccacattcttgaacttgcagtagccgacattacagtttgcttcactgtatcgctagctcgtctccactcacacaatttctcatttgatttgatttgatttgattcatacgatgaattcaacgagacgagctgttcatgatcgattctgtccgtgaaacgaagataacgagttgaggaggccacgtgaaagcattgatttttagactgattgccattggcaaatggcaagcatcatgtgaacgatttttctctcgtcaaaaccaatgaacgtgtagtggcgacaacgccatgaaaacccaaatgaaccaaaccaatcgtagttatccactctactctagtatttggacggaattggggctggatggtctacactgagtctgtgaatgaccatggttttgcagatggccagcaattcagcatggttctgacttgcaagtgcaatgtataaattgttcctctataatgctctctctacgcaattaaactgtttacacatgtcctttgattgctgttgactgatcagcaaccaaagtaatatcttttgttcaatgaatgtggtctacagaagtgttaattaggacacgtaatctttcttattaattcgatcgtctgtctggcatggcatcaatctcactggccacagtagtagcagcttgaagtctttgcagcatcaagcactactagaaaagaaggcaacatttattcacaacagaaaagcttctttagcttctgaacaatggtaaagaaggggtcccatcccaaaacatggcagcatttcattttcattttcatttccataggataggaatgttctgctttacgcttcccagaagccttctctctgataatcagagcttctagctagtgtagtgttagccgcaggtttttggtttagcttctgctttcttgctgtaccaggctgtgagtctgattaagctaatacaatagctaattgggcatgagttcttgcttccgagaggaggtaggcagcagttgcaaactttgcattctcctttttgtactgattgattggccgtttgattggacacatatgatcgatcgacaaacgaatctggccgaccaaaacacattgcacggacagcctcatccatgcacgtaccagcactgtattttactgtactccacataggcatctcttctcttctcttccaacttccaagttccaacaaatggacagaaatatgggtccccatgtttctatacagtgaaaccaatcaggtacatcactcagaaatcagaacatgctgacagctgatgagcttatctatgtactactaggagtattctgtattaccatgcttttgatttttgaactatactgtacttttcagaacagatggctgatggctctgagctaatgaacaaacccaactgatcatggcttgctcatgctaattaatcattagtcaacttgctccaactgaatgtactgcttactactagtatattatggttctcattgtcatttatcagatagtcataaagggaagaagatccaactagacaccaagaacatcacaactcaactgttcacatgcacaactcaacaccctaaataaacaaaaaaaggcacaggcataataaacaagaagaaggcgacacccaaaaaaaaaagaaatattttcttcttctttttttttaccactggccatgagctagtgatgagtgagtgtgagcgagagtgatcacacgcactgattgctcccgtcgtccatggcgatggcgatggcgagatggccatcacatgacgctgcacccgccggcgttggggtcctcgtagcattgctgctggtggtagtacggctgccggttgccgtagtaccatccctggtggtcgtagggcgccgccggcggcggtgccacgccgtagtacccggcgggcgcctggaacgcgccgccgccgtagccgtagccgccgccgccgtaatatgacgactggtcgtaggctgctgggttgtagctgtagcacgagagggagccggcgggcgccggccagatggacggcacggcgacgccctgcgccgccggcatcatcatcggcggcgcgatcggctcgccgcgcgggggttcggggccggcctgctgctgctgctgctgctgctgcttggcgatcttgagcttctcgaggagcggggcgaggtcggcctgtgtcatgccggccgggaagggctgcaccttgccgggcttcgccgtcgccgcggccggcggcggcgcgtcgtcgacgtcgaacttgaccttcttctccggcttcgcggcagcggcggcggccttgtccgccttcgccgcctccttctccggcttgccaccaccgtccttcttctccgccttgtcaccgccggcggcgtccttcttctccgccttcccgccgccgccgtccttctccgccggcttcgccttgtcgccggcggcgtccttgccgcccttgttctccttgcccttgacctgcatgtccttgatgatcctgccggccttgcagcacagcttcttgcacaccttgtcggcgtcgaacggccccgacaccatcaccgcattgttcttctcgtcgtacgagatcgtcttgatgttcgccttatctgcacaacaccacagatcatccatgaaaaccatcagccattagccatgatgaacacggtcgtcatcaacctcaaatcaccaacatttttatcttttcacactccatatgctacagtgcgcagcagcatcgcacgagctcacagtaactaacacaaccatctgacatgtgggcccacatgtcagttgacgaaacagagacaggtccgtgcctttgcagcttttgcattggtgactgtggcgatgaattgatgatgcgaatgcgatatgaaaccatatgatagtgtactagcttctaccttggatcctgcaaaggactcttctgatcttcttgtagcatcgatcgcattcgaggtcaacgttgagcacaaccgtggagatctgcagcgatgtgatcgagggattaaaagataggtaaatgctgtactaatggagtacttactagctagtggtattattaacagcagatccggaagctgttggtacttccggtgttactgtgtggttcacttggcaattcttaattgagagttaactgcagagttgcagatagcagaataaattagtgacttgcctaattcttcaacctgtgggttcagaaaggatttactagtattctacaattctgctactacctagtttttgttctgtccttaaaaaaaacaaaagattaggagcataaaaatgaatcttggagttttctcttgcagaaccagatgaaatgaagccagtttctgaagaagaaattcagtgggcgaacttgaactaggaaatcgagtgggtgcttctttcgagagcatcaaaagaaatatgaaaaggacactagctgggagcgtgtatcttttgtatctttgttcaaaagattgtttgaaaacgaaaccacgagctgggaaaagaaagaaaaaaagaacgtgtgccttgatcttcgcatgaaagtggcttgcgacaaggaaaggagttttgggtggtcagagatagagatatttttgcttgctctgcacttcatttctgcttaccaccatgcttgttttcttgcgtgcctgacactctgtttagctacacaagtgaacgccatcaggttgtcaacattctccatttctccaataaacctgaagtgcttctctaccaaacttgactcaggttctccaagaaaaatatttctaccccaagggaagaaaaaaaaacgattttctttattttgcttaaacacatcaactttgttctgactacacatgcacacacacacacacacacacacccaactgaagaaatgaaggaaagatgcaaggcaagaatcaatactgaacaacagaatcttcagaccagctcatgaaaggacaccctagaacagcaaagtccggcgaaaagctcttcttaccttgtctgccatgagaatggcggcggtgtggccggcttcgtcgtcgccgccgccgctgcggccgagctggacgccggaggaggaggtcgccggagagggaagaggagaggagggaggcgtgaagagaagagaagaggggagaaggatggtgtatgttcgtactgggttggtggtgggtgcgtggctttaagcctgatctcggccctcactgacgcgcacgcaggtgttgggtatatatcttctcttaattatgtgtgtagtgtatcagtctagtaattagcagtaagcaccaaccacggcccaccgacaggtggggcccaccggtcctcgtcgaccttttgacctctattagctgtgtatcatgtgcaaaaatattgtcagtaggtgggcctctctctgcgttgggcacacacgtttcagagaaaagaaaatagataatcagtctagtagtactagtgctgcagtagtagtagtactgtcctagtacaagtcacttctagaattcagaaaagaattgtggaagcaatgtactgtaatgcttatctcttcatttgcaatgttttgcacattttccccccttaaaccagatgatatatggtgatgaagaagaggagggcgagatataattagcacttgatactaacattgcatggctcagaaaaaaaaaaggtagtaaaaaaggaaaaggaggtgacatacatgacttaacacaggtgatgtaatgttagcagcagtgatgtgtgctttgtgtttttgtgccatggaaagcagggaaatttgtgtccaagcggcaagagcgcatgcatgcatgcatgcgtcccagcctgggaatggcgtccatcgattttgacacctaaatttggcggcgtctccatgaccatgccttggacttttgatgcgtaggcaggcgaaatgccgccaaatttgccaataaattgaggtgaaatgcaccgaactgaactgaaacagacaaccataagaaaattttgggacgccacatactttgggggaattttgtttgttacctttgggcaggtacaatagcagcctattagtcagctataaacatattttaataagataaacgatgagagagaaaaacagcgggctacagatttatagcccgctgtagcacggactctaatatgcaatgtgtatatgacagacgtgaccatatattaatagtatagtaagtaactattgtatgaattggctattagattgactatagatgaattggagttagtagtaggctatactattgaactttctcttacggcgtgatgttttctgtcggcaacgggatgaagattgaaggcgagctacgtacgtacgtcatcaaccatctgtgtatgggcaaccaccagataaaacacaaagatggtcaataaattaatgatggtgtgctaatgcgattgccttttggtgttgggaagttcatagctatctggattcttggactgggggccagggatttaattttgcattccctaaacttccaaagtgctgcacaactcatttgccaattgccattcgtcgtatcgatctcaccagagggaaaaatacttggaaccttcctctgtccctccctccttcccagctactcgctcgccacctttcgcagcttcgccaaggtggtcactcgcaacgccactccagtactccactccccatcacatgaacaagtattcacatgccaatgattgcccccctccccccggatccggatatatgcagtagtagcgtggatttatgcagttgtagctgttgcgttggatctaaatctaacggtaagaattagattgattactgcagtaaaaggactaaaagatcgttcaggggtaccgtagcatgaacactgtagcaattgatttagatcattgatcacaaaaataaatggctgaaaatacatgcagttttaaggtgtagtcgtaattaggaccccaaccaatgcaaccaaaagaaaaaacgtcgtcacaccggacgagacacagtgacaactcatgcagcatgcggcacgtactccctccaggaagtcgcttaggacagcgacacggtctccaaaatacaactttgactttttatttctataaaaatattggttaaaaaatgctatatgtatatttttataaaagtatttttcaagacaaatctatacatataatttttatatttttaaactaaacaacttgaaagctatttataatttatatttctaaggtttgacttaaacattattctaaacgacttcctaggtgcagagggagtacaggcccaacccgcagatcgccccggtgggcggtgaaaaaaatagtaggcgacgtacatacgcgaacgcgaggtcgcgcacggagaattctgccgtttttaccgtgagacgcgcgcgcgagcggcgcgcggcggcgtcgtgtgggcgcgcgtatgtacgaacgaggcgagctgttacggcgcgcgcgcgcgcgcgtacaccaaagtagtaccaaattaacacgttggccgcgggacgttttcttcgcggcttcgcggggttggtggtgtcggtgggattctcatcgggttgggcgcgcggttcgccgctcgcgcacagtggtcgcactagtcgtgcacgttaccccgtcgccgtgcgctcgcgccgttgcacgttcgcgatcgtcaatggagatgctcatcgctgggtttcatttattatttttatttttacgctacctggggtgtgtggtgtgcaaacctggtgtggtggctgccgttgtgctctcgttgtcatgataaatgctactctctgtattttaagtattacaccgttgacttttttttattgatgtttgaccattcatcttaattaaattttttttacaaatataaaaatatttatgatatgcttaaagaacattcgatgataaatcaagtcacaacaagataaataataataatataaattttttgaataagacgattggtcaaaacatcaatggcatcatatattaaaattcggaatgagtacctccttatttcatgatataagacatttcaattttttcctaactcaaactacttcaacataaaaaaaataaactatcaaaatatattcaatacaatattcaataaaactaatttagtgctataaatattgttatatttttttctataaacttacttaaactttcaaaaaatttaactttaaaaaagtcaaagcaatttataatatgaaatggagtgagtatgtactgtaagttttaaaaattaaagtgtagatataatgagtgcacgtaagttttaaaaatttacagcgtagatatatgaaattatagtgtaacaaacatctaactacattttgatgaaaaatatgacatcaaaaataaataaatagttaattcctgtgcaacccgtagctgccgttgcgctttcgttctcatgagcaatacaatccgggttattctgcaattcgtgcggtgtttttgtacatgcccgtcagtttgtcccatccactgactgcacaaggaagaagaataatttatctgctcctacgcaaagaacgtgtgggtttttatttttgtttatttgatcgtatttgggttggcttaatccacaaggtttttagtgctggttgttcgtgatcaacttgtcgtgtttacgggggtttcgtattgtgatgattcatccatgcaagctgcaacaagagatcgagcatcatggcatctcatgcatggctcttggatacctcttcagattgttctattggattggttacaagaccagcaggctgtaggatcgaatcacaagaactaagccaaccaaaggggggtgaatggttggtatacccaaaaaccgaaaacttttagcgaaaataaaagttaccctcaatttcgatgagatcggtctgaccgaagtagattagccggtctgaccgaagcgtagccgccggtctgaccggtgttgatctaccggtttaaccgccgagatcgcctgccgctcgctatcgccgccgtcggtctgaccgccgtgctctcgccggtctgaccgccgtgctcccgccgatctgaccgcccgtagatcgccggttagaccgccgaaacccagtaaacacaaatcgaagaactcataaagtagatgacgactttattgattctctttgtgtttacaaagtgcaccaacagcaatctttacaaaaatttcgactaaactcgaaaccctaactcaaaactcaactctattgctctctaaagcgataccgggaagcctcacgctccccctctatttatacatgaggtaggcagcctaaagccacgaaccaaactcatactaggagtcctaaacaccttagaaaaccctctagtacaagaaagaaactttacataaccaaacgtaccaaatttggactccttccaaattcgactccgcatcctatacgcacacaataactccatcgtatgccatatggaatctccatcaaccacgtgcatcaactctagcctaagtatcccgcatgatctctgaccacaacggacgtcgtcttatccccaagccgactcccggtccatcaccgcaaatactctcccgagacatcgagtcgcctacacatggaacaaacaaagaaaccatattccgagaccaagctatctccaacttaactcattagcagcaaacaatagtattacatacatatagcatccatttagaagtcataatcatgaaaaaaactcggatatccaaataaacaacccgaaaccgaaaccaacacagtgtcggccggtcagaccgcgggctgcgccggtctgaccgcgcattacacgccggtctgaccggcaacccatgcccggtctaaccggacccaaatccagcagtacctgtatattcacctgtgaaatccaataatctccaaaaccacttcgtgaataaattccaaataacaaaaccaataatctccaatacccatttgttcatcacagaataataatcaaaaatacctttgattttacacaggcataattctgggtgatgattggttctacttgattaaactaaggagaaacttccgattggtagcttgcacccactcaagtatcgaaaagagattattgggtgatggagtgagcactgtttccctgtgaaacaacagacaaggaattaacgatttgaagattttatgagaatattgggaagatgaaacttccctttcagataatgaataatgtgttatttgcacactaacatttttgaacttttttgggtacatgtactttattactaaaaaggtaaatagagagaaggagtacaacctaatgccagtacatgtttcactgaatggaaggagtacaacaaaatgcagagagatagctgtatgcaccgtggtatttacacactaacattttttaatacttctctacctatttcgttagggagcgtattctgtgcacataaatttttcgtatacacattatgcacagaacaaaattcaccaaaaaaaaacttagagaaaaggagtacatgtttcaatagcattatatttctgtttaaagtcttaacctcagatttattatattttagcccagaaaaaagatagcttgaaggttataataaaggcaaaatttgctacaggacacgcaaaaaatgtgtaattagctaggagacaccgaaaaaacgtgacactgtccatggacactacaaaagttgtgtaattagctgtaggacaccggaggcaatattttataatttccaacacaaaagaggggagataattttccaaatgaccagattgcccctgacattgcacaatctaaactcgaccgggtctggtcgaaccagtcccagtcagagtccgctaatggggttgggcctacatgtcagcgaggtggtggatgggaggtagggtagcagcgatgtttgcggtgtcgccaacggtgatgaggttgcgtgaccacgacgtgtcgacggctccaagcttctcctcgccctctagctcacccagcaacgtcgcacgacatcactcttcaccccattgccaagaaactgatgcgaggtgttccatctcatcctcctcgccctcatcttctctgccggccgtggtgaagacaaaggccgtcatcgccatcgagtcgcggtcgtctctatcttttgcccgttccatcatctcctttcagtgccatctccattccatctaatcacaccccatttcgtgcagtgacggcgttggaacgcgacctcgccaccagagctcgggagcatgctccgagcaccgccgccatagcgacctcggcgttccgaccaccgtggagcattaccggtcaagctgcctcgccatcattatcacctcgagcacctcttcaaaacgccccaagaaccgccaagatcgatgaagcgagaagggagatcaaccttttcttctccggcgccggtctaccgccatcttcgtcaaatccgtccacaccagtgagccattgcccgattccctatacacgtgctgtccctatgacctcaccacgctcatgcatgccacaagctagcggctcatcgaccctttcgcgccatcatcgtcgtcgtgaagctctgcatcgccgcctggagactttctccatcaccatcgatgtctagaccttgccgaaccctgtgtgcgattcggtgagtactctagagcctctacaaaccacatgcatgcattcccttaggctaaatcgagctctaacacgacatgcaccaccatcccgaacttggccggcgcccgtaccgctgacaccactgattccgttcaccattgcttgcaagaagactatggtagcttcgccttggacccctctacaaattctcttttgactgcaacctcatccaagccgccgttcactgccggcgacgccgcaaacctcgccgttgccctgcctggctgcctcccatccaccacctcgctgacatgtgggcccaacccgattagcggactccaactgcgggtttagatggtgcgataccgggggcaatcaggtcatttagaaaatcctatcccctctttttctcagaaattataaaatattgcctctggtgtcctacggctaattacacaacttttgtagtgtctatgggcagtgtcacatttttgcggtgtctcccagccaattacatttttttgcgtgtcctgtaacaaattttgcctataataaatcggttagatttttttgttgcttcatatacatagtgtgtacacgagattacttgtgcggataagatatgtgtccgtttcagaagaggtacaacttaatgcagagagcaggtagctgctacaatagatgtatgcactgtgtagtgtgagtacgatggtacagtcaacgcaaagcaaactctgagtctggacgagctttttgtttctgactgtgactgtgtttagtttctgaaaaaagttggaagttcgaggaaagttggaagtttggaaaaaaaaagtttaaagtttatgtgtgtagaaaatttttgaatatgatatgatgtgatggaaaattagaagttaggggtaaacacggcctctgtacaagtacttgacaatctcaatgcatgtaccacaaaagattagtatggtcttgttcgtttctccaacaacatggagataaactttttatactcgtggcacgcttttcaaactgctaaacggtatgtttcgtgtgaaaactttctatatgaaagttgctctaaaatatcagattaatccatttttttaagtttgtaataattaaaactcaattaaacacacgttattaccacctcgttttgcgtgaaacacttaatctttatctttaggagattcaaacaccacctatgtgtcatctttgacaataagcagatagcaagatcccgggaagaacactataggccctgtttagttctaaagttttttttccaaacttccaactttccatcacatcaaatctttcatacacacataacttttcagtcacatcgttccaatttcaaccaaacttccaaactacagtgtgaactcacagcctatgaatcaacggatagcccgcaaagtggtgggattcagtcatactaatgaacaacaatgccacacccaaatgacagatggacatcctaattatttctcttgtaaaaggcccaactgttttgttgggtcaatgggcattttgttgggccgatgaaattgttgtacacagtatgaataagtccaccttgaatccttcacgtagggtttcaatcgtatttctcaaacgaaaaaccaggtacaatacattgctcatcttctgaaatcagtcaactatagttcaaagacagtattgactaattgagattgttttcgactcatgtgaccccatgttgtgtgttgactcggtcatcgtcctacgtggcactcatatcaaaggaaacaaaaaacagtggagcccgcatggtgcccactcatcacataagaagagacagagagcccaaacaagaggtgagagggaacgaggatggatggctaagggcatcaccaatgtttactgttggaattaatgaatggaccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagagggggaacacacgcgcgcgcgtactcgctcgcctggcaggcggcgcacgtgcacgacgtgcacgtggttcgccaaaattggttcctcaccttgcgcagatgcagcctccttttgcaattttgttttgctgcaaattcggattcgtttttgttttggaaacgttccagaaaaatccggtgcatgcaaacggtgtggagtccggataagttacgcgcgacttatccggttcggttacgcgcagtggagatcgtgcgggcgcccttatcaagcgacccttctctatataaaccgagccgccgccttcacgcaacacacgcgaaatcaatctagggtttgcctccgactctgtgctgcgcgtcgctcgtagattactccatcccgctcgccggcgtgcacctgtgatcgggagagcaggtctccggaacctctgccttcgacgttctgcaccgggagaaggcggcaataaggtttttgggaagcgctttgcgcgactgctccctgttcgtccgcgacggctcgtcttcctcttcgcttgcgtgctgcgtgccttcgtagatgcctgcgaaaagtttcgaccgagcagccggtctttccgccacctcggtacgtgttcaatatgttgcgcatatttgatctgtttatgttatactgtgtagtttacatgtgtagatctaatgatgcgttcatgctagttttcatctgtaatgtcatgatttatttatggagtagattaaatcattatatgcctataatctcaacaatccaaaaaccttattataggcattgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctattgatgctagcaatgatctgtatatcatggagcagtttcatgactacaagatggctgacaaccgttctgttatcaaacaggctcatgagatacaaaccatggctaaggaactcaaactccttaagtgtgtcttacccgacaaatttgtggccgggtgcattattgcgaaactacctccatcttggagaagtttcggtactgcactcaaacacaagagacaggaatactccgttgaggggttgatagcgtctcttgatgttgaggagaaagctcaggaaaaagatgccgtgtctaagggcgatggtgggcagtccagtgccaatgttgtgcacaaggcccagaacaagagcaaagggaaatacaaagctcagcagaccaccaacttcaagaagcagaagaagaacgacaacaatcctaatcaggatgagaggacttgctttgtgtgtggccaacttggtcatctggctaggaagtgtccacagcgcaaggggatgaaggcacctgcagggcagacttctaagtctgctaatgtgactattggtaacactggagatggaagcgggtatggtaatttacctattgttttttcagttaatcagtctactaattggtgggttgatactggggccaatgtacatgtttgtgctgacatctcattgttttcttcttatcaggacgcacggggttccaccgtcctaatggggaatgggtcacatgcctctgttcatagtgttggcacggtagatctgaagtttacttcgggaaagatcgtgcagctgaagaatgtgcagcatgtcccttctatcgacaggaatcttgttagtggctcccgtatgactagagacggatttaagttagtttttaagtctaataaagtagtcgtgtctaaacatggatattggggcgcgcgaggcgtgggcgcgtggagtggttggtgaatggtgagagagagctcgccctcgccctcaccacggcgtgcgccttttatagcgaacgaaaggcggtttcttaattgtgatctgtggtgttaagcaagtgactaatggtactgtgatcttaattagtgtctaatgatgagcgtgattatgctttaatttctgtgcagctctccctgcgccctgtggttgggccgttttagctaaaagcccattcggattttggacgtgtattttcttagtttatccctcttttgggttaaatttggtttgatgccaaaatcaaatactactactgtagcatttagcaatactgaatactagatatttgaattgctactaatatttatcaaatcaataactataaattgatagtactatattctacgctaccgaaaacattggtactcctgttttgattggtgtgatttttttgtgtatacgaaagaaaagatatgcatggatggatggatgagtgaatgaggtgtcgttgcgtcgagtattaattttctttttctactgtaccacacagttcgcaacgtatcatgtactatagcgctctctccgtttcgaaatgttcgaaatgtttgacatcattaactttttagcacatatttaaccgttcgttttattttaaaacttttatgagatatgtaaaattatatgtctacataaaaatatatttaacaatgaatcaaatgataggaaaagaattaataattacttaaattttttaaataagacgaatggtcaaacatatgataaaaaatcaacggcgttaaacatttcgaaacggattgagtagtatatagtcgttgcatcgcacgtctctcctgcaggctttttcccttgctggttttgcggaacaaggaaagcttagggtaaatcacattatcacacacacaaatttaaatacacctgtacgttcaaaagagaaaaagtagaagtatagttggctgggtcctgggtgggtccatttcaggtcaggtgaaaactgaaaatactgccagctacgacgaatcctatattcaattcaaacgagcttgctctagtttgggacctctcagaacgtttctttgttctaaaataaaatataaaaaataaaaagactagcacttagtagtaactttctttggcaatcccaacgatgatcatgcaataatgtatatacagtacctccgtcctaaaataaacgtagacatagatatccatcttcaacatttaaccatcctcttatttaaaagatttatgcaaacaataaaaaatagtcacacataaagtactccttccatccacaaaagttacacctatttcacatttgagtttttctaaataagttgttcctatttgtagtctttatgcattcaagacttgaatgaagagataaattaaatgttttattagaactcaaggaatcatctaaatacttattggttgcatgcttgcatttactacttgattttgtaacatccaagatgatttaatttttccttggtcttggtgtcaaaagtaatatatgtaacttttgtggatggagagagtactattcatgtcttatcatctaataataataaaaatactaatcatattttttttaaataaaacgagcggttaaatattggacatgaataatgtaaagttacatggatggagagagtactttaccggaatgactacgcatacgactggtcaatacgactctgtagtccgtacgatcataacctgaacccacagaggtaattaatctaagcaatgtgattagtttgatgaggtgagacatacgttagtagtacgtatagcacttctcatactctacgtgctctattgcccgctcgtcagaaaaaaataataattaattttaaataatctaggtgtttctttagtgtgtataaccagttattcagacgtggtttctaaactgctaagattcgtaagtagtccaaccaattaatcaaacgtgcatctcgctctatgaataaccagcatagttatgcaaataaaaaactttgatctcaacttaattatcgatgcgcgattatcataaaaattcatgattaacacgatgatggtatggtcaaagtctgttgacctgatgttaagtgacttttttttttgcaagcttttcagtccataccaaatgccacgagggcatagtagaattattagtgcaaatgcagtcaaacatcaaaacagaaacacacatcacactgatatggttcttctccgttaagatgaaaaaggaaggtggcaacagaagatgaagacaaacaaaaataatgcagggttgtggtgtgtatctcttgctccggtgcatgttgccaaaaagcccaaacaaggcaggagtatacaggtacagccagctttatttttttttcctttcagggagggaaaagaaggcagctcacacgcaacacatggacgttctgtgcttgcagcatcacagtagcttttgttggggaatcacaatgcagcatgaaaccaacacacacagggaaacatacggttcagcaatacaatgctgcaatgcagttgtgcaagcaaggcagcatttacacttgcacgtcagatcacgcaacacaaggtagtcggagcaatttagaccaccttactcttcaaccacaatataataacaatttagaccaatagtccttactcttcaacaatacaagtatataacccttaatgttgcgttggataataaatcttttatacttgtactcttaattgtcaaaaaccaagcctaacaaataagaagtggggaaagaaaagagacatcctaaattaattcttgactagactaagggggtgtttgggagagagaggttaaactttagcccctctctcaaaaccataagtctctaggggggacttatgtttttgagagctctctcccaaacaccagtaggcagggcagctatgcatctaagatattatgctcatttaaactcggttccagaagattaacatctgaagcaaggcaaacacacacacaaacggttagctttggtcttcagaagtaccaagtatgctcttattcaggcatcgacgatttcacgttacttagaggcgggctgtttgcttctcaagaaaagttccctgcgcataaagataccagcaagatgacagcgatcgttagtacaataacaggctactagccagctataaacatattttaataagataaacgataagagagaagagcagcggactacagatctgtagccagctgtaacacgcaatgtatgtatgatatgtgggaccatatattaatagtataataaacaactattgtataaattggctattagattgactatagataaattaaagctagcagcgggctatactattaaacttgcacttacattgatgagaacctaaacattgcaaaagcagactaattaaacgtgtgcagagaatcatttaatttaccgaggcctgagatagaaggtaatgcagctctccgacatttaaccagatcagaaacatataattctgtattaatcacaccatgcgagactgtctcattcacagaagtatagtccactacctgtttgacaataaagactgaatttcaggatattcggtgcagtgacggactcagaaagatcacgttgggtgtgcacattcatatctctcttacagcgataaatgcagaaatgaaaatctaagctacgggatattacaggacctgaatatcaaattattatacatacaaatagtatgcttaaatgcagataagattgtcaaaaatagtgcttaaacagttcaatcatcatctcatatatagtgaacaaaaatagaaaattacaaccaagaaatttaattggttggattaaaaattctgcacaacaatataaatattcttgaattgattcccatgatccttatcatttaaatggttccagagctaatcagatgtttggaaagtgatctaagcaattagaaattcaaaagttgacaactaaaggctaaaagggaatctttcaatctaaccttatttattagtgctaaataagctagaaatccttatattttggaactgatggaatatatatggtagcataacgaatatgtggacaagaacgtgtaccttgtatccatcaattcttgtttcccttttaaaattgtctttcaaaatgttcatctccttatcaaacttatgggaaagtgcatccagatcatgggtgattttcttttttaaaagaccattatggagcttatccacggtatcttgaaccaagatatgtgttattgcccctaagcctccaagagcatcaagaaaggatagaatattttccattgtgaccctattatgatataactcgttggcaacctcacaaaagatagttgtgtacgtcctcaccatctgcaattcagaaacgatcagtaagccgaacgaaattttagaagtacaatagaaagaaactttagaacttaattacctgatctgctgtacgttgagaaatttcggttgtaccaagcccgaaggcagcaacatcctagaaatgttacaataaaattgatgaattaactttagaagcaccaactatacatataacaaatggaaagcgtacacatgacatcataatttaccatgacctccgaagctaaatctagagctaatcgtgctttcctgcaaaccgttgacaccatctccttctcgtctgcattctgtcatagtgtcatcgccaaattaaaagagaatgaaatgcatcaacgataagctgcaacacatttattttggtagatctttgttaaacaataagagcatgcttgtcaaaatttcaccataaagtaatgtgttaacaatgaattcggtgcattagcaaaatactagtgaacttgacataaccccaaagattggtcagctagtgcaaatagggaaaagatgtgcgcactaattttttttaaaagaaccattacaaaagcagatgtttcacattgtgactgaatcttgacttttaataaaggcaaattgactcaatcagttaacatttttgttagtaagaagtttgtaaagaaatttttagtacatgtagcattgctcttgcaaatacatatcaatggaaatgttattattgtggattttttaattagaagttttttcccaactgtttcacagacagagtataaacaagactaaccagaatcttagaactggaagaatacatcttctgcatgataaccgcaattttgtacttctccttacggaacatatcagggggcgtacgcttcaaaagatcaaaattagaggcattaggaacaacaaatataaatctaaccgcaggaaagtttgctaataatcactgactcaccttataaagaaaatgatctcggttacctctgtccctagagtaataaaactaacacagtagtagattgctttcaaaattccaattgaagtttaaatttacattgggaccactgtttttagaaaaaaaaaaacttctgaacttaaaagcaattttagaactcatacagctgatggttgacatcataagcttgggactttcatttgtaacactctggtttacaagaagaaatcaaacattggcaaatgccaaaacatctacttcctccgtttcaggttataagactttctagcattacctacatttatatagatgttaatgaatctattttatgtctagattcattaacatttatataaatatgggcaatgctagaaagtcttagaacctgaaacggaggtagtatcattagttatcatattactcctctgttgcttataattcccactgctcatctatatctcgagggactagtaatctagtattacagcatgaaccagattaatctagattaacatctgagatcgagacttaccaggcccaaggctgctctgtaatcatccaggaatttgtctaatctctcctggaagatgattgctggatgctctgatcttgcagctgcatcctgttcgagcaagcaataagcttacatcattattagcacaaaaacatagcgggagatcgaaggctcgccggaagaggagacgatgccgctgcgtcggctagcattacctcgtcgtcggcgccgtcgtcctcgtgctccggctctgactccgttgggctctttgtacagtgggagcggagctgtatcctcctcgccggcgccggcgaggggaggcggcggcgttggctaatcagagggaggaaggccagggcgctcgtcggcgcggcggtcaccgcgagatgaggcggcgaccaggtggggcggagcgccgccatgtgttccggagtttcgcggaggaggaaaagggattagcgatggatttatctgttcgttcgttgcaaccccgcatcgtatcgcgcacaaattagttaccataatactatcgcgcaacattctaaacgataatttcaaatcctagtttagagattcactggtcaaaaactcggattaaatcctccaatttcgttcgaaatttacaccaaacacggctacatttgccaagcaaaaacttgatcacatcatcatcacctgttctagctgaaactgaaaagcatattacacgtgaaaaaggattgggatgttgctgttgttctactactggtcgtaggtgtagatgaagtcggagttcccgaccatggcgttgagcacctgggagacgaggaacccgccgccggcgaggacggcgacgatgagcagcgccgtgacggggttcttgagcagctccacgatgggctgcgccagcgtgtacgcgaacccggtgctcaccgtcaccacgtacagcgcgtaccgccgcatgttgtcccagaactcctccaccagcgggccctccggccccagcgccgccgccggcccggccgccgccgccgacgacagcgccaccgccgccgcgatggccccgatcagcgcccacgtcgggagcccgcacgtcctgtctgccccgccaccgccgctgacttctccctccgctggttcttggagggggtggaggagctgctgctcctccgtcttctcgggctccggtggtgcggtcgtcacggcgaggaggcggtgctggttcgttcgctgaggggaagggaggcgagcttggaagacggtggtgcggccatggaggcggaggtggcgggggtggtggtggagtacgggggagaggcgaggtaggtggaggagcgagaggtggtggttcatcttgcgccgccgcggctggcttggccggcggtgaggtgaggacggcggcgatgagggaggaggagtgtgtggtgacgagttcgcctcgcagtcgccgtgatctgcacccgctctgcatgtggggtggtggggatgcgggtggttgttgggccgagtggaatgttgttgggccgaagcaattgttgctgatggttgggccgtgggcttggttcgtgtccatgggcatggttcgataaatgggccggtttggtgtgcgctttggcttgttagcgcttttctacttttgtgcggcttgtgtaggctaaagtggctaaccaaaagtttgatgacatgttagcgctttctacatcttttaatctgcgcaatgatttagcaaattgttttgcttttctctgctagaaagaggccgtctcgtaattcgttttagctttcgtgaataacgtggcgaaatcgtgtttactaaagcattttatcacggtaatgatacgttgtggctatattttgtttcatattgtatctttatctctaaaaattgaagatgtttttaccggtatttttggtacgttattcgtgtatgagtcagtttttaaattcgttcgcctttaaaaaatacaggatgagtagtataaaaaatctctttaaaaaaactcgcatgctaacatgagatgatcagacttatactacctccatcccaaaatgtttgatgccattgacttttttaaaaatgtttgaccgtttgtcttattcaaaaaatttaagtaattgttaattttttttctatcatttgatttattgttaaatatacttttatgtatacatatagttttacacatatcacaaaagtttttgaataaaacaaacggtcaaacatatttaaaaaagtcaacggtgtcaaacatctaaggaagaagggagtaattgcagctaatgattttctagaaaattatgcagcgaagcaaattttaaaattgaatttctccttactaaaccgtataacaataataaaaattaaaatattcttcacctgttgtaatgtacgggtattttttttctagtttgatctaaattgagaaatatttaggcattttctagctagaactgaactgaattagaaacctcaccccttctttctattttataataatgtaaagcgtagtaaatactaccacagaggctcttggaggttgtctgtactccttcattcttatctttcaccatagattatattcgtcaaatcgatcaatcggtagaaaacactatattttttattaggattcaacgaggtcaatagtattgattgataatatatactcgagataattttatcaatttactgctgattttgactttgtacattccgtttaacagtacatctttacaagtagtaacaaaaaaccgaaggcgtaagccgaagaagactttctttcacgccctcctccaaatccaagggcagcagtagcagcaaaaggaagtcaccaacccttccttcgtcaccctaccaccggtcaccggtaaacccgcccccgccccgcccgccgcaaccccagcgaaccaaaccaaaccaaacgaaacgaaacggagtagattcccccaaggccccaacctcctcctcgccttcccacctgtccacctccccccctccgccgccgccgccgccttcttcccgggggcggggcggggagaggaggcgcgggggtgcgggggtttagtatctcctctcgccggtggccgcgcggggaggtgacggcctgagattctcgccgcgtccgcccgtcgttctggtggtctcctcctccgccgccgccgccgcccgcgtgttgggggagagcggtttggcgtgaatcgggccggggtgagcggacgccgccgccgttggtggctgcttcatggagtgcttcctgctcagcctgaacccgttccggttcaagccgatttggccgccgaggaccgcgcccaaatctccctgaaaccctagggtttcccctcctccctgcccggggatttcgagaaaaaggaagtcccgggcggcgcttccccccaacccctcgtttttttttttgggttcatctcgtgtgttccgtgaaattctcgtcttctcggaggtttctgaggggagggagaggctgggctgaccggctcaaggtgttgtgaaaggacatgagcttgctgcgagaggctccttgtctcgtttagtttgagttcgggctgggcgtcccttcttctataggtgacggtggtggtggtgctgctgctgcgagggatggcgaaggaggaggacggcggcggcggcccggagttcgtgaggtggagggaggacttcgtgtcgcaggagaggggcagccgcgtcgtgcattactacctcgaggacgccgcgggcgcgtcgcacctcgccgtcgtcggcacggagcggagcctgcgccacatgctctatgtggtctcggaggatttccgggaggcgcagggtgccgatggcggcgggccgggggtgtttgcgcgcaagtggcggtcacgccgtgaggtggtggattggctcgcctccttccttccggcgaagtccctcgcctcgagtaagtctcgcctcctttgtttatagtgctcatacacgagttcggctgatactgaatataccaatagctgtttatttaacatgctatatgccatgtagtgactttagaacctaatgaagtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggatcacatatgggtaatgacattggattggatggatacagtgaacctgatagctttatgggtcacaatctggtatgcaattacttgtaactttgcatacagtttgttctcatctttattagcgttttgattttttttatattgttaggggaaagcctgtagctcggacattatgtggtctggttcgtcctggacttgtggcaagcagctttaccactataaagctttttgtcgtaatggtaccacaatatctgtaagtattttgtcatggtcatggtcatgtgtgtatacccaattgcccatattgttttctgagcttcatgtgccatcttctttgcagacccactcttttgtgcttgtcatgtctgaggaggaaagtcgctatcttgcatacttggaagatatgtacgaagataagaaggggcagaagaaggttaaagtgcgatggtttcatcaaaaccaggaatttgcttgcgctatacctcctccccctcctcatccttgcgaagttttcatcactccttattctcaagtaatcagtgtggagtgtgtcgatgatattgcaactgtgttaactcctgagcactatgaaaaatgcgtcaatacattgccaaattcttctatggtgggaatccgtttctgctttcgccaatacagtaaaaataagtttaaacgttttgacctgagatcattgcgtggatattttagtcaagctgttgttttgtccttaaaacttcccccagagcaagaaaaggatgatggttctgatatcataaaaacttttgagcaatggacacctgggaagacaaagtttcctaagcagtttgagaggctttactcaaaatgtttgggaactaaaatctgccgaggcccacaagaagactccatagcatcttatcagaaaccaagcagtaagcaatctcccagaaaacatctctcagtcaagttcatagggccccagaatcagcgtatgccaacctacaatgttggtgacagaatagaggtcttgtctcaggacagtgggattgtaggctgctggttcaggtgtacagttctcaagtcatgtactaatcataacaaattgaaggttcagtatgatgatctccagaatgctgatgatagtgggagattggaggtatgactactggtcttagtttgaaatttaagtggtatatgtatttttgaaaggcagaatatgccataatatttggtattttgttgttacttctattctttttcgtaatgccatgatttattttattaactctgtgtaaaatgtatgctttcataagaggatgagattattctatgcttctttgtaggagtgggtacctgtatcaacattggctcgtcctgataaactgggattgagatgcccagagcgacgcagagttaggccacgccctcaacaaaatagtttggctgacggaactaatcttttacctggagctgctgttgatgtatggcaatttagtggctggtgggaaggagttctagtcagtgcagacaacatttcagctgatagcctacaaatatattttccaggtaaatttcctttttgaatttttttttctggtcctttcttccaatgaaaaacaacaagttgttttgataaaatagatccttctgcagtccgtatctaattttgaccttccaagctaggggcaattgcaaatttgctgttggattgaatcgttattgcaagactgccactagaaaaatgcaaaaatgacacactgtcattcgagtggtatccctgcaaaattgaaaaaaccattggcaaatttgcaaatgccccagtggtattccttgcaagcgtatggaagctaaaccatgttccttatcatcaaacaacgatttcctatgttctttaatcctctatttcatctgcaacatgttgatatttctattgtttttacaggcgagaacttctttagtgtatgccagctaaagaatttaagaatttcgaaagattgggtcaagagccactgggttgatatagaaatgaaaccagatgtgttatcgaaaataccttcggttggtgttcaaacaaggcaacctgataatctgacatctgttgagaggccggactccagaaattctgcaatgtctgaccaagagcttgcagccatacaaacaaactctagtgaagataaacaaacaggagctgatcagccagcagaagttagtttgactgatatggcctctgcttttgcagaggaccagaaacaaacagttctaggaaagcgacctagggatgatgatgctgaacaacattgcaatggggaagtaggcatagatgttggcaaattgtgaagtttgggaagcgcaacctcattagacgtatgtacatagctatagatatggtaattggaccccagcagaggggttttttactaggttgctgatatcagtgagcatcgacatcttttttcatacacgtgttcccttgttttactgttagcttcccactttcaggctttctgtcaccagatacagaggttgcaaactaaatattacccttaccagtcatattgtatagcagtctgattgatcattgcttctcttatgttttcctccggagtctggactatagtttcagtttattctcaattgttaatatagtttaagttcatatgaataacattcttgtcctagcttgcttgtgctacaagagtatatctgcatttaagctgttgtgaagattcaacgactaacaatcacacattgtgattgggtatggtgtgcaattgcacatccatcaagtatgaactgcacttgcgcatgttgatctgaagaagttgcaaaatgagtggttttttctcctcctcaagttctgtatcatctatttgtggcatcctgggatctgaagtcaattctacctgatgccaatgccatcccatgatatcattatcttctgttatgttaggcctgatgtccctggcacgagcatgtcacattcatatgatgcattacctagttcctttacacatgcaaactctcatctgctatgattggctggtctaacaaatctccggtcccattatatcgcaaactttgaattctataaaactcaatctttgaagttgattttatggtttcatcgtggtttattttacaacattttgcttttgtatcattaaattttacctataaattactttttgtttgctaataataggcgatacgaataagcataaagataagtgaaatgatggggctgctcatctcactacatatggatgtatgtcaaagtttgttacatggtacatcgttacatgtcagctattatatctactaggtacatgttctatctgcagactgcagtggagaaggaaccagcagcagtctgaactttctgaacttgtgaagaatcggcgatgatctacagccggagccactgctcgccgttgatgaagctccggccgatgaacggccgcgcctcgtcgtaggtgagcgtccgcgaccacggcaccctctgcttcgtgctcgcccctggccctttgcagttgtactccccgaacagcaccgtcctgtcagaagattcagacacattctctgtcattttctgacggatatgatatggcagtatcgtctctaggatttcagaaaagaaaaggaactcatttggtaacagccttgtcacatgtggtaactgaattcccctatcaagactgtttggtgagcctgcaatgcaactcccaaccacttcctatgccatttgatcatcgaggatggtaagttggtaactagtaaaattcagctaaaatataatctcttcgatcaataatattaatatgccatgtgaacctgacagagtagctgcaattataattgtaactgtaattttaatcaagagcagcaaattgagtgtgtgattaaatggcaggaaagttgatcactttgttcttgattgatcaccccagtcgctccatccctgggggacgatgatgccactgaggtcacagtaggagtacaccactctggagtacttgccccatgctcttcccaggtagagcatgccggagccggtgagccggcagccgacgaagctgaacccggactcctccgacggcgagctccgctgcgacgccgcgatcgcgccgtagctcgtcgccacggcgtgcagcgtgcaaccctgacaaaaagaaaaaacaaagttacaaaaattcagactgccaagaagctaattgtccattttaatcatggcatattactgcctccacgtgttacagttgtatattgatctaataataatatattgacgtgtaaggtttttgcatgttcgtgaaaaaaataaattgatcatggcaccacattgccatgtaatgtcactctcattaacactcactccggcatttttcattcagtgacagttgtgccgaaggtagaaagagaatgtgaccactaattctgaacaccgatttgtgtaagagcattggtggcattggtgcagggctaagtgcctaaccaccttatcccacttagctatatagctaggttaagcaaggtgctaatctaggtgcctcaccagagtgagaagttcttttgctgtaaggtataaaatggaagagttggtgaatgcctgaattgtgagtttgtgacagctctgatcggaccaacaggagacacagcataaaaggtatagtactactagtctagaggacaactagagcaaagtgtgggggacagagtgtccaaagattttatcatgctatacataaacatattcttaaaaaatataaaatacttcctccatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcgccggacagcctcagcgccaccgcctgctgccccaccgcccccggcgccgccgccgccgccgagttctgcaccaccaccacgcttgttacatccaggaacacgtttcgccgccgccggcgagccggccggcgacgacgacgacgacgacgtgcggtgtgtgtatacctcgaaggtgatgtggctggcgcagaagtagtcggcctcgacggcgacggaggcggagtagaaggtgcccacctggtggcccgacgcgccgacgtcggacgcgcgcgagtgccacgtgatcaccgtgtggccggtgcccatgccgatcagcgacacgaacggcttcgtgatcggcaccgtcaccttctccctgcacggcacgccgtcgccggcgaggtcagcgccattgcagcttcaattccagtcttaaaaagcttcgcgagataggacgacattaactcgtccatggcggttacgagagggacaggtagtggggaggcgatcgatcggtcgaacacccacgtacctgtagacgcccggcctgacgacgatcttgaccctcctcgtgttgccggcggggaccatgtcgacggcgccctgcacggtgcgcgagtgccccgtcccgtccggcgacaccacgatcgtcgtccgctgctcgccgccgccgccgccgccgctcctcttgccgccgccaccgccggccgtgtcgtcccacgtgctgctccgcgccgccccggccggcatgctcaggtcctcccacgtgatgaacccgccatcacctcctactccggcgccgccgccgccagccaccgtcacggcgaacacgagcgccacaacgacgacgagcacgcccgtggcggccatgtccaactagtcgagagctaccgatctctagctagagctaattaaccacgcggattaatttggaacacacgagagatcaaccagcttagcttaatggagtatatatcgagctcgctgatttcacattacacacgccatggatgatgacgacgacgatgtgaagaagaagaagaagaagaagaagagaagaaaggatggaatgcaagaagacgttggaggcgtgaggaagtgatgatgccattaaatatggggagcgccacacacaaagccatgggtgttttggtgtgcccattggagatatatcaaagatttttaacattttagggcacaaaagtgggtgtttttgcttatggagttgtgtacacggtttcgtcgaccgcgaaaaaccatttttttttcatgagactaatttcgtccacgaaaaactttagcggtttgtcgctcgaaaagccgctttcatccaggttgcgtgatagtggggacctatttgtcagtgactgtttcgtgatggttctttaagagtggattgttggtagagctagcacgatggtgttgcattgcatggacttgttttgtgggaagggaactcataagggtgtgatagttattgcatagtattttttttgtgattaattaattaattaattagtatgtcatggcataatggttggtgctttgttttattgattacaagaattggaaaggttgttcatgagttgtgcacgagagagaccaagatttgtttggggaattttcgtggtggaatttggacaaggtaggctgatcaaacggggtagttagtaggttgttagtgcagaacggttgagtctagcatgcacgtcccactttctcaaccctttttacctagctcttgtgaattgtgatggtccatagttaactgcttttcttgacctaaatggagaaaaattagattggcaaaaatgttttctaaaacaaagcgctaatgcttcagatgagaagaatggcaagagatcaatggtcaatgccattttgtttcctattgctagttataatggattaggcgaagaagcattatgtaagtgcgagcctaacactgctgaaatctgtcaaaaggtcaatgcactagagctatttttgacgattaggtaatcttctgcagaaacctgcagttcaagtaaagccgtttactgtgcaatcaaatgaacatgggttgtgtaggatctatgcccaaattactcaaaaattcagcaaatcgacacgcttattcgtgacaactttcatcaaaatttcgtttacaaatgagcacggtgaaagcaatttttcagaccgcactttgtcgttcaactcaaaatcaaagtcagcctataaagtcagacaactttgtacaagtgtgaacttaaaacgagttcatgtccttggtcgtgccaaataaaaatggactgaaatagtccgtatttgtatgagggattgatgaattcaatataggctctagtactttcaggctcagccttgcaacaatgaaatggtcctgtggtttcagcccatggactggttactggttagagatttcgtaattgtcatgctgttctgtggaaatttccagaagcttctagaatcaccatatgcacaaacagatatggcatatatgtatgcatacaaaaacagtttttgttcatgggtgattaaaacatgggtacaagtgattcccgaattccaaatttattgtgattgatcttttcacaaatcacaatatgttcaggagattaccgaaatttggtatattctcatttgggttactctggatcccaaaaaactttacaaggaagtgggattttgctgtgtcatcagcatatgcttaagctttgcatactgcagagaagtggaatttttgcattggctaacaaaccaagtaaactgtgatcatatttagcaagtgatcttcaagtgggatattaaatttttacataatcctaaatacttattcaggttccaactaccatctccacttcaccaaatgttacacatttatttctgcaaaatagaaaagcatatattaggaacaaacaaattcagcatagacagcacaaccagattgctacagattggcagttttttggcaggggatgcacaaatgcaaggcagtatttatatactgaggcaagtaagcgattgagtaccatgatattatatcccactagcctaagcgattgagtgatatactgaggcaagtaaggtttggaaaccggagcggaatgtccctagcccactacaccagtacaacatggtactctagctaaagtctgcaatgatgaccatgtgcttcatccttcatgcgttaagtcgttatgccatagcccataatattgtttgttaacatctacgttgagacatccacagatagaaatagtacaaaattggaaatgctaacaaccaaaagatgccttggatgatgttatagtttattaaattgaaattaacatgtggcatcttgttttacatccctttccctcctaaataaacacaggcacgtcattagtcataggaactttctatacttgaaccaatagtcagtggagaaaatacagtaccaaccaagaagcatacaaatgggaactaggtatagtgaaaggcacacccttaacggcttaacagtaatgggatccatgttcgataagagaggcctcacagccctgattttgttgcatccacgcttgaaaaaattctcaaacttcagacttaggtattagaattccagaaatttagaaaatattgcgtaagctagcaactctagtctctaagtaacccttttttcattaagttacaaaagttggtaaccatttcatatctgataatcacacttatgaccagcataatcctcacagcgaagcaaacatagatatttgattatataaataatttaaaagaaggaaaatctatctccatgcagcatcaagatcagggataggatcaatttgttcatacctaatacttgttcgacgattgttcaagttcaggcctgtggactgacatgcgagcaatctcagatactgccgtctcactagcctgcgtatcatcaccagcaagctcctcatatgcagcctcgaatgcttcttgccagaaccgtggaagccgtacccgatcaacaccggtgcgtgtgtacacatcccacatccggcgcactagcttctctctgtcctccatctcctactcattatttaaaaattaggcaaaacttcagtacaagatttcattcacaactaaaaaatgcatatagttttgctcgtctatgttttagcttaggattctgctggtcatattgactagacaattatgcagatgaagcttgggaaattaaaccgttaacacaaatagcatatgttccagacaccaaaatcaagaaataaaggtgactgctttctcgtccatgtaatggaacaacttaaaataccatcagaccaaaaaaaaaaaatcatcatgtttccagcagagcgtgtacccttccttagcatttttttgataatgagcattttcttagcacagaactaaacctttcagaagagaaaatatgcaatgtatgtccaaatgaaactctataaacagagaaaattactagattgcagaatgcttagtctactatgtgaatttctaataaaataagctgtttgtgactttgctgaaacaagtacccatttcatccccactatgaaatctgaaatcaaccaataatgcatctcctttttcgcaatgtcagaccgttgggacttgggaaaaatgcatgtacacatcggacagttgaggaacaatggaagagattaggcaccgaccaccgagtggcggcaagatctggaaggaaggaagggaatgttggggtaggggagacatacgagggggtcgaggtcgtcgataagcgggtcggggaggtccccgaactcggcggcgaggtcgccggaggaccagcggatggtgacggaggcggcgaacatggaccagagcgcgaggagcgcgatggcggcgagcgcccacgccttgtaccgccccttcccgagcagcgccgcctccgccccgccggcggcggccgagatggggatggagatcttggtcgccggcggcggcgtggaggagtggtggtggtggtggtggtcggcgggagccttcatggccagcctcgagtatggcggtggcagtgggagctcagcagctgggtctgggactgggcgatgtgggcaattactctaccttttgatgagatgatttgagcaacgtgtttatttttctttgatagttgtagtgtactccctacgtccaataaaaaattaaaccagtattaaatataatatattctaatacaataaatttagaaatacatatgtctatatttttaggatgtgtcacacatcccgtactagattcctttttttttttacggagagagtatatggataagaggaccaagattttaatttttgatgttgctgccaatctatttttgttaatgatggctatgattattcactcaaggaaaagaaagagaagtgctaggagagaatgtgttaaatatggcccaatagttaaaagagataggatgagaattgagtatctagacacaaaaatttagaggaacgataccacttgtatcaacatacttagacttacgttattaccaccttttagaaaagactctttgttttggctatgtaagttctttagaaatcgtggtttgcttaacgataccatccacatatctattaagaaacaagtaactatgtttctaaatacagtaggggacagccttagaaatagattagttatcactaagtttgataggtctggagaaacagttagacgttatttcaacaaagtgtttcttgctgttggtgagctacaagatgaactaattaggcctcctttattggacaccccaactaaatttgccgggaatcctaggtggaatccttacttcaaggcgtgagattcatctatgtctcattttcaattttatatttaaataaactagtatgaatggtgaacagttaacagtgatggatagtatatcatcactaactgttgacaccaagaccctttactagaagtttttagcaactgctccctccgtcctaaaatataaagatttttatggttagacaccggtattaaaaaattatgtggaattaaatgagataagattatgattggttgagaagtaaaggtagatgagaagattgaattgtggagggttgtgattggtttagaagagaatgttgatgaaaaagttattgtattttgggacaaaccttaagcgctaaaagctgttatattttaagacgggaggagtacaattccttttaacatatgtagctctatagattctcagtaaaaaatatatgtatagttatataatccacgaaataaacaaaataaacaagaagtcaaaaactgaaaaatccaacctttgtaaattcttataagccaagcaattgttaataagaattttaagctaccgagagctttaagccttttaactcgaagttgccaaacaactgtaaatcttggctaaaccgctaacgcatgtgaaagtaggcctggtgatggtgggccttgggcttagcatgatctgtattaaactaattaaaactgctaaatcgcaaaaaaaaaatagaagttgctctaaaatatcaaataaatctatttttcgattttataataattaaaactcaactaatcatatgttaataccacattattttaaaacacttaattttcatctttatttacatgagtttcaaacaccacctacctatatacttaaataaacatctcaaacaaaattggtttaattaggagttaggtggccgtgagagcctgtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgaggcctgaggcccagtgcacagtgtttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtattttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaaatttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgatgtggtcgctgcgcagagtcgtcctccggtcttcgatgattcgggcgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgataaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatatgttgcattccaccgatgctctgcatcggtggcaaacttacgagctttcacaccggccgcattgcaaaacctcttccatgcagcaatctgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttacaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaataaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcgctttcggcctgacgggccgctggcgaaacgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaagagcctgcaatgagatgggctctgtgcaaaagctgagttaggtggcccgatcccctttcttccccgcaatcaattgctcaccggcggagaggccgccgccgccgccgcgttcttcctcctcctgagccctaaaagggaatccagctcgaggtcgaaccaaccaaaagcttggcggcgtcgcggagacgcggccaacctgctccacatacaccgcccgtttcgccagtgtcttttctctttttactggcgcgcgcgcgggcgcgggcgcgggagaggcgagggagtggtggtggcgcgctgcagggggggctgcttggctgcggagtgcggacgacggctataaagagggcggaaagagagcgcccgatcccgctactcatcagctgccgtctcctctgtgtgtgtgctcgcgcgcgcgctccggttgctcctccttgggttcttgatttgctacacgcgtttgcttgctcaccacgtgtttgatggaatacctgtgaggtgaggtgaggtgaggtgctgtggctgtggtttggttgatgctaatccagctgttatttgtgctggattgattgcttatttgtgcttgttattactagtcgttgttagaaagcttctggctaaaaagtcgtcatttttttgcgaaagcttctttagcctacaacggcatagggatttcgatagctaaaaggtgtgcttatcttgttaatgaaagagaagtgcagatgctttatttgttgtcttgttgttccaaactctagaaaagtatgctctttttgcctttatcccacgagtagtagtatatcatcataaaacttaagggtccctttgaaacgcagaataggaaaaacacaggaataggaaaaacgtaggaattgaagtagcatgttttcctaatcctacaggaatggaaaacacaggaaatatgaagagggtccctttgatagcaccataggaaacaaacaaagcaaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctctaaaattcctatgacaatcctccaattcaaaggggccctaagtagatgggagaatggagatattcccgatatacacacgtggattggagcccaaccgtgcatagctagccatcatctttgtctcactttgttaggaaatttaagtgaaatcaattaaaatctaggtaaatccaaaggttacgcctttcagtttaactatcaaatactccttgataaaactttactaaatataaagagtttgatgttgtttccagagaacttatatcaaatatcaataatttttggtatccattcttctgaaattagtatttcccttccggaaaacatacttaaaatagcagatatttcctctatttcacaatgtaagtcattctagcatttcccacattcatattgatattaatgaatctagatagatatatatgtctagattcattaacatcaatataaatgtgggaaatgctagaatgacttacattgtgaaacggatggagtagcaatctatagcttctttgtgtatcctgttccaatggcaaacgcttgctcctttttcttgatcagagcaagcaagtctgaaaattttatgtcttttccagtttgcaggcctgatactgcctgttggtccctccccatcaaaatgcttggttcacttatctcttactcaccttcagtggtaagttttagattcatatgcagtgatatatagattaatctcttatgctgaacaagtacccaggtggaaacattattagtcatgtaaagataatcaaagatctgtgactttttttttgtgcttattgctgacattcgctgatattcgtatacttctgttttgcttttttcatttagaatccaaagacggagaaccctgatgagttaattgcgactggtgtccttgcgagtctgcaaaactttatccgcaaatgcatcgtagctgtcctctcatatggcccaatgcctaaacatattgcatttattatggacggtaaccgtagatatgctaaattcaggagtatccaggaaggctctggtcacaggatgggcttctctgctctcattgccagcctactctactgctatgaaatgggcgtgaagtatatcacagtgtatgcatttagcatcgataattttaagcgagatctgactgaggtgaaatccttgatggagttaatggaggaaaagatcaatgaactgctagaaaacagaaatgtcatcaacaaggttaactgtaagatcaacttctgggggaagttggacatgttgagcgaaccggtgagggtagcagctgagaaactgatggttagcactgctgaaaacaagggactggtcttctctgtttgcatgccatacaactccacttctgagattgtcattgcggtcaataaggtctgtgcagaaaggagggatatactgcagagggaggatgttgacagtgttgcgaataatggtgtgcattcagatatttcagtggcagatctggaccaccatatgtacagcgctggttgccccgatcctgatattgtgatccggacctcaggcgagactcgcctgagcaatttccttctgtggcagacgacgttcagtcatttgcagaatccagaccctctttggccggagttctctttcaagcaccttgtctgggccatactacagtaccaaagagttcacccttatattgagcaaagcagaaatctggctaagaagcagctgtaatcacatcctccctgggaggagatagaaaccatcatacaagatatctgtagttacacaataatctgtattctcctttgatatctcctagaatgtgaaatatacaaaaaaaagatagctattccattgtaggcaggccaaacatgtgtatgcttgagttggtccaaatgtgtgaaatgtaataacatttggtctaagcaaagtgccttattttccctgaagcaattttgttcgctgtgcagatgtgctactatatccttcttgttacagtatgcatgcaaacaaactgagaacattataaagcttaaagcatccgtaaattaccaagtgcttcttcacacctttgatttatgctttactcaatcaaacaaattggcacaaaaactgttcacattttatccgggaaacttttgtgcttctctgaatcaaaagaatttttgctccattgattcggaagattttgaactagcatatttcattctaaaaactccttatggaattgctgactttgctgtgttaaggatttatatgattctttaaagcaattttcttacatatatattttttttagaaaaaatcatgcttagcaattcgaaaagcgtgtgagcggaaaacgaaggagtagaagttagaaacatgcactctcttcataaaaaaaaaccctggctatgtatacagacatgcgtatcctaactatgtatctggacatatgtatgtatgtccatatacacagccatgtttttttttggacgaagggtagtacttcctccgtttcacaatgtgttattctaccatttcccacattcatattgatgttaatgaatctatatagttatatatgtctaaattcattaacatcaatataaatgtgggaaatgatagaatgacttacattgtgaaatggaggaagtagtatagaatatgcccttgttgtctatacaatatttttttgaactattttcatactaaaagaaacccatttggaatcaatgtgttcaaagggtggcaattccaaatggattttaaaaccatggatatacatattttgcaacttttgtccccattgatcggcataaggcataagccaataatacaccatataacatattagcgataataataatttgttgataaaactgttatatatgtgttcttatcaagttaaaaggtcatggtgaagaataaactttgatgaaaattttaaatcaagttttaaaattcaaattttagccatggttgatttcatttgggcaaacgatggaggcctctttgcttgttaagcttcaacatggagtcaaatactccattcgtttcacaatgtaagactttctagcattactcacatacatatagatgttaatgaaactaaacacatacatacgtctagattcattaacatctaaatgaatgtaggcaatgctagaaagtcttacattgtgaaacagaggaagtatgagataatattttgcatttatattggtgttgtttattgaaatttcatttgtattggacgttatgggtgaaatagccagtgcctgttgaaaagctctcatctagtctcatcgtttcacctacaactaattataagttgtgatgcttatcagcgactcaaaaaataatttatgagtaaaatttttatatatagttgaaaaataaactagataaaacattaaaatcaaatctcattaagatctaaaaattaaatttgggctatgactgataagtttaaatgtcaatgctgaaaaaaaatacaatgagaaaacactaaaatcaactcaaattaaaaattaaaatttaatttttggttgtagcagataagttgaagtggagctgatcgtctgcttgtcttatcagttgtagcaaaaatttgaatctaaaaacttaatttcaaagttgattttaaggttttctttgttgtagtttatttttcagcattagcttttaaattgataagaacacacatataatgttttgaatataaattttttgggttgcttagtttattttctactgtttattagtggtagatcaacaatcagagcaacaagaaactcacatgcaaaagcacggtttgcaatactattttccttcgatgacaatatcagaaattctgaatttgggatgaattcaccacctaacataaaattaggctctatatttttcctcctcctcccctccaattcggctgcacaacttgtttccatgacaaattagaatcaaatccagcacatataggcctttttctcttttcctgatgaaacaaatagaataactcaggtctattctgaaaaatggtggcgatccaaataggggggtttgtgctaaataacgacatgaaaaaaaaaggcaaattgggtgaccactgtcaatggtttacaaaaccgcgtggttatcgcacggttatcacctgcggtaacctttttagttttgaaaccatggtatatttcacggttttgaaaccacggtataccttgtgataaccatcaaaccgcaagatgatggtaacctatctaaaatggtttggtaaaccctgctcctgtccaatatacgaagtccaatatacgaaaggaaatggatcatctgacgtgaacttttccctgacatagtcactatcatgttggtccatggatgcatggtggagtctatacgtcagtgacaatgtttatctcactttacatccgaggatccgaatcctctatcaaatgtagagtattctaatttagcatgagcgagttggaatttgcttcatcagaagatccaggacaaattactctgtagactatctatctctctgtacacactcctgtatcggcctcatcatttcacttacgtatatatatgcatacccaaacagtttattattaactcgaaaaataatttacaaataaaactttttatatatatgtactcttgacgattcgatataaatgttgtaaaataaaataaagtgtaatgagaaaaccataaaattaacttaaaattaaaaaaaatattgacttataagtataagcatatgagaaacgaggagttcgtaagttcctgacaggagtaacttagtactatctccatattttaatgtatgacgccgttgactttttgtctaacgttctaacgtttgaccgtttatcttattaaaaaaatatgtaattatcatttattttattatgacttgattcatcatcaaatatcctttaagcatgacataaatatttttatatttgctcaaaaattttgaataaaacgaatggtcaaatgttggtcgaaaagtcaacggcgtcatacattaaaaatacggagtgagtagttcggagagctgagcagtgaggccagcagcatatgtgtttacccatgttctgcctccacctgcacacccactcctttgaacaaattcttatccaaacgtgtatttagaagttgggttttttagacagtgagggtatagtttttacttatgaataaaagccaggcttattaatccgtagacaagcacatccttaacaagtactagtatttattcgtctgctagaatgcattaaggggatattggtggtgatacctaagagtgccacgactaagcataggtaaattatagtatgaagtacgagaaaaatattggtcaaaagtgttactccatacaatactttactctaaaattaaggtagaatctaaagttaaaaagtgtggtataacgtaaatgtggtaacgaaggtggaatctaaagttaagaaaatgtgttataacgtaaatgtggtaacgaagtaaagacatgcttctaaaaaagaaagtaaagaacaatggtacgagtgcacgacgactaaagtgtgacgtatcaaagcaaaggaacggaccaaaaatacactgaatcttaacatactccctccgtccaaaaaaaaaagacaaaccttagtttttcgtgttcaacatttgattgttcctcttatatgaattttttataattagtattttcattgttgttagatgataaaacatgattaatatttaatgcgtgacttgtctttttaatttttttcataattttatcaaataagacggatggttaaacgttgaacacgaaaactcagatttgtttttttgggacggagggagtacaaatatacacgtgctaagagaacaaagtcagattttgccagccaggtgatggtgatatcggacatgtcactgtacatcagaaagctaaacagtggattggtgctggttgactcgcagcaggagcataattaaagcagtacggttattttgtgctttgtggcgacgaagaggcgtacgtggaatctcgcttgttggtgcttggtggcaccggtagaggagggcgaccgccgccgccgagatgttgggctcgtgggatttgagcccgagctggatgggccgttcaatctgccggagtgatgggctactgggctagtgcatcactgtttaaaactgatgaagataaaaatgaattcaacgtacgtaaaacgagaaagctactaggacataattaattaagttttaattattattaaacttaataaattaatatattcaatattttaaagcaatttctatataaaaagtagtcgtacggtttaaaaaacgtgctaacgaaaatcgagaaaaaaatatgtatctttatgagaaaaaaacatgtggtggacgctcacatgttcttttgatgtgaccaaatggcacatcactcacgtacaagagaaagtgtagaaaagagggtatgttgaaaatcaaatgtctaaacggagaaatctacaagtatataataatccttccattttatattataacattctttgaccttttctaattcaaacttttttatatttaatcaaattataggaaaataacaatatttacaacattacattagtttcattgaatctaacattgattatatttgagttaattttactttgggccaccttttattaccgatgtttcgctttggaccaccttaggactaatgttttcactttggaccggatatttttacctttatttcactttggaccaaccttactcttttattcatctacatccaacttgtaatatgttgaagaaatagtcttacatatagctgtggcagctcattgacgagtatgagacgatgtaatggagatcgtttatatgcttgagaagagagtcgggtggtccaaagtgaaacaaaaggcaggtttacccagtccaaagtgaaaatattgcttaaagggtggtccaaagtgaaacatcggtaacaaaaggtagcccgaagagaagtttactcattatattttaatagtattttcgttttgggttgaaaaggttgctaagtttctctataaatttggtaaaaatttaaataatattaaattttaaaaataaaatgtttcataatatgaaatgaagggaatatagaaaaagaggggacagtttatctgttagagtgctctctcctcattggttgtcatgagcgctaatcatccttgttagcactaacacacagcaaaataagcatggcatttagctgtccccgggtccattttccatttttaagaaaaaaaaagggaaattccatgggtcctgactagagagactatagagtcctgcgtgcatcgatctagggagtaaacgaacaacaatgtttcaaacgattctgtcgataaaattttgtcacatctacctaacacaagatatataaaaaaaatcacatacaaaatggtttgcaatggagcaattaataatgattttgttgtaaatgtatatgttatcaacatgtatgttatatcgtttgttaattaacatgcggtacccttctactccctctgttccacagtgtaagttattttagcatttcccacatttattttgatgttaatgaatctaaatagatatatatgtctagattcattagcatcaatatgaatgtaggaaatgatagaatgacttacattatcaaacggaggaagtagctcttttatcttttgtttccccctccacattacaaatatcctacgtgttgatctcccagacgatgacatcgtatcattattcttgtccctctgatgttattttcttattaacgatatccatggaacatatttttttccaactaacttaaaaatgttcatcattacgatagtccttaatttattcgaagataaacgtattagagtaaccggattacataatatgattatgaaccattgtaccacaatccgtgcatagcattgtagtggctattatataaggcagtgtacatagcagaagatgtattcataacatatccctaattgttgtggccgtttattttgcctactaatagtcatacattttgacgtgatcatgttttaccaacaataaactatgcccattatatagttttcaataaggagttcctattggaaaatttgtgtctcaccatggacagtacatataactacacgctgcccataccttctaactccactcgttagctcatcgattggactgaagtaacaagtacaccagtcataggagtgtagctagggttgaggaggaagagggagagggagagcacattgatgcctatataaaagatggcataacaattagactatgaatggatgacaaggtaatgtaatagtgtcactgtatgttagacaaaacttaatggattatgggtagacttgatggtgaagctaatatatcttagcaatcagactagagtagcgggtcgattatcgatcacacatcaatggtgactacatgaaggctctatgtgttataaccgtataagcacaatacccacaacgaggttggatacgtgggtggaggcgtaactatatgaagacaacactacgtaactcgtggcagatcagctcaaaaaggaggagaagccattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagagatggacgaggcgtgggagagggcggtggaggcggcgctgcaggccgccggagaggggagctcgtcgccggcgaggagcctgacgctggacggcgccgtgaagtgcctgcacggacggctgcccgcggcggagattctggagcggtaccagagcctggagcacctgtcgatcgccggcgtcggggtcgcgtcgcttgccgggttccctcggctgcggaacctgacgcgcctgacgctctccgacaaccgcatcgccggcggcctcgaccacctcgtcgccgccgggctggcctcgctccgcgacctcgacctcagcaacaatcgaatccagacgtcggcgacctctcgccgctcgccaacctccgcctcgtctcgctcgacctctacgagtgccccgtcacgcgggtcaaggattacagatccaaggtgttcggcatgatccggactctcaagtacctcgacaagatggacgccgcgagaacgagaggccggagtcggatgacgacgacgacgacggggatggcgacggcgacggcgaggaggaggaggacgacgacgatgacgaggatgaggatcctggcagcggcgaggtggccaacggaggcgtctcccacccgcgcggtggcgtggcgtcgcacccggtggaggtgaacggtgtgatcgatgtggacgaggacgagagcgacgccgacgaggtcgtcccgaacgggggagacgaacaccacgctaatgggtttcgggtcgcggccgttggggacgaggatgaatatgtggaggaggaagacgatgatgatgaggaagactatgaggaggaggatgatttgggggaggagatcgatgaggatggtgatgacgaagacgctgttgttgaggtgcatgatgtaccaagtagcagtgatgaggaggaagacggcatcgaggaagaggatgaggaggaggacgaggatgaagaggaggttgaggatgatggtgaggaggctgagccagagagcagcgggagggtcgctttggcggtgggggacgttggagaagagattgatgggcatgagcacggagagggggaagatgaggatgagaacggtgagattggagaggaagatgaggagagattggaggatgatagggtttatgaggaggggaatgatgacgacgaggaggatgtggatgatgaggtataacacattttgcattaatttctcgcaagcgtatcaagatctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgtctttgctattcgttgcaatgtttcgtagtaacggtagcatcggtagtcgtttatattcatgttctagtaaaattgatattaaccattctcagttgcaggttcttttttttttcaggggatttactagttcgtgcgttagttatgtgggtgtttgtttagtctacttattataagtgcaacattttttttgtcatgctgaagtagataacttcaattgttaggtttcctttccacaatcacctttttggtgatgttttacactctgaaatagtgtcagggataatcttctttacctcagttacttagcagcagggataaaatcatttttacctcatttactgagtgtgatacataggagcagttcagagacttatgtgtgcgctctatcattattggctaatgtatccgtgtgatgattttatgagttgtgcattagtactttgtttgatatgctgcagctatgtgcacaatctttttgaaaattccagttagacccaaaaatgacaggaaatgtgagaaattagtgtttcagatatgattagatagatactgtatgacagcagagtttagtttcttcatgtagaagaaagagaaggttttagttatctcttttatgccctattttcggatataacaaaagattttgcatctgaagtttttaaatttggcaattgcttaaaagaaaaaaactgatacatctatgaaacctgggattttatatgttctttttaccttatttgatatccatatctatgtatgcttagtaaatcactagtgtttctactctaatttttattgatatatttctgttttagtagtgccagatgttttgtcatgcatttatttcttttggggctatcttaataatgcattatttcattatatatccctgactgtgtaagtgtgtacagacctgtagttcttctatccatgagaacatgctttagtttttgcctatgttatctggccagtagaagctcttctctcatttgtgaactgtgcaatttattcgctgctaaatatccttgtagatagattttctcctgtcatgcttgttatggcccattgttttgttcattgtgtaacgagaaggccttcctttctgaatttcatcttcttaaatccttcgagaggtggttgatactgcttttttactttcactattgttttagtgtgctattcttgcttataggacatttaatttattgttaagttgatcttttgatgtaaatattgctgatgtttactatggttttgaaaccatacatattttctttcagtggtagagacgcttattgtatttcagcaattgcatggttactttgcctatgtttttcattgctaatttattgctgcatgtatgttaaaactataaatcatggagtaatttgtttgactctttgggcatttcacttagtgagctgtttatgatacacatgacttttatgtttgaggtttttctaaaccctgttccagaatgtccttcctgttaatgactatctctaaaagcagaattgtggaaacacaggtctaatgagaattcatccaattttgcatttcctcaggatgaagacacagaatatcttgttcaaccaattgctcaacctcaggccatggcggttggaaacgactttgatgcagctgaggctgatgatgctgatgaagatagagatgaggttgatgacgatgatgatggtggtacggacctgccctcgtcctcgcagggcgctaagcggaagagagatgatgatccatcaggcagtggagatgacgacgaggacgatgatggtgtcgaggacctgaggcccttcaagcaccactgaccaagcagcaatgtacatggatcccttcctccccctcttctcagctagaaagaaccaagcaagcagcagcaggagcatcagcaaacagaaatggtgggtttccccctgttttttcttagcgtttttcttgtaaagactttggattgagagagagcttcttcatccagccttcctcttcaaacatcagattttaggagggaaaatggagatacctgtgtagcaacttagcaagtagccatggcagctcagtttcagtttcagtttcattgtctccctagcctgcaccatctcttttgattttcttttttccctccagaatttcaaatggtagttacaagccccaggtttccctccaccctttcaaatttctgttacattggcagtgtagccgatgtattgccaactctcaaaactgtagtttccctccaaaggaaaagcccgggaaatgccccccctttcaaatgccccctcaccctcagtagccgttgctccccctccaatttgaatttttatacttttgccctagttggttgaactgtgttgctgtgtgtggtaagagtttctcactggggagtgtggacgacggtgccaccaccccggggggggcttctgtacgcgggcgctgcgtgctttgagataggtgaaacggctgtggttgcagcgatgcggaggcgtccgcggccaaccaacgaaccagccacctctgtgggcgagagggcgggcaactgggctcccggtgctcgcagcagtaagagccatttctttaccaatttttggaccgagcagatgcagcagcacagcccg

SEQ ID NO: 64509 - DNA, 1397 bp, Oryza sativa
  unsure (1)..(1397): unsure at all n locations
atagatcataaattaagttaatggtaaataatataatttagtaaactttattttcaaacatattagagctatttttagttatttatgattataatgtgatatatgacactataacatatgttttcatgtttttttttgtctgtgagatataacgcaattggtcaaatcgatatgaactgatttaattctaaagaatataattgtggtcgaataaaaaaaattgtatatataatttaaaaattacaatagtttatttattatttatatactacatttatctcaaataatgtatggaaaaaaggagttaaggagagggaacaggggctccacattatctgcaattagtgagtgtggctagttagttacctatggtggaacttacccacctaggtttaacatctagacttgacatgggtcttatatttatggctaattattttttagtaggcaacgtttctatcaatagcgaggcgtttatgatgacttcactaatttgaagatatatgattggctcagtctctcgaatatgttttctatagataagtgtacgcgtgtgtatataaactcatgtgtttgtaatatgtttctcctaaaaaggcggcatgcattacctttccaaaatgattatctaaaaaatcaattaacaaatttctggtggcaaagcacgcagcatcaagacgtcttgactaagtgctcaaaaataaactgacagcacccaaatacccgatgttaattagtgaatatattgtccaagaggcaagagctttgatatatcgctttgttgtagaagctagtagcaacagatcagaatacgaacaacatcaccgaggagtagtataaaattgtaggtaaaaaagcgaaattatatgcttaaaaaaatagagaagtggaaggctatgttaagagatcaaacaataaaaagatggaagttgctgcttgcatcactcacctgtttgatacgattaggattgtttcaaccttggttgttgctgctcgttcctaaaaaaatgtagatggatgtcgttaatattggtcgaaaaagtaagctagaggcgcattgctttcttttcctatggctttgcatctgaaaatttatttgttgatttttttttcgggagagaaagaactgattctctgcatttgtttactcctaattaattattttggtgggaccaaagcatgaaaccgtcatatattatggaggagagatgagaatttaatgtagtgagatttagcatccgtgaaaatttcatcaggccctggtaatcaaacagaaacatgaaaaattcagaaactaactattgagggcaatattcatgaatctgaacctaactctgtaaatagtttagagcagttagtgatattcacttttttaacgcanaggtgatattcactta

SEQ ID NO: 64510 - DNA, 1911 bp, Oryza sativa
agcggggaggcgcttgaccttgctgacgccttggcttcgggcatttatccgcaaagtgcccgggctggaagcagttgaagcacagacgctgctgaccttgagcgtccctgcggccttgaccgggctgcacagtcggcgtaggaggacggggcgcacgagtcccttgctgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgctgattgcggaaattcgccaagcggcgcttgtgcgactccagttccttgtgcttggcctccaagcggatgctcttgtccaccaatcgttgaaaatccggatagtccccagagactagacggacggacagctcggggtccattcctgccaagaacttctcttgcttctcctcatcttcccgcacatcctccggggcgtaacgggccagattgttgaactcatgcaaatactccatcacggagcggttgccttgcttcaactctcggaattcccttttcttaagagccacgactccagcgggcacatgggtcctccggaaagcggcggtgaagcgggcccaagtaataggttgcccctctggctgcgtagcttggaaatggtcccaccatagagatgcgggcccctgcagctagtgggcggcgaagatgactttctcctcatcgctgcactgcaccgtgtctagctttttccccacggcatgcaaccaatccaacgcatccacggggttgttggagctagagaaggtgggtggacggatgcggaggaactcggcgagtttagagtgttgtgggggtggtggtggagcattctgttgtggtggattttggaggtggtggaggaaagcagtcatcatgttggcctgctgggcgaggatttgggtgagaatggcattggtatctggtggtggtggtggaggcggaggaggaggtggaggtgggttgcccgggtggttgtggttgctgccttcaggttggttgccatcaccggtggcagcatttctcctggtcgtcaccatctgaaaaccccacacagaaccagcaaacagagaaagagctaacaattaaaactaaccacccacgactaccataattcttgaatttattactgctattaaatgggttcattaaagttcaagttgcttaggcaaataaaataagacaggctccgacacagttatgccacacaccggcatgaccatgccccacacgactcaaacaaaagacaaacaagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcgacgcttggggcggcagacctctccctgggcgatcttgagctgatgcagctgcacctccaccgcgtctaggtccttcttgagctgcaggttctcctgacgcagctccaggatcttcaagttgttctcgaccatcccacggtgtaccatctggtggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatgacgaggagag

SEQ ID NO: 64511 - DNA, 770 bp, Oryza sativa
  unsure (1)..(770): unsure at all n locations
agcgcattgaatgactatccgctggnacacnancncatcagacgccatccgttgactcctgcatccagcttcgccaccacagcttgagtctccgcttgcttgttgttcaacgacaccagcgactcctggatctcggccaaaacttttccgaagtcgttgttctgcttctccatggcctccacatgcagctgcaacctagaggtgtagcgtggtttctccaggatgagtgctctaataccaaattgtcacgaactcacttctctccgattcgatttactcaagtagcgaagaagtcagcggatagaagtttcgtgaggaagaagaagagcagagctagaggaagaagaaggagaaggaagcagaggagagtttgaaatattggggaatagtttgtacaatttctttcatgtcccttttctctcgaccctgccgatcttatatagcaatgagctattagatctcactctctgacccgtggcccggcaaacatcaccgggtccactcactatgagggaatttacttgtgggcctcctcgcctgagtggatcgcctgatttggatgtcttgagcttctggatcgcacggtgatgacgacgccgtgacatcggccccttgtgctcgcgctggtatgcgtggctcctaccatgagcacttttcttggctgctgtttcactcgcgtgtgaatcgaggaaagaccggagcagagtaccaactacttttatgtaagtatttgaaatttttatgagctactcccttcgtcccacaggata

SEQ ID NO: 64512 - DNA, 1643 bp, Oryza sativa
  unsure (1)..(1643): unsure at all n locations
tttaaaaagtgggaagaaagtaacaaataacggtaaattgacgggcaaaatagaaattagacatacctaacattgttttttttttctttggcttgctttacagttacctggaaaacctgaaaaaacctagctgatcaatcaattttcaacggccgcgattgctttaagatttatgtgtggattataatccttttccctccttcctcttctccccatttccacctcagcctgcccgccaagatcttcacccatacgccgctgtgtactataccggcgacgcccgtacaagcgtgtcgtcatcgagccatctcgacgagatttcccagccccgccactcattcgcatctccagcagctctcactcctaacatcacctcctaattatttcggtgagattccactatacatattgtcgtcgcactgcccatgtcctccccacggatgagacaccgccgccgcccgcaaccactgcccatcacctagccgccactgccccgactatttctctctgccccaaaatccctcctatacctacattgtcctcccccaaccccctcctaccttggctcccacgcaatacctaattcggcgtgccaccaccgtcgctgaagaagaacccatgtcctaggaggacaagaggagcacgaatcatagcgcaaaaatcgacggggggaaaatttaatcttttttctcctaatgaatagcaaaggtgtttttctctccttcatcctctttctttcttcccatattgagacctgcgaaggtgattctagcgtgtaaacactcacacgatggctgtgtccggtactggaggatgggaacctatcccctccacacggaaaacggagtggtccattagctcgtgattaattaagtattagctaatttttttcgaaaatggatcaatatgattttttaagcaacttttatatataattttttttgcaaaaaatataccgtttagcagtttgaaaaacgtgtgcgtgaaaaacgagatggaggacttgggaaccggggattccgaacacacccatacgtgcttcctaaccctgcttggtgttagctagaaaacacaccataagtgcttctaaccctgcttggtgttagttagaaatattacggctctattcgtttctgattaagatataaattttaccttgattttcgttagcacgcttttcaaattgctaaacgggtaaaaactttctatatagattttgctttgaattatcatataaattcatgttttagtttgaaataattaaaacctaattaatcatgcactaatggctttctcattttatgtgctcgtacttaatcttcatcactccatgagaggtatatctattatagtattaaaatagtcttgaaagaaagtatcacgtttgctatgctggctagaaattctcacattagtcggagaaaaagaaaaaatgtttaagtaggaatacatttaaaaattattgaaatttggaatgagaaataaggaatattaaaataagagtccatataagagttcaagcagaaatacatttaaaaattacaataataaataaagaaataagtgctcatatagaacacaactagagaatgatgaactacttgcagtaggnggcgagtcaaagtagannttcaatgccgccg

SEQ ID NO: 64513 - DNA, 9638 bp, Oryza sativa
ttgtgtcttgtgggtacagtggtacacctctgatcagagtaaaactattcgaatagctgtgcccgcggttatgggcgagtctaacaatgtctttcgtgattagtcccacacttctcatcttagtaaatgatgctttaactggtaataatttgattagctcctggtttggaatggtatattcctggtttggagatagaactgtgcagccgaggtggttgtttagaatggttgggcctatacaacagggtatgttgtatagcgttggattaatattgtttaattattacttaacggtttgattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacagtgaagctgatggagtggaggattaggtgtagccttggtcaagctgcctgtggagtggagccgtctgcgccgtttatttctttttccgctgcttagatatttattgtttgagaggaactatctacctctgtaatgacactttatacgcttattaattagagtaataattgtactctattatcaatttgttattgtgtgcctcggctgattcctggacgagggttcacacacatgtaagcgtttggaattttggatagaaattccgggcgtgacaaaagatcatactcagagaatgtgcgtggattatcgagcgttgaatgaggtgattatcaagaataagtatcctctacccagaattgatgacctgtttgatcaactggaaggtgctacagttttctctaagatagatctccgttctggatatcatcaacttcgaatccgtgaggaagatataccaaagaccgctttcacaactcggtatggtatgttcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtccggaggagtggcagtagatccaagcaatgtggagtcagtgttaagttggaagcaacccaagacggtttcagaaattcgtagtttccttggacttgctgggtattaccgcaggtttattgagaacttttcaaagatcgccagaccaatgactcgtctgcttcagaaggaagtaaagtacaagtggacagaggattgtgaacaaagtttccaagaattgaagaaaaggctagtgactgcgcctgtgttaattttgcctgattcgaggaaaggtttccaagtgtattgtgatgcatcccgactcggtttgggttgtgtgatgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagagatgtatacggatcataaaagtttgaagtacattttcactcaacctgatttgaacatgcgtcagcgaagatggttagagttgattaaagattatgatatggaaatccactatcacccggggaaagcaaatgttgtagccgatgctcttagccggaaaagctactgtaatatgtcagaaggtcgacatttaccttgggagttatgccaagaatttgaaaagttaaacttggatatagtcagcaaaggttttgtggctactttggaagctcaacctactctgtttgatcaagttagagaagctcaagtgaatgatcctgatatcccagaaataaaaaagaacatgagaagaggaaaagccatcggttatgtagaagatgagcaaggaactgtgtggttaggagaaagaatttgcgtcccagataataaggagttgaaggatactatcatgaaagaagctcatgaaactttgtattccattcaccctggaagcactaagatgtaccaagacctaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggtctacccagaacgtcggcaggacatgattctatttgggtagtggttgataggttgataaaagtcgctcacttcataccggtcaaaacaacctacacggggaataagcttgcagaattatacatggccagagtggtatgtttgcatggcgttcctaagaagatagtgtcagatagaggtagccagtttacttggaagttttggcagaaattacaagtagagatgggtacccgtttgaatttcagtaccgcttatcaccctcaaacagatggtcagacggaaagagtaaaccaaattttagaagatatgttgagagcctgtgttctagattttggtggaagttgggataagaatttgtcgtacgcggaattctcatataacaatagttatcaagctagtttgcaaatggctccgtatgaagcattatatggccgaaagtgccgtacgccgctcctttgggatcaaaccggtgaacgtcaagtttttgggacagacatattgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagggaaattggcaccgtgtttcgtgggaccttttaagattgtgagtcgaagaggtgaggtagcttatcagttggaattgcctccgtcaatggcgggaatacatgacgtgttccatgtgtcgcagttgaagaaatgtttacgtgtacctacggaggaagcagatcctgatcgtatagagcttcaagaagatttaacttatgttgagaagccagtcagaatcttggaagtaagcgagaggaataccaggaatcgcattatacggttctgcaaggttcagtggagcaatcattcagaagaagaagccacttgggagcgagaagatgaattgaagtcagctcatcctcatctcttcgccagttcttctgaatcacgaggacgagattccgtttaaggagggtaggtttgtcacgccctaaaaatcgtctaatgtaaaaatacattgtttaaatcatttttagaaattattttaaaagcctacaagttaaaccctaattatctaggaaaattttcagcataaaaatgagctagataaaattttattaaatactttacttgttcctctattttctagatttttctaggaattgtttgagcaagggaagtatttttaataattgaaacaacaattcacaaattatttttattcaaaaaagttcaaaaacccctccctaagccgttgggccgaattcggcccaacattcctctctcttccgcgcggccgaaccggcccaagccggcccagccgacgccgcccgcccctcctcctcgggtcaccgacatgtagggcccacatgtcggacccatcttcctcctccagccggccgattgccaggccgagccgtccgagccgccgtttgcaccatcgataccgccgccctcggtcgcaatcgagtccgattgttaggggggtttttatccccacatcttcctctatctttcccctcaagaatcggagcaaatggttgtgtatcttgtccgaatcaaactcgttttgattttatctctgcaaactaacccgaagattttccggtttcgattcctctcgtttggagtctgatctcttcaatccaaggctataaataggaccccccagttccctgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacagagacaaacgagaaacagcggaagactagggcgacgaccacaggcgcttgacggcaggcacgagctagacaccaaagccttcatctttaaggagctcctcttctgggcttgggaaaaaattgagcaagactgagtacaaccaccgtactcaacaagacacacccacaaatgcagaataaatgcaagggagtacaaaggaattatactataaaggggttagggttgcagaaaacagcatttaaagacatttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcgcgcggaccgggtccacgggagtggggcccacgcgtcagcctctcggtccacggtggaccgggcgcacgcggctgacgccggccggcgccgtgggtcccacgcgtcagccgcacccgcgggcgcgggcggctgacggccgggccccacctggcagctgcggggcgcgcccgaaggcggccttgccggcacggccgacgggaggcggcgcgcccgcgccccgatggtcgccgccggcgaccaacggcgcggcggagcggcggccgagagaggggagggaagagggaaagcgaacggcggtcctcggctcaccccgggacgacgagggcggcggagacgacgaccggagcggaggaaggcggcggcgcggttcggatcgacgaggacggcggcgctccgacggtcggcgggcgaaacgaaggggtggacgaggttgacggggacgcggcgaagccgaaggaggtgacgccgagacgggaggaggtccggagcgacgacggcggcgaaccggagctcggcggcgacggcggagagagagtacaacggcgcgagcacgaatccgacggaaagagcgagcggcgagtggcggaaacggaggagtgaggcacggggaacaattatatagggacgggagcgagagagggcggccggggaggaaggaaaccggcgcggcgatctcgggctccattgatgcgccggcgaactttgcgggattgaatccgagcgaatccgagggagagagagaggggaaagtggggggaaagagggagggaatcacggggagtgatttccccctctttatggcgcgcggggacggcgggatgcggcggaatcggtggcggcggcggcgctagggcacgggcggcggcgggcgcggcgcgaggtaggcgatgacaggtgggccccacccgtcagcgagggtggcgggcgggcccgcccgtcagcggcgcgcgcgcggggaggaggccgatgggccgcgggggagaggagagagagggagggagttgggccgagccggcccaagagaggaaggggggggggggaaaaggacttttagggatttttctttttataaaacccttttaactttgtttatttcttctcaattattatttgtgctctgaaaatttcactaaaatttatttacgcattttaggcttttaggaaatatacaaaaatcctccaagccttatttgacttttatatttgcacattttaattgttggaggctttcacacgaattttaattattctcggcacaatttcgaggatgtattttagagtcgttttaggacgcggcaaacctaccccccttaaacggaatctcgaccccgagattcggaagaactggcgaagagatcgggatgggctgccttcagctcgtcttcacgctcccaagtagcttcttcttcggcatggttgctccactggaccttgcaaaaacggattacccggttcctggtcctgcgctccatggtgtccaggattttcactggcctctccacataggtcaagtcttcgcgaacttcaatctgctctgagtcggcctgctcggatggcactcgaaggcatttcttgagttgcgacacatggaacacatcatgcacgttgcccaaggaggcgggcagctccagctggtaagcgacttctccgcgtcgagcaatgatacggaaaggacccacataccgaggtgcgagcttcccttttgtctgaaacctgtgtacacctcgcaatggcgtgacccgaagatacacaaagtcatccactgcgaattccagatcacggcgtcggttatccgcataacttttctgccgggactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaactcagcataggggagactcttatcccaggtcttcccgaaatctagtacacatgcgtggagcatatcttctaggatctgatttagacgctcggtctgtccatctgtctgcggatgatacgcggtgctgaaatttaatcgggttcccaattcttcttggagtttcttccagaaatgagaggtgaattggcttcccctatcagatacgattttcttgggaacgccatggagactcacgatcctagcgaagtagagctctgctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttttccttcaagtctaagtacatctttgtactgcccgggtgaatggaataaggactctcgtgagcttcctgaagtatcagctgtttaagttctctgttatctggaacgcatacccgatttccgttccatagggttctgtgttcatcctctgtgaaaccagcggctttaccctgtttcatattcttgaggagtccatgcatgtccggatcattcttctgagcctcgcggatttgatcgagcaaggtgggcttggcttctagcgcggccaagaatccgcgaccaactatgcttaggttcagggcttccatctgttgattaagttcgggtggaatgccacggacgttaagagtgttgcaatggccctttcgacttagagcgtcggcaaccacgttggccttaccaggataatagtgaattcccacatcatagtccttgatgagttctaaccatctcctttgccgaagattcagatccgactgggtgaagatgtattttaaactcttatgatcagtatatatttcacagcgattcccaataagatagtgccgccagatttttagagcatgaaccaccgcggctaactccaaatcatgtgtagggtagttgccttcatgaggtcgtagctgacgtgaggcataggctaccacgtgaccgtcctgcatgagcacgcaccccaatccttggcgcgaagcgtcacaatacaccaggaagtccttgcgagtatccggtaagattaacaccggcgaggaaaccagcttttccttgagagtttggaacgccttctcgcattgcaggctccacacaaatttctcttctttcttcaacaactgtgtcatgggtcgagcgattttggagaagttctcgatgaatctccggtagtatcctgccaaacctaagaaacagcggacttgagtaactgtcttgggttgcttccaatcggtgacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatggtgctgatggtcttcttctgattgtgagtatatcagaatgtcatcaatg

SEQ ID NO: 64514 - DNA, 15358 bp, Oryza sativa
  unsure (1)..(15358): unsure at all n locations
agaaaaataaaaataagagttaagtaggaatacaatttataaataacaaatattaagaaaaattgaaagaacagtacatttagaatataaaatggtggcaaatgaccttatataggatagggatagcaggcaagccgtaaaggtagggtggtggcggttgatcggatatataaaagaaaaccctcaatcattactatattctatttttaaaatgctaacgacgattaaaaggataagaagtgggcaagccattgtaacgctccgcttttcgtgaggcgttaaaaactaactcggcaaaatcctaattgcgaaaattttcgttctttgtgtgagagtctaagttgtgccaaggatctcaatttaatcccgttgttccctctcatcgaaatcagaatcctccacctcgaaaattcctcttccgattcgagtctccgaaatcaaattccgaaagtcaaatccttcctttgaatcctcgccaaatacttctatgaatccagaattattcaaatcccgcctcgaatcctttccttgactccaccctattgaatcctttccttcaatacccaaatattccttttgaatcttttccatgactcctccttgagtttcccttgatacatccctaaaccctcgagtttgaatatcaaaattgaattcgaatccaaaccctaaatctctccaattctatccaaatcagttttctctgtaaaagtctattttacctccctcgtgatgatttgggccgaaacctgccgttggcccatctcttctcagctccctccatctccgcgtgcgccgcacgtgaccaccaagagagagagagcgctggctctctctcccttccctctctcggacgttctctcgctctctcgtcctcttcctctctctcgctgtttctctctctctctctcgcgccgacgccgttttccgccgtcgccgtccaaaacccgccaccgccttcgctcttttccgcgctcgcgcgtggccgaccggccggtcgttgccgccgtaagccctgccgcgcctgcgccgcgcagccgcccggttgccgccgcgtcaagccctggcgccgcctgcgtcgtgccctgccgcgctgccgccccgccgctccacgccgctagcttccaaagccgagagaggcatcccctgtctcaatcccctctccctcctccttttcccgtttcggcaagggtcaagccctcctttccctcttcctttcccctttttcccgaccaccgacgatgtcatccatggtcccagccgcttgcggccaaagcgcggacgctggtcgtgcgactgcaccagctcaccaccagctcgctctctttgaccgccaccaaggacggtttccctccctccccaaaccgacatcgcctccactataaaacccaagccgccccaaaccccttcttctctcgttttcgctcgccacactctcaccgcgccattgttgacgccttgccgccgctcccacctcttgccttcgtctcttcgccgtcgcacgcgtcggaggccggtgcgtgcgtggacgcgagacgaggactccggccatccctcttcttccccttccccggcccgaggccagagagctcgctcccgcgccgtcggccgctcgtcactgcgcccgtctcggcttggtagtgccaccctccgtttcccccttctcgctcgtcctctccctccctagctcgcgtggtagctcggctagccccccgatcacgcatggacgctgccccaggtctcgccgccgcccgccataggcttgccgccgttgccgcccgctcccggaggccgccgccgtcgccagccctcctcggcagtcctccgccccatccggtgccggaaatgagttccccgtgccccggagatgctccctcctccttgaatcgacctctcgtcgccccgccgcgatttccccttttgatctccggtgattgctgccgccgcaatccaccgtcgtcggctcctctcgcgtcgattcctctcgccgccacgctcccggggatccccttgacctccccctggctgccccaaggccgtcggccttcccctttgtctccgcgccgtgtcgccgcttccgccgccgcctaacgctgccgtgcgtacgccgccggcgaccatcgggtcccacgttcccgcgtgcgcatcgcggtcgcgtaccggttcggctaagcccgagcccgcgcgcccttcgcacatctcgcgcgcggccacgtcggcgtgccggcgagattggtcgccgccgccagccgccgtcgtttttcccccggctaatccgctccgttgaatcgattccccttggcctcctctctcttccgttgctaaccccccaatccacctcgccgccgttcgccggttcacgtcgctcgtcgacggccatcggatcagcctgcccggcctcctctcccttccccatccgacgtggcatccacgtggatgccacctcagccgcccggccccgcggagaccggtcaaaggcctcccggtccaccgatccaacgcgccgccttgcgtgcaccccgctcgcgcgagccgtgtcgccgccttgtgggtcccaccttgcgcccggcacgatggaccgcgtccaccggcttgcgtcgcctggaccgcgcctcgttcggccttgggccgcctccctcccgcgcgccggcccactcgcctcgaccgcgcccgcgcatctcttcgggccgcgccccttcgctcggcccaagtccaattaacatccctccatccttttctttttcagggatttaataaatcctatttcctttgtcccataaatcaattccttatttcaaaaattccataaatcttttcccttggtcccgcacgtccgtgactgccaataatattcttgagaatattatttctataaatttcataaatcaatttccccttgttccacaaatatcttcctttgcccagaaattccaattaaacttccaaaattcatatctctcgatccgtaactctgattgactccgttccacttcccgtatttccataaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcatgaagaccttgagcaaggcaagtcaccctttgatcaattgcccctataattgaaaagtcattattattttgtttgcaacttgcattattagaatcacacacacttaacttgcttggcctcggtttgcatgccaaaccgacggacctacccagtagtcgtactaatttccgtaggtcgtactaccctgaatccttgtcgctccacccttgtggtacctcggtattcgtgctctctgagcacgtataccaaatatcccacatacaccgttgcttgtcgaaaatttgggaaatgggtttgtgaagccttcaaaacccgacatgtggtgtcggtgtgtttgaaaataaaatgaattgtgaaaactcgcgatgcggggggttgtgcctatgtggcactatcccgtattcgcatataaggaccgattcctgtgggaaactcatcgaacataatcaaagtacaaccacaaggtggaatgggacaccctagctaagtaactagtcggttcagggaaacctcgcatgccaatagttgggaacgccggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaatctctgacaccggccagtgtttggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctgtgtggcagatggatgacctgagtggtcagaaacgaatctgtgtgattcgggatgtctgtgggcatcatagactaggcttcccgagtggaagcggattgctttgctgcggggcagctggactctaggagtctgagaaaatgaaaaaggctatgggagccgattaatcaagtggaatggctctgggagccgagaagtaatgatctgacccgggaggtcggtacattactaaatgagctgttgaaaaacatctcttaaagtcgaatcgagacgcaagtctctcttttcggcccaaacttaaaaagaaataaatcacttagtgatttcaaaaaaagtcttcaaataaaagatttgcaaaacaaccttgcctctcttccaagcttgcattaaacacctaagttcccgttacttgctgagtacgaaagtactcacccttgctctatatatagttcctccgccctgaagagaagataaagtgaagtgaagattagggtttcgtcctggttcccagccgtcacctgtggtgttgggtgttagaccgttggttccgctgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtactagcactatgtcctgggactggtaccgagatcacggtttcgtaggaagcggttcgcgccgttttccctacgacacgctcctgtcaggtgccgttgtacggcggtatcagattggggtgtgacagccatgaaaggagcatgctatgatggttgacgggacttctagatagtaaaaaaaaaactaacgataatcatcaatttttgtaatcccaataacactaaacaggaggatagcgagtggaccgtacaggaatacaataccgagttgtgatgagacttcttaaactataaaacgggaacccgactttgatgggacttcaacaattataaagcctgaacctaacgatataatgaactggaaaaactacatgatcgaaaatttaaaggtttcaagaagcatgaataaaagccttggtagattggcgagcaaataaaggagatgacagttggtgtgacttttaaaaactataaaattaaaacctagatattgataattaagatttgatctttaaaaatcatgacataaccatataactatttaataattcttaaagaaaatcatatgtaagaaaatataattttgtacagggtgctagccgcgcaattgcttgtgtgcatgaatttttttatttcatcatgaattgacataattgctataattttctataaaataaaacttaaaaaagttttaaataggaggaaaatcaaagcgacgaaggtggtactattcatgacaatttgtatctgtctgttaattttttgccataaagcatacacgcaacaagatggaaacacctactcctatgctgctactttccgctgacagctgtcatgccgcgtctgtccgacgggcggggctcgtcctgtcgtgtcgtccgcgccaacgacgccgttcatctcctcgtcgccgggcaagctggcaatggcgacggcggcgccgtccaagtccctccccttgccccagagcacggtgtacagccccacgacaatgatcacggcgccgataacactgcacacgcaccacgccgccacaataagcaaggattacaacagagttgtgagcaaacaatcgacatgtaattacagagtaatctgttcatcaagaacacaacgatgatcaatcatgatcgaccgcgcacgcgcctacctcccgacgtgtatcttctcgccgaggatgccccagccgacgacggcgacgacgatgagcatcagcgggctgaacatggacacgaacaccggcccgcgctcctggatgcaccacgacatcaccgtgcacaccatccccgacgccacgatcccctgcccatttatatatacacaggtgttcgatcagttccctctcatgtcgtgctaggacgtactgactgactctgcatagtttaatattaccgcgtagagcgcgccgacgagcctgatgtcaaggccgagctcccacgccgagaacctccgctccgccgcccccgcgatggcggcgcactgcacgctggcgatcaacgccatcagcgccgtgctcgtgtacgggcaagcgaagctcttggacagattcttctgcgaacaccacgaattaaaatccattcaccatttcccgccgcatgatcatcaaattaagttgtttgtacctggatgatgaaccagatggcccacgcgacgttggagccgatgacgaggacggcgccgaggacgacggcgtggccgccggcgtgcgcggcggcctcggcggccatggtgccctggacgtagggccagtggacgggggacgccagggtcctgacgagggggccccggtagaacgtcatgagcatggatccggccacgcacagggcggttccggccaccttggcccggccggcgcggccggcgacgggctccatcttcagcagcgccgccaggaggaaggtcaccgccgggagggtgttgttcagcgccgacgccaccgtcgggctgctgtacttgaggcccacgaagtagagcacctgattgagtgttgctctgccaagggacattatatgttttgatattattttggagtagagaatggacgtacgtgtcgactgacttaaaataggtgtagacagtcaaaatatacaggaacacttcggttgagttcattttagcaatttgaaagagcaactttcttatatttatatttcgttaggacgtttctcaaattgctagacagtgtgttttgaggaaattaaataaactgatttgtttaagtttgtgatagttaatactcaattaattgtgatgttcttgttttgtgcgctgcgaaaaagcataggcaatctgccttgtcgaagaaaccttaacccaatagcttgtagctcggtttgaaataaattattgagcggactgttattaataaatagcttaaaacaaattatttaaacaaaaaataatagatattttttgagaaaatatagttttcaaaccgtagagtaaataatcagattaataatctgaaaaaaaaacttcaatctatatatcctctatctaaaattccagccaaaattagaataaaacttaatgactctagtttctactaacaatttgcatccattctctttcatacacacttataatttggccagtactttttataattatatactagtgaacttatttgtggatacaatgatggttggttgaaacgccatttggagtaaaacccaaaaatatttctagttaattatgctagtcaacagatccattccagtaaaaaaaaaacaattccattccagtaaatcgaaatcccaactgtgcaattttgtcacataaaactatacacaagtacaccatcccggtccaaataccgttacagttctctatatttttcagctgtttactgaatgtaagtcatttaagaactattgtatgcacctttttatcttttacctcatattttccttgctaataaataatatttatcacacaaataatgattcatctttataatgcagcataaatataatataaaggagaacaaatttatttgaattcggagtcttttttaattcttttttcacaagacaaaaacaatctacatttggaattgaagggagcatacatgtgtgctaaatttatttcatcttaatcggagtagtggaagaatatctttttcatatatattgttttcgctatggttcaattgtgtgtgtgtgtgtgtgtgtgtgtgtaacttaggagcagtggttaaaatttggtataagccccagttaactcaatctttaaaattatggaattacatagcatccttctgattagttaatgctactattatccaagaaaggggaactggatcaaataacttcattgaagtacataaaatgaaatagtcacccaatgctggagcatatgaatatctggaataatatcttcttactaattgccctccaagttttcctgcaatcacacaagaaactcagtttaccactttgaattaatggcattaaaagtcaacatggttttggttgtacattgaaagatatacaggtaaatgagtggaattgaatacatcattatacagatataggtcatttagataatcagtggaattgcatacatcatatatgaaagtggacttatacaggtaaatgacaatattaagtaattatatgtaatgatttcgtttcactttgaatattaaagttggatatatctgaagactacatcaccaggtttagaatctatgtaacattcaaattttgtgttaaaaaataacattttggatacatgaagattacaggatagatcattttacttaaatacttgcaaaatataaatttataaaagctagtatatgtcggtggaagactggaagtaaaaaagacaaaaatgtattgaataccacaacagaaggaaataaactagcaaaatgaatcatagtggccactcaaaagtggcactaacgatatacatagggatcctagcccatatatcagtgtcttatttacgttccactccttatggagtggcaagtctgagagttgacatctccactatgctatgatagtagggaagtatatattgtatcaattacaccaatatatcaagagtaatacttcctccatctcttaatataagaaattttggaaggatattacacatcataattatactacgaatatggataggaatctgtccagattcgtagtattaggatgtgtcacatcccttcaaaatcctttatatatcaagagtaatactccatccgtcttttaatataaggaatttcggagggatgtgacacattctaatactacgaatctggatagggggtttgtccaaattcgtagtattatgatgtgttacatctctaaaaaaaatcctttatatttcggacgggggagaaaaatgtttaagctaatgaaaattgaaaacttggggaagcaccactgatatggtggtggagccgtggttgcataactccacccaccagagtttaaatcctggtgttcacgaatattacgcacatgaaggtggattttcaacaagactttagtcaaatcacggatatgtcgctgttttacatctcttagagcatgtgttaggagatgcattcgtcgtgggggtgtgagtgtggtgttgtgtatacagtggtgtgtgtgcgtctgcgtctgccgtataatttcaaaaaagaaaaattgaaaacttcaattgtcatgaatgtacctttcaacaaggaatgctatgggagcgaggaaggcggctgcgatgaaattccggtaggcgaggagaacataggggctcatgcccgaggccatggtcagcttggacatcacattcaaaccagcaagccccagttgcaccagcaccatggcaaggagaggcaagtaggtactcaaagtactagcttccatgtctagctatcgggtaagtacgtacaccctctctttctctcccaaatgttcaacagttcttgtgtacttgtggttaccaatgctatggcaacacacaagaattgttcttgggagagaaagattgggggtgtagaggcacaggctgagcagagaacatgtgttaatgtatactatatagatggagcgtacgcgtactttgtagatagtagtagtgcagctgagtgaaaagccagtacaggcgtttccgtttcatgtaaaacaaagtagtaaatactgttactcttaaattattcatttgatcatgaagatcatgctatctttggagacatctagcttatatttatctcttattactcctctctctactttgataatgtacatcctgttttgccacaccccattggttgtacgctccatattttcacacgaactgccacatttcctggtgaccgttgctggtcaattgaggagggaatgaatttaccatgttctaaaaaaaatgacctgcatgacaacgcaatctacgtgaagatgaaaaccagttcatttcattttattcatagatattaggattctccactaaaatattgcaagatttttttaatataaaaatatcattttgggtcagtcaattcaagcgagaatcaaatgttagatgttttgcttttattttctaagattttgtttctgattttttaattcattagagatggcatcctactagtgttttaagatcatttaatgacatctattaattgttatagaataaatagataggagtagaagatagatagacatacagatagatttattgaataaatcgacagatagatatgtagatatgtagatggatgcattacgccagatcctcacacctttgacagcatatttgtgacgggcataagtactgttggtcagtgatgaagatcacctttgacgggtcctaccggatgccgtcttcagtgagccatccggtttcgacctagtcacctgtgacgggccggaagtgaaaaccgtcaaaggtgaggcttacctcacctctgacgggttccattttcaacccgtcacaggtgactagctacctgtgacgggtcgcaaccggatggcccgtcagaggtgaagtttactcacctcaaacgggttgaagccctaacccatttgagtgagttgtgttactatatatatacccgatatatttcttctcccttgagataaggccagcttctccacttctgtgtattcttctctacttatccactctctctccctctctctctccacagacttctctcaatacacgcgccgagcaccgggttcggcagcggcatctgcttcctcctccaccggccggcgccgcctcccccggccaccttccgaccgtcggtcaactcctcctcccgcaccccaccgccgactgctagatccggcggtagccgcctccactgcggcctctccccaccgcagatccggcgcctctccaccgccggtcccctcctcctccgccaccccattgccgcctgccagatccggcggctgccgcctccaccgcatggttgggcgcctctccaccgccggtcccctcctcctccgccaccccaccgccgcctgccagatccggcggctgccgcctccaccgcaccgccaaccgtcggatccggcacctctccaccgtcggtcgcctcctcctccgccaccccaccgccgcatgctagatccggcggctgccgcctccaccgcaccgccaaccattggatccagcgcctctccaccgccggttgcctcctcctccaccaccccaccgccgcttgctagatccggcagcggccgcctccaccgcaccgccaaccgtcggatcctgcggcctctacccccgacagccggcgtcgtccaccatctcctccacccgctaatgccgccgccatttccaactcttgtaggttgtgcaaattttcattgccaaatttcagattgggttatactctcagttgcttgtgtagatttatagtttattactcaaagttgtgtggatttgtgatgtatagtacttgtgtggatgtgcttcatgtgtcaacatatctgtcaataaaatgcaaagttattgtgtcaagagagattttgaaatgttcttcatgtcataagatatggcttgtgggctgctaaggcttgagagctgagagctagaggctgagggcttttgatttttttttggttgcttttccacacctgtgacgggtggtgagttgaaacctgtcggaggtgtttatcacctttaacaggctgaaaagatccactcgtcacagtgacgggttattttattcggtccatcagaggtgtcaatcatcattgacgggctttcacccgtttgagatgaggtgcagtcatcagtgaccaagactaaatccatcaaaggtgagggttagagcctgtcacagatgactaggtccagtgtagtgatggttgcatactttcatgggaaaatatataatgtaaacctatataatgtagtataaatgtggaaattattattggataaaatatagacatatgatatttgtccatgtcatcttgagtaaactcatactcatgattaaatttaggagtaaaagctttattcatggtaacgtgcagatgtttaattttgtatcgaatggtaatttctaggtttgcattacatattttccctacatgcatgtcttgcattggataaattccacttcacatctcacatgtgtaagggtcgggttttaatcctatctctcaaccgtgaaaccagatattaggcatccctcatcttctaaaacatgtgtaatatagttccaaggaggtattgaggcatgttttggctaatgtagtattatgtgctccattggcatgagcccctatgtgtaaatgtagtccaaggtggtatttacactggttttataaagatgaggaatatgttgtatctggttttgtggttgagcgacacgatcaaaactcgacccatatatatgagggacctaaaacgaacttctccctctaaggagtagggacagtcagatacattgggccacaaaattaggcccactgaccaggcccacataataaacgagagaataggttgcgtcggtgctgaactgtggcggaatctcagactttggcagcattcaaggttgctgccaaaccactggccaatcagtgtcacgtgagtgagcggcgtgaaagttatggccgcacatcacaggccatctgtgtctaacctgtttttatgtcattgtgtcagataatgtttggattctccttttacataactttggccaatcatgtgtcctattaattcttcctttatgcatacagcatactgatactattagttcttaatgctacaagtgtaacactgctaatgattgatttccattattgaaaaaaaaagtgtaacattgctgaataacatgccatcacagtaatacattgagcaaaactaaaaatgaaaattcctgttccaattaattcccaatgatgcaatgtgctttgtaaaagtttcatctatagcgtggtgtaaactaattacacttgcttcgattttttttttaccttttaccaccccagcaaaagaatccaacgaactccaagaattgcagagaacctatgctgctatgctgccgcctgcaggtcgatctgaacagggaaggacagcgacagcgcgtcgtctccgacgaggaccctgctgactcccgacggcacgacggtgtacgccgtctcctcgacgatcgcgaacgccttgcacacgttgagcgcgaaggccacctcgacggcggcgcccgcggccacccgcacccgccggaacgccaccagctgcttccgcggcgcgccgtccacctccgccggcggcgccgtgtacatcggcacgacgtgggtgccgtccctgccgcccgtgttggccaccgtgacggcgaagctgacctcctcctggcacgcgtggctggccacgttcacggccgggcacgccggcggcgaggacaccccggccttgtaggtgagctgcttgcagtactcccacgcgccgaccttgaccgtgaccggggcggcggcggtggccgacgcgtaggtgaagttggtgtagctgaggccgtggccgaacgggtagagcacgtcggcgccgccgtagaacttgtaggtccggccggggtagccgtgctcggcgtccggccgcagcgccatggacgtcatcgggatcttgctcacgtactcgttcttgtaccacgtcagcggcaatcttcctcctacaaaacaaaaatgtttcagaaaaatgcattgaagaacagagaattaatctacatgtacactcgattctgtacctggattgtattttccgaagagcacgtcgccgatggccgtgccgccttcctcgccggggtagccggcccagacgacggcgccgatcttggggttgtcctgggcgaaggagacgtcgacgccgccggcggacatgatcaccaggacgatcggcgacggcgaggcctcggcgacggcgttgatccagctggcctggctccacggcaggaggaggtcttccctgtcgttgctctccctctccacgctcatgttcaggccggcgacgacgatggtcgcgtccaccgtcttcgccgccgcggccgccgtgtcgcacgatcccttgtcgcatgcgtgcaccgacgtcgagctgaccaccttccgtacgccgtcgtacggcgtcaccaccctgcaaggcttacctctgtagtctccaagcatgacgtcggtggcattgatgtgttgcagctgcccgaacagtgccaccgaattgaccttctccggcgacaacgggagcagcgcggcgtcgttcttgaggagcaccatcccctgcctggcggcgtcggcggcgagctccttgtgctcctcggtgcagacgtcggcggcgccgagggactctagctccgggatgccgtcgaagaagccgagcctcatgagtgtaaggtagaggttggtcagcgcgttgtccacggcggactccttgagcttcccctgccgaacggcgtcgacgccgtaggtggtgaagaagtcgtggacgccctcccagaacatgccgcagtcgaggtccaggccggccttcatggcggcggcggtggcctcgacgccggtgtagccgagccacttggcgtccctgaccatgacgcggacggagtcgcagtcggagacgatgtagccgtggagctgccagtcgcggcggacggtctccgtgagaaggcgcgcgtcggcgcaggccgggacgccgttgatgcggttgtaggagcacatcacgcagctggcgtcgccgtcccggatgcacatctcgaacggccgctcgaacgtctccaccatgtcgcgctcctggacgcgcgcgtcgaacgtcagccggtcggtgccgttccacgcgtcgacgtcgtacgcggcgtagtgcttgcagcagctggacaccttgatgggcctggagaacgcgtcggtggcggcggcggcgaatgcggcggtggtggcgccgtcgatgtcctgcattccgcggacgaagttgacggcgtaccggccgacgacgaaggggtcctcgccgggggtctcgctggcgcggccccaccgcgggtcgcggacgacattgatgttggggctccagtacgtgagctcggcgtggcccaggttgtacatggccctgatctccgtcgacaccatgatgagctnctgtaccagtggtactcactngccac

SEQ ID NO: 64515 - DNA, 855 bp, Oryza sativa
ctgcattatgttgttgaagttggtaaattgagcatcggcagattgttgccattcttgcgtttgtgctatgtgttccgtgaggttgtactggatctcccccgtctgcacatcaaaggtatccattctcgtagtgatttcacccaagtcccaacaagaggaacacgagcacaattcacttagagatggaggcacaccacttgatctgggaggttggtcgtccccccattgtatgtcatgaggcgcacgccatcggtcctcactggcacttgcccagcttgagactccgatgctgtagcgtggagcttgggtccatccgggtgcatccccagttggttcccaacctgtctcacgggtgttgaggatgatgagctttcccgttcatttcttgccatgttgcgcatctccctgtatgctccacctgcacgagattcttctatggtttgcaggggaatggttagttcacggcagttgtacaaatgataccccgcatttggcaacgggatttcatttgtacaaccggagaaaaagtatatcaaagatccatctactccatgtttcagaatatgaccttgcactagataagtctcatcaatacacggacgagaagctaagataaaagcaatttggtcgctaatgatccctagcccttttgctatccgagtaatcagagaagtgcagtcaacaagagcagagaactttatattctctaaccattgtcttatcatacatttcataggagcaatgttgttttttctaaccatggcaaacatgataatcaattcatcccccctaatggatctatgatcacctctagaaaacaaggtcatagcaatccatttatgcatgagcctaagt

SEQ ID NO: 64516 - DNA, 13884 bp, Oryza sativa
ggttatacttgtcttcctgacgaatcgccttgtccaccaactgctagaaatcccggaaatccgtagacatcaaagcataagacaactcatcattcagtccctccaagaacctctcctgacgctcttcatcggtgcgaacatcttccggagcataacgagctaaacggttgaaatcatggaggtactcggtgaccgaacgagatcctggttgagtgctctaaattctctcttctttagagttacaacacccgttggtatgtgtgtcttcttgaaagcggccgtgaattcctgccacgtaataggctctccttcagccctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatttgagctagcgtgggatctcctccattgttagcagctccacttccacttccacttccacttccggtgcgcgtgttcaccatctgacgataagcagagacaacaggaaagaacgacagagagacacccttagaacagagttatttaattaatttaaattctatattgctcttaactgtgtatgttttcatttaaattgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgatctaactaagcgactaatcccgccttgcgtcggaacgaagcgatggatcttcttcctctggagtagctggctctctttcttcagggtcttcctcttcttcctcatcacttatgatgtcgatgacaggttcagcacgatcgggcacagcttcacccatcacgcgaatcttcgaagctaactggagacgaggtggcggacaggttctttttcttgcgatgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactggaaagctgatgaatccaactcttcttcaaagtgttgacgcaactctccaatggccaccaaagctgcttcttgacaagcatggctatacgatcttcctccagcttcgaacttaatggacggaaggtcttcacgatcactagccaatgtcacacgaacacgacacttctcctcgttggggtcatgggaaatccggcgatcctcaggagcaacttcatagcctacctcaaaagccatcaacctcagctccctgacgaatcctaacaccttgatcaaatttctcggtgaatggggcggcatctaaagaaacatagaagagaggaattaatgcatatttttttttaagttagctgcaccatctagacttaactgatttgaccaaagaggaagaaaaaataaaagaaaagacacatactaagctattatatatatatatatttagaatttaactttttggacagagacaaataatttttttttttgacaaataactaaaataaaactaaaatacttatgatctattataagcacggtacagtgtcaccataagaaggatgagtagtactagtgctatcatgattgtatcgataccataatagatgtacagtgctgactaatcaatgaagtttactaaggcggaataagaaacattttgagaagaaaatttttttttcttttaaaagaaaagaaaatgaattaaattaattttgtgcataaccttgcatgtgcggccaacttaattaatttgtaagagaatagagaagagcagttctaatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtacaagtaaataactatttaatactcgcaaacaataaaatattacagaggtagatagttcctctcaaagaataaccttctacgcagcggaaaaataagactataacaaactacggaagagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaagataacaaaggatggcataatatagctcatttgtagaaacagcatttaataaatatttaagagaatggtaaaaacagttgaataattaatcagtattaaataacaccatacaacacacccatgttgcatagggccaacctcatatgaacaaccaaccccggttgtacaaatctaacctccataccaggaatataccattccaaaccaggagtcaaattgattatcacaattaccattaatgaataacatgggactaatcacgaaaaacattgctcaactcacccataaccgcgggtacgcctattcgaatagattaaactctgatcagaggtgtaccactgtacccacaagacacattcccacaacatgttaccatgcgccttagtaccaccacgatacctcggaaaggaactgtgacaataccccttgcataacacaactcaccacagtgcaccgtacctggatcataatcaccctctacaaccagaggcatggactccccagcgacccccacggacttctcgccgcttctcagtctggcactccataatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaaccaggttttaattatcaattaattaacatcacacgatcacccatcgtgagctaccatttaatgtaaccataattaaaataataatgtaacatagtctataattaatccctttagttagctaatgtttctaagcacggctaagcaaacttacatatagcatttagctgaaccaatccaacatataaggttcatgttaatcaaattataacccataggaaaataagatcatcttcggccgttaattaattgggaaggttcaccacccgatgacattcgaaaacaatgcatagttgaaataaaataatagctttaaacgggtttaacatgctcaaagagttgtttgggatctgtgtgacttgccttgggcttccgcaaacgcttcggaaccttcctcaacggaaatgctctcctccggaacgtcgaaaactaaagcaattaaacaaaaatcaacaaaacagtacaaaaacaagcataaacagtacatgtggatatttttaacatgtagatcttgattttagaaaaatttagcaacttgaaccacctgaaacggatctacgattatttagttatgattttccgaagatttaatctattagaaaaaaaaagaaaaagggaaagatgatgatgtcatgatgacgtcatcaatggcggccttggctcgggcggcacgaccaccggcgctacggaccttggtcgggcgaaaagagggcacctacgcgtagagggcaacaagacgaacgcaacggtactcaccaatgcgcccaacgacgaccgatggtggccggcgacgagaggaggcggcgcggcggttcggtcgacggcggcgacgggtctccggcgaccggcgacagcggggagagggcggccgaggttcctcacctccgtgcgcacctaacggcggcgagaggaagcggcggcgacggcgaaatcgatggcgcggcgcggctggagatcgccggcggcgacggcgagacaaggcggcgtcggcggcgagctacggggcacgggagaggacgggaataggggcaaacgaaagaggagaactagggggtcctatttatagccttggattgaagagatcagactccaaacgagaggaatcgaaaccggaaaatcttcgggttagtttgcagagataaaatcaaaacgagtttgattcggacaagatacacaaccatttgctccgattcttgaggggaaagatagaggaagatgtggggataaaaacccccctaacaatcggactcgattgcgacagagggcggcggtatcgatggtgcaaacggcggctcggacggctcggcctggcaatcggccggctggaggaggaagatgggtccgacatgtgggccccacatgtcggtgacccgaggaggaggggcgggcggcgtcggctgggccggcttgggccggttcggccgcgcggaagagagaggaatgttgggccgaattcggcccaacggcttagggaggggtttttgaacttttttgaataaaaataatttgtgaattgttgtttcaattattaaaaatacttcccttgctcaaacaattcccagaaaaatctagaaaatagaggaacaagtaaagtatttaataaaattttatctagctcatttttatgttgaaaattttcctagataattagggtttaacttgtaggcttttaaaataatttctaaaaatgatttaaacaatgtatttttacattagacgatttttagggcgtgaacaagctcaaggctagatatgtgccatcctctaatagctaatcattcactcgaacctatgatagattatataatttgtgatagactccttgtcacgcccggaatttctatccaaaattccaaacgcttacatgtgtattaaaccctcgtccaggaatcaaccgaggcacacaatgacaatttgataatagagtacaaataaataactatttaatactcgcaaaaataaaagattacagaggtagatagttcctctcaaagaataacattctacgcagcggaaaaataaaacgataacaaactacggaacagctatggcgactccactccacaggcatcttaaccaagaacaagctcaatcctccagatcatcaccttcactgaaaaactcctcttctgatgaatgaatattgcaagaatgagcatatgacatactcaacaagccacacagcaaatatgcaagtgcacaggataacaaaggatggcataatatagctcatttgcagaaacagcatttaataaatatttaagagaatagtaaaaacagttgaatatttaatcaatattaaataaacaccatacaacacacccatgttgcacaggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagtttaagctctgatcagaggtgtaccactgtacccacaagacacaaccccacatgatgtcaccatgtgcctcaataccaccacggtacctcggaaaggagttgtgacaataccccttgcacaacataacccattacagcgcacctttcctggatcataatcacccccttataaacaaggcctggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacctcacacgattaaccatcgtgagctaccatttaatataaccatcattaataaaaatataacatagtttataattaatccctttagttagctaatgtttctaagcatggctaagcaaacatatatatagcatttagctggaccaatctaatatataaggttcatgctaatcaaattataacccataggaaaataaagtcatcttcggccaacaattaactgggaaaggttcaccacccaatgacattcgaaaataatgcataagttgaaataaaataatagctttaaatgggttcaacatgctcaaagggttgtttgggatctgtgtgacttgccttgggcttccgcaaatgcttcggaaccttcctcaatggaaacgctctcctccggaacgacggaaactaaagcaattaaacaaaaatcaacaaaacagtacaaaaacaagcataaacagtacatgtggatatttttaacatgtagattttgattttagaaaaatttagcaacttgaaccacctaaaacggatctacggttatttagttatgattttccgaagttttaatctattagaaaattggaaaaaagaaaagaaaaggagatgatgacgtcatgctgacgtcaccccacggcagccggctagggtttgcgacctcgccggagctagggcgatcggccgggcaattggagggcacctacgcgtagaggacgacgaggcgaacccaacggtactcaccacaacgacaaacgacgaacgatgacggccggcgacgagaggaaggcggcggcggctcgggttggacggcgacggcgagctacggcggtcggcggcgaaggggaaggggcggccaaggttcctctcaccacggcgcacctaacggcggcggcggcagacggcggcgacggcggaggcggcagcgcgacgcgaccgaagacggccggcggcggcggcgaacttaatgcgcgcggcggcggctctacgatgcacgagagaggacggaagagggggcaaacgaaagggggcgatgagatggtcctatatataaccttggattgaagagatcgaacttgtcacgcccggaaattcactagtaatttccgaactaatttgtgtataaaatcctcgtccaggaatcagccgaggtacacaaactgacaatttaatatacaaatccatcataataacgttacatacttacaaagaaaagaaaacagcagcggaattaacggtctagcgatggcttcagctccactcccacaggcagctcaactggggtataagccaaacgtcttctccttccggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcaccaattttaatcaacactgaacagcacacccatgctgctcaggcccaaccaaacctgaacaaccaaccccggtcatacagatcaaacctccaaaccaggaattatccattccaaaccaggagtcaaattaattatcacattattaatattgatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgtacctggatcataatcacccccttataaacaaggcatggactccccagcgatccccatggatgtcacgtcctgataaattcatcccgaaaataaaaatcattctctaaaaggaataatagaattaattaaaattcgaaaagaaattggcaaacactaaaatacgtgcaagaaaaattcaaatgtggcccggagaatttttgttaaattctccttggtctaaaaataagccctcaaattttacttgaattttcagagcaccggaaatatttattaaacaacaacatttatcaaagttcaataaaaagaaaacctaaaaatccctcctcttcctcctttgggccaagcccagcccgaagtccttccctcctccctctctttctctccctctccttctctccctcctcttgggcctcctcccctctcggcccagctccctttcccccctctctctcccgggctgcctctttccccccccctccttcccggcctgcctcggcccagccgcccggcccaagccgcctcccccttccccccccctcctgggccggccgcccggcccaacccgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagctcactccctcctccaaatccgcttgattcgcttggttaattccaaaattaaataggggaaattaatccccattgactcctcttcatttccccctaatttcccctttgaatgccgcccccaatcgccgggaacggccgcgccaagtccggccgccttccattgccgccggccggcttttccgccgccgttccgacctcccccgtggccggctccctcttctctcatataaaatagaaccccctctttacgttctaccgttttagcctcttcccgagctctcccgtggtctctagccacctccccaccgtcgccctctctctcccacgttgccggccggcctccagccgcctctcccgcctcgccggagcgtcgtccggccgcgccgtcgcctcctccagcgtcgccgccacctcctccaccccggcttgccctccgtttcgcgaggtgacccccggagctgcctccccgccgtcgcccttctcgtttctccgcgccggccgcctccagtcgcctctcccgcctcgcccgtgcgccgtccggtcacgccgtcttctccctcggcctcgcagccacctcctctccctcggtcagccctctgtttcgcggggaaaacaccggagacgcgtcctcgccggcgtccagtggcgtcgccaccacttctccgcctccggccgcctctgccgcgtccccggtgcgccggccgacgtcgccaccacctctcccggcaccggagtgccgtcctctctcccggccaggccacggcgtcgcccgaatttcgccggaacgccgtcatctccgcgccggcctctccttcctcctcgtcggctcgtcgccccgctgcaccaccaccttcaccaacatcgcagcggcgtgttccacgccatcccctcctccgctcagccgctgctgcctgccatcatcgtcatcgtcgtctccgttcgtcctcgccgatcgacgtcccatcggttgcccggctcgtcgtctcgcggcgccgcctccgtcatcgtcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtctagccgttctcgtccgtcgtccgcgttcgtcaagcgagccgctgcagccccgtcctcgtctccgtgctcggctccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtcgttcccacgcctcgtcgcgtggtggtaaggatccgtcctctcgcttccccgccctcgtccttccggtgtcgccccgtacccgttgtgcggtcgtcgaccccggtacccgtgtaccggtgtcggtagtcgttcacgtgtgcgggtggcgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgtttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttgtaaaattatgttgatttaaattattgcattaccgctttatttaaattcccgcgttatcactgttttatctagccatgcctatttacctttgttatgaccttattattgctattgttattattaccttgttcaccctagagtaaacaaaacctcaactagtggacactctactcgtggtatccctagtttaaatttaggtagatgcttcgcaatttaataggacaacattagttagattttataactttagactttgggaatttctcatatcatttggacactatggaattgttggattatggtggaattggacatacacctctcttcctctttcaaaacccctaaagcctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggattggagatggatgaagtcgggtgtcgatggacattctccagggcaaatgaaggctacacgagctgcggcccggtagtcgagatgtcgtatggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtccgaatcatcgtaggccttgggttaaggcaggttcgtgagggttcacggccttgattaataatactgtgtagctctaggatcgtctttacaaaatggctttgggcaactaagtggcttttaaatgctgtttactgcaaaacttaacctctatattattatccccttgtactcctttgcattaattgtgcatccccggtgtggcttgctgagtactgtggttgtactcattcttgctcaatctttcccctcttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaatggacttctcgccacttctcagtctggcgcactataatgaatcatgctatacaaaggataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataataataatgtagtatatatgattcatcccattagtgagctaatgtttctaaacatggctaagcaattatatatatataacatttagctgaaccaaaccaatacataaggttcaagctaatcaatttattacccaaggtatcaaggaatagagcattcaatgcaaattggccataacaaaggaaaaggttcacaccacccggtgacattcaaaaataaatgcacagttgaaataaatagagaatttaaatataggatcaacatgctcaaaggattgtgtttaggatctgtgtgacttgccttgcaataatcgatcttcaattaatcttcttgatcacttccgacgcactcacgaaccttcgcaacgacggaaacgacaagctaacacgcaaaacgaagaaaaagactaataaaaaaccaaataaacagtacataaaaagtaaacaaacatgtagatcataattttagatgaattatgagacttgaacggcctcattctgacttcaaatgaatttattatgaattttacaagattaaatctaattaaagcccatttaaaaagaattaataaatttaattcaatttatggacaattttaatatgtagatctttattttagaaaaatttagcaacttgaactacattaaactgagttacgatgatttagttatgattttccgaagatttaatctattaaaagaaaaggaaaaagatgagatgatgacgtcagcatgacgtcatccatggccggcggctcggattggcgacctcgccggagctagatggtcggccggggatttggagggcacctacgcatagaggacgacgagatgaacccaacggtactcaccacgacgacaaacgacgaacgacgacggccggcgacgagaagggcgacggcggcggctcggttgaacggcgacggcgagctccggtggccggcggcaaagaaggacgggcggccgagcttctccaccccttggcgcacctcttggcgatggcggcaagcggcggcgacgacggaggcggcggcgcgacgacgccgaagatggccggcggcggcggcgagctagacgcgcgtggcgcggcggctaggaggcacgggagaccacgggagagagagcaaatgaaagaggggacgaggggatgctatatatagccttggattgaagagatcgaactccaaacgagaggaatcgactcgggaaa

SEQ ID NO: 64517 - DNA, 6998 bp, Oryza sativa
catcagtactcctcctagtccttgccttgacgcatcacaatatataacaaagtctttcctgatgtcgggaagaactaaaataggcgctgaggtcagcttttccttgagctgctcaaagctttcctgacactgttctgaccacacaaacttcttttccttcttgagtagttgtgtcattggtcgggctatcttagagaacccttcaatgaaccgtcggtagtatccagccaagcctagaaaactccaaatttcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggagaaccaatcgtaagtgttccgcatgttcttcctcatctttggagtagatcagaatgtcatcaatgaataccaccacaaacttatccaagtaatccatgaatactttgttcataagattcatgaagtatgctggggcattggttagaccaaacgacattactgtgaattcatacaacccatagcgtgttgaaaacgcggttttggggatatcctcggtcctaatcttcagttggtggtatcctgatcgaaggtctatctttgaaaacaccttagctccctcaagttggtcgaagaggtcatcaatccgtggtagtggatacttatttttgatagttacttcgttcagtgatcggtagtctacacacattctcatgctaccgtctttctttttaacaaacaacactggggctccccaaggtgacgaactggggcgtacaaatcccttctcttgcaactccctgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgttgcactactggcattccctttaggggtagcatggtaaatatacctccggcacgttcggttagcctaggatcttgatccatggttgctctcatatccgatccccagggtgtggtcagggtaacttctctacgtctacagtcaattactcctctatgctttgctaaccaatccatacccaaaatgacatcaagagtttggggtattagcaccataagattggagggaaataccacatccctaaggcggatgggtacgttaatgcaagctgtatccactgctatctcacccccaggtgagtgtactaacattggttgtcttagtttaactctggttaaattgtgttgttgacttgctttcaaagatataaatgaatgcgatgctcctgaatcgaagagaactttaactggagtggagttgagtgaaaacatacccatcagtacgccttggtcttcctgggcctcttcggctcgaacgtggttcacttgcccgcgtccaaatcctgtagcggtcctgttagtctgcggggtcctgaatagacctcgtccagcagcaggggtagcagtcccgtgaatagccgttgcattagttccggtgcgaatgggtgtcttgtttggatgtggacatttattggcgaaatgcccatactctccacagttgaaacagcttcctggccttactgatccagtggcggcctgatttggtgcaggagcgcggttctgaatggtaaccggcctgtggaaattgctagaggcggcaggtcgactggttgtcaccactgttggtctccatgccgaggaggttgtccctttaggacgctggggtgcggtctgaggcgtgcggttcatggcaagcctccttttacgattgtgctccacgaccttccggtcgttctccaacctaacgaccttattgattaaactctggaaactatcgtggtcttgtccaatcatgggcccgcgtaactcatcattcaagccttcaatgaatttgtcgatcttttcctcctcgtcggcaagatctctagttgcgtagcgcgccagctgagtgaaacggttcaggtactcttgtactgtggtattcccttgccgtagtctcctgaactcattcttcttcatccgcatcaccgcggcaggcacaaagttgtcacggaaggctgtggtaaattcctcccagtttggttctccagcatcttcttctcgggcttctttgtacgtgtcccaccaatctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggttgccttggttgttcgcgatagcttgcagaagttgagtttgggtggccataattccggccagagtgtttaagtcgggtgtctgagtttcgtcattgctggttgttgcccgacgtcggcttgccatctgtgtaggttgatggagtaagtatcctaattttctaactagctcctatggctttatcccattaagggagttgtgtcgatatgaactttgtttcgcaagcatggtggaataaactcatttacaacacaacaacaatagatatcataaataacatcacagagtttcacaaatggtacataaatcatgatgcaattgactgcatacatacacagtccaaataaggttcatccaaacgatacatcaaaccaatcatcaaactactcgtcaatctaggtaagggaggggggtgtctcgcatactatccaaaaaccatctgatacgagatcggagctgcaaggagtccgtcagtctagtcctccagccatccgcaggatctcggggcaggtagagggtggtcgctggctcgcgcaaaccgtagtccccacggctcagaggtagtggcctctggatctggcttgggcctcttgcccgggggtcgtgtgctcttgcgagcagtgctgagggtgcgaggtcctccaaggaaggtgatgcggggaacaggggtctcatcctctgaaggatcagtgatgtctggctcgatctcaggctcggtgtcggtcccctctgtctcggagtctatctggatcggagtctccaaaccggaacccagctgcggagaaggtgtagggatcagtggagtgtgcaccaactccggaacaggtggctgtgccgctgtagggtccactaggtagggcgctgactcggtagctagcatactagcctctcccagaagagcgtggaacgccggtgggtacggcggggtgaggaagaagtagcggtcacggcctactgctgtggaagtagaagcccctgtagtgctgatcttggctactcgaagctgctcctccagctggctgacgtgctcctgactctctctcagctgctcctcaagagtatccatcatcccgcggcgatcgttgtactggtcggataactgctggaactgatcgccgtggacctggagctgtgccttcagtgagtctatctcactgccccaagcctggtgctcctcctccaactgaagctgctgtgctgtgaggtcggtcacctcagtctctaactctcccacacgtctctggtggtcgtcaatctccaacagagcctcctcgtagtagtcatctactgcctcagcccatcgtgacaaccgagtcaccatcgggttgtagcagcagggcgtgtcttgaactgtgcaaactgagttgccctcctcccggaacgggtgatgagcaaactcggtactcactaactcagctcggtggatagagctgagtcggaggaaggcctcccgggcggcatcctgcatcgcggtctctggcaggtctcggtggtgacgttctggaagctgtagtccaactcggaagggactcggggatgaatctcgacccgagcctcccaaattgagccacactgtctcactcggtatgacgggaacccagggtatcgcagacgcctcaacatccgatgcagctcaatgacatacccctctgattgaggtaagctcaacttccaggtagcgggtgaatccgaatctgccatctaattttaagaaaaacccaaggtcagttgagagtaaaacttgttttgtaaaggaaatagttaagagtaagatgaaaagtgtaccgagttttgtaaacatagagtttttatttttgaaagtattgctaaatgggaatttctcccttggccaacttagaaaaggggtggggcgccttttggtcttttcctacagtcgtatggttctgataccagctctgtagacccccgtttttataacaggagtcaatcgtgtaaacagtaccatttccctggatcaagtagtttggtacacacggattcatagctggaataccaagtgcacatacacgagtgtctaatacgaattattacattataggcccgcaggcatagtcttaaatcatcggaccgagcggtccggaatacatccaaaagcagaaatagataaggcaacggaattcaggcagcggcatgccattgccacaggcaacgaccgtactaagacctactggacgccttcgtcttcatctccctcctgatagtaggcatagggatcctccgaggcttcatcttccgcttctgataaattttatatttgcaaggatgagtaccaaccgtactcagcaagccaccacagcaatgatgcacatgacagaggaattcaaaggatggctatggttcttttgcgcaaagcaaattttgtaattcttttcacaagcctaagacctagcatagattgatcaagttttaataccagtgttcatattaaacaatgacggttctgtccaccatccattgtgatcccaaggatagcttcccgccattgaatcgttatggttttctgaggacgtccacattcccgcctctcaggaagtggctccgtcagcataaaaatcatcatgcaatatcccatcccacacaagttaaagaatttagagtctagccaagtataatacatgtcccggtgctcaataaccgcgagcacggctattcgaatagatttggtttactcacactgcagtggatgtacactttacccgcactccgcgactgcccaacacatgagcctcggcccaacacatgagacgcgtcacggcaaagctttttgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctctcacacactcatggcagtcctaccaatggcgacaccgatgtagggcacgcctctcggccctacctcaacggctgtcccaacgtagcgcacctgcctcactcagaggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctttcacaaatcatgtcatcaacataatggcaatgtggcgcttatgtctccacatgccgcatctcaattaccttcccaaaggtaattgccccaagcatatagcatttgataaatatgagtatgcatgattctagaatagcatttctaagcaattgtcatagttgactagggactcatacgtaaacatggttacaaagatttaagggttagcaataatcaaggcatggcataatcacaagtaggatgttcatcattgtatgcaattttatttgtaaacaaaacaattttgcaattaggatcaacatgttcaaggaatagtgatgacttgccttgctcaaagtcttgcgggtcttggccttcacttggatccgcaactccctcgggctctatagttacgtgcaaaaattgatttgaattcggttagaattcaaataaaaatccaaataaatccaaatgaaagtcgaatgcgaaagttgattcctttttattaactttactatctgcgaactacggcaaacccaatttcgatttaaactattttgcgggtataattatttcgttgtcaataatttagtttccgcgagcattgtatataataggttagaaatttctaccacgagctaaatattggacgaaatcctagaaatgctatacaatttaatttagtctatgactaaatgattaaatataatatacggctaaaatccctagtaattaaatccgaatttctaccgttaattgattacttatagggattacccaaaaataatctataataatttatgataattcctatttttacttaattacatctaaattattaccgcgaactgatctcctattgatattactaaaaataatctataacaatctataaagattcatctaattgtttaattcgtaaataattaattctataatcaaatcctagcactttaggtatttaaatagtaggagttcatccaatgatattctcattaatcctataatcaaattctaatattttttttaaatattctaaatctcttaaatttttcctttttctcttttctttctccctctcttttcctttccttttcttttctctctccctttctcctctctttcttcttttttttttcctctcttctctccctcccggctcctttctccctctctctctcggcttcttgctctcccgggcggcgacgacgatgggcgcgagggggggtgggcggcggcttaccgacggcggcgtcggcaacggcggcgacagcgacggtggcggtgttggcgcaaggcgcggtgcggcggcttctaacgac

SEQ ID NO: 64518 - DNA, 31038 bp, Oryza sativa
  unsure (1)..(31038): unsure at all n locations
tccccggcccaacggggaaattgccacaccctaatccggtttcatccaaatttatctcgagtcaatgggaatcatcgttgttgctgaatctgaacttggccttaggccttgtattagactagggccatctcggaagtgtctcccttcagctccacgaattaacctctataaatgtttatgtagaccctctaaaacaattggattttgtttagttgaattttgcaaagtgccattcatcatgtctctagttctcgctcaattagtcggcgactatgcattgagagccgccaatagttggtgtgttgatttgcctaatcgattagatttaccacttcaattacaactatttctttgtgcttaatcacctattcacaatatttagattacatcctatcttgttcttaaaatgttctctcgttagcattgcagggatcatcaaccacgcgtcacggttggtacgatatcgtttgtggggtagcgattacacgacgtcttgaacttgttctggtcgtagccacatcgcaaacgtcgcgcttgatcaaagagaaagctatcccctcaccagaagattgggccacgagagagagcgtcatcaggatcgctccttttccgccactactttctttttagtgtgaggattaagtgtctgtgctgcaagtatttacgctttatttatatttcgatatgtataaagatttatgatattattacctggcttgattcctggacaagaaattatacacaaaatagtctgaaaaatttggctaattttttggggcgtgacacccacaagagatctagcgaacgtcgcatgctcacatcccttgatagggaatgagtcgttgacacgtgggtcccacgtttcgtttcagcataaaaccacttacgaaatcttcaccgattttcgaagatgaagaaagttctcagtccggtttgttttgcggttgagggagaagtttcgattagcagaaacaaataaggaaggcagaatagacttgttccccttgattgctgcgagccgcggttccatacttccatccgtgagcctcagacatcgccgccgtgagccctagcctcgccgccgcggcgcgtcgatggacgtcggcgagggcaaggggttcggagccgtggttgatggcgtcttgccaccggagatgctgcacgaggtcttgcttcgcctccccgccaagcccgcgctccttcacctccgacccgctcttcgccgccgcgcacgccgcccgccaccccccttcacgccgccctcctcctcgccatcggcgtgcagagcttccccagattctgtgtcgatcttgtcgacctgtctggcgacattgtcaagcagctgatcccaaaaccccaatcccaagtggggagaggcatggttgtgagtgcgacctcagacgacctcgtcttcctcgacggtaaggagcatagcattcacctgctcgaccctaccaccggatccatctccgccttacccaccaccgaatccatgtccgctttaccccactatggcgacgtcagtacagactgctcaatgctagcttcttgcctggtttgcatttggccaggtagcatctcccacatgagagcgtaagctagttcagattgtgaagacattgagagatcgttacgtgtccgaggttatcaccgtcagccgccgcggcgtcggtggacagcagcggaggaaggtggagaatccacctgtacagcttgattgtttctgcaccgatggagttgtgttcaaaggggctgcttacttcaacttcgatatcctccaatgttcgccctccgttctagaggcaggttgcctgccttccttcgacctcgcgatggagcagtggagtatgaccctctaggggccggcgaagagcattgttgaggaagccaatgacagacttagctatcatgaccttgactatcattttatgttggctggaattaaagacactttgtgtacagcgcattgggattatcatttttatgtggtggatctatggtttctaactgattctgaaaagggtacatggtccaaagagtacaggattaatgttgatccatctttctatgggattggagattgtgtgaaagtgcatccgttgcttgtgacggatgagggaaatgtagtactctggttgcagatgccatcggaagggatagtgcagatttataatccagtaactaacactttctgggatataactcaaacgagcatctataccggagtaggtgtgtacactggaagtttattatgtcgagggagtgtgtgacaaggtaaagattggtctcacatcatcatatagctcgtatccatggaattgtttggttatgtttgtgcgctttattggtttagccacatcaacttcatttggttatttatttttaaataacaagagcagttttattagttccgtttaaattttcatcgtcttagttgtttttatgatgctaaaaacttccgtaaggtcacaaaaatatgatgatctccaactccaattaggaaatggcctttgatgacctgtttcatcggaaataaaataaaatccatcattaatcataatgattcatattcattgccttagttgcttttatgatgcaaaaaacttccacaaggtcacgaaaatatgatgatctccaactgcaattagcaaatggacctatataggttgatggtctttttcagaaataaaatgaattcagtcagtaattaaacacttgatcatctattcattgagatgtattataattatgaattgctggcaagaggcaattcttgctgaagttgtcgcttaaggaggattgagccgagcgaacatatttcttctccatgcgttgattagaaagcataataacccgggtctttgtgtaactatcgaggatgagtgggaggtgtggagggtcgcgggtctgttgcggcctcttggttgattgttgattgttgcttgctgtatgttcttagcagtgctgtgagttgagctgcctgtgctctagtgttggttgctcagctgtttgcttactgtaattttgttgttacagttgttaaaaccccttcttttcccttaataaacttcagctggctttccgctgccccgcgaaaaaaagcacaataatgggagggtcttttgagtctgttatgatctgtttacaacagaaactaatttgcatttgaaaaaaaaacatacataacatttgtatcagattttcatatattcagttaatatagaaaatggattgttctatggtcttatctcatgtagtgaccaagaaatgctggaagtcacaaattgcttcaccaaatagtgaacttatgcagaagtggataataatacagagatagttgaaatgatcagtcctagattaaattgtcaattgttttctcaatggcataatgctagggagaaaagttattggctcctagcagatagctgtgaggagaaatattcagtatcctctgtcgcaaaatatgggaaaatattttcccgcaaaatatagctacttttaactatgcatcttgacaagcgtgtcataaacatagtgtcaattaaggcttatgtcattatttggggaactgaaaagaacactgtttctttttggcaaaatttgttctatatctggtgatatcatacatcggaaaggtttttaacacatgcctgtttggtatcttgatgcgaaatgctttcagctacgtacattaattccataaaacttatccacgactatactagtgtctcatttatattcatttctttgtttgcaataaagatttgagacatgcacttgaagattgtgtctgccattgtattgggtccaatttgctgtatgcaattcatactatccatggttcattaatgtcaaatccgtactcaagaaagctctgaaggacttgtctcacttggacacatggacgaatttaaaattaattaaccttatgtatcttttggtaatgcagtcaataatgcttaagcacaaaaggcaaagcttgagataagatactatgttaacatgcaagttatccacagttccacaccacctgtttactgtgcctcttcgcttttttttttttttgtctttgcagatggttggatcagagattggtttctctattctgatatgatttatttcacccttcagcacttagtaatacttagggtgcactaactgcagttcacttcgcagtaggttgtcacctagagaagcactgaaattgatttagcccaacccttgctagttctctgttagaatgtctcttttttagagagtgtgagagagttttttttgtcagatttttcagatgaactctgctctgctctctctctctcttctctggagtaaaaaaataattcctccagtttactgaactgactgaagccacaacgaacggtcatgcaattgttaagaacaacaatggcagccaagttgttatcacaactcgaatcgaaattgtggcatctctagcagttgcagaccatgaaattctatggttctaccgaagcaggaaggctggactcttttctatgtaaaggctttctcaaaattggatgacagaaattgcccccttaatctgaagactgtcgctgaaagaatcacggagaaatgccaaggtttgccactggctcttgtagctatagggagccttttatcgtacaaagaaatggaggagcatgagaagggagttgttctataatcaacttaggtggcagctgagtaaacaatccagagctgagctgggacactagtgttctgaatctcagttacaatcaacctggttttacctcaagaattgctttctttactgcggcctgttccctgaagattatcggatcgacagaaaatggttaatcagattgtgaatagatgaagaaactgttcaggacagagaacctgagacaacaatggcagatgtagcagcattgtcacctgaaggaacttgctagtcgatcattgcttcaggttttggaaatgaatgaatatggaaggaaggccaaagagattccagaagcccagatgcatgatcttgttagagaaatagccctaaccatatccaagaaggaaaaaattgctaccatatgggactgtcctaactcggatggaattaccaatggatcacagtgtgcttcttacaaaaggattatggcaatttagtccaagcagcaaaatgttcatctcagcttcggtccatgttcgtgttttcagaggaaatatcatcgtcttggttcagactgctgcctgagaaattgcaatattcagaaagtgccaattgttttacttgcactacctaaacttcgggtacacaaaactgaaagacataccgagattgatagggaagcttagcaatctgcaaatgctttatctcaatggttctgtactggagttgccaagtgaaaccacaatgttaactaagcttcaccacctactcgtagatgggcggtttgggatgtcagcaagtagcaaaataagtcaactgcaacatctacagtctctgagaagcatagaagccaacagctacatggttaaaaacattggatgcttgacagggatgagatcatgaaggtactggagtcccacaacacagatctatgggcctcaatcagacatctctgaattcattgtccgttttcgcagaagatcgcgatcgatatattcttgatctatggacaacttgaaacctctatctcacctggagaagctaatgataagtggcaggatacataggcatctgggcttcaaaaccattacaggtaaaaatcaacccagtcaaccttttctctcttccttcttaatgaaacagcagagctcctgcttcagtttcaaaaagaatagggtatgttcactttgttgggaaaaacatgccaaattttaataatatagaattaaggttgggtggtgtttggtttgatgtcttaacaaattttactaatttttaagagtgggtaatttcaaaattaacaaaatttggtatcttaccaaaaattaataatgtcaaaatttgatacatttgacgttttgtagcattgaatgtttggtttgaagccttgctaaattttgatggagttttttttataaaaaaataccatttttatagggtggtccgcaatcatatagtaggccttggcttaacgtgagagttttctacttccgtgtcctctttcggcaacttgttggtgttaaggaattcgataagcggtgttcactagtcctgagtggtctcgatgtctgtgacgattttgtcaatctaagtagtagccctcgagccaacgtcggtggtgctatcgatgtcgtcgtctggcgaactcttgacggatggactggttaatacttaatactctaggaacatgctggattccaccggctttctcctggaagctcgtcgggtgaggttgtcgacattggtgttgtctttgcgatagacatggcgcacttcgagctcgtaatccttggacaattagggattagagcctccgtaatccttatgcacttggttggcgactttctgagtcacctttcacaatcagtcattttaccctgagtgttgtggctgcttgtagtccagctaggagtccttcgtactcagtagtgttgttggttgctcgaaaatctaattggtctacatgtaaccaagaattttgtaaaattttcttactgaattctagaagagttgaattttccaaaaataaaaatttgggtattttacaatgcggatgctgcagttgtcatcctcatccttgaggaagacatggtcgaaggcggagcacccgatgaacaccttgattgcctttccccaagaggatcagtttgacgatgttgtgggataggtcgacgagatcaagacatagttgttaacgaccaaatttggtaatctgagtatcgaagatgaagatcagatcgaagcggaatccaagtccaagatcgtttcggaaacagagtaaggatcggctgaagttcgaatcggctacgatcaggatcggtagagtccgagttggacagggttagccgatcaagccgaatccgacaatatgacacggcatgcgttgttgggttgggttaatgtgcttcatgatgattgccacgtatggatagagtcctgagaaggcaattgtatctattaattaggatatttcatgtaattcccttagagatatgtttggacaaaagtctgccgcaaagacttatggtatcttagagtttgttagagataaaagtcgtgtccgacacgggcatattttgtaatctcgggtataaatagaccccgagccccatgtaatcaatttaacacatgttcaatacaatctcggcgcatcgccacccttttactttcgtttcgtttcgacgagttcttgctttcgggttgagctgcatcggtttcgatcttcaactagaggtaaaacttgttatggcggcctgcgttctcaggattagtgcttccatctttatgatactctaatcttatttatgtaattcgtcgagttatcatatatctcatataatctccggcaatatcgttatctaacctccaatcggctaacatctgttactagaaggcagccgattaggttaagtagtgacgttgacatagattatataggatatccaccactctatgaaacatccaacggcttgattgtctagatattgtctttcttttcatacttatagttgtatcagttaagtttgaccttataagtcgtgattaggatctcaatctctagcctgcttttggttgccgattagggtagcatcggggtttcagccaatcttacctaatttaactatatttatctcatatgcttgattgacatgttaaatctgccctttatgttaagatcttgctgcatttaagtatattaggcttttgtttggtatattttacttgctttgatatcttaatatagagtggtatcggagtattacccaagacacgctagatctatctgatcggctatgctatgaacatatatagtcttattgttaatatatatttcgatctaagtgatttatactgtctcggcatggcgaccgatctatcccaatcacttgatttaagtatatatcgacataaaggctacatattgttaatatctacagccgatcgagtagatttagttctttcttacttatttatgattgccgatcgatctatatgtgacatcggcttaaaaataaatgatatgtcatcggccactagccgatcggctatcgtttatagatttaaccgcggtttctttgtctttatttcttgttgattgcatgatcaaatcaactggcatgctcacgaacctaaaggcaagcttttggacctgcactagagttaagcagatttctcaggccttgtgtttttacatcaacaatagtctaggaaaggtctgcacgtcgacagtgcaagaagcgatccagggtggcaagcgacgtgtgcggcgatgaagagcgtgtacaaggtgaagaatagccacgcacgggggccggggcgtggagatggcagatcgacttggtagggaggtgtagcaggacctcgagctacatgtctggaagcaagatgcagtccactgcggcggaggatgacgtcattgaggatgaggagttgagactagcggtgaaaacaggatgtgtactttggccagcccgcccgactgactatacataattcaacaattacagcttgcacctatttattccattctaaaactataaaatttgcttaaaacaaattttttaccatgtagaccacaaaagcatttataaactattatattgaagccacatcagagtgttctattatagctgcaagtagtcttggcatcgggggcatatcaagctcatgtagaccctcaatggcccggaccacttcacccattgtcggccgatcagactcaatttcttggatgcaccaacatgcaactttgcaaactctttcagcctcttccaaactgaagtcgtcatgtaatcgtggatccatcaaactatgcacatctcccacatgaagcttgttaattgctcgcacaggaaaataagcaccatgatagctgttgctagcagatactttaggtgaatttctccttcctgatatgatttccaatagtaccatgccaaagctgtaaacatcaacttttggtgtaatagcaactccgctaagccactctggggcaagataccctacagtacctctgaatgtagttagaactcggctaaaatcccttcctacaatcgctgccatcccaaaatctgcaatcttaggaacaaatgattcattcagaagtatgttttctggtttaatatcacagtgtatgatgcattcgcgacaactctggtgcaggtagcacaatcctctagcaactcctatagctatttgatacctggtgctccaatttagaacggtagcattgctctgaaatagatgggcgtcaagagacccatttaacatgcgttcatacacaagtagcctcttatcaccttcgcagcagaaaccaatcagtttgattaggttgatatgttgggtcattccaattgagctcacttctgccctgaattgcttctctccctgacgagcaccatcaagccttttcactgctatagcagtctggtctcccaacattcccttgaatacagaaccaaaaccacctcctcctagcttctctgagaaacatttagtagcacgaactaaaccggtgtatctaaaggctataattccaccatcattaccttgactgccatataatggcacaccacaccacttggatttgttaatccaaatcgttaacaaaagcatgagcattagtaatccaaaactaacgacaatgcttacaatggcaacaactcttggtctccgtttgttgttcttccttaaactttgtgaatctctggcggcgaggcgaaggtaaagaacattttcagaatgattatcaatgccatcattctgattcacacttcgcaattccccatgccagatagagcatctgttaccattataggtataagcagtgcaagcgcagtcatgaagacaagcttcttcgcaatcgctctgggtcgaagcatcttccatgctttgagggtacaagggcagtgtaacaggagctatggggtggaacatgtctgttgaacttgtgttgttttgtttaccagatgcacaatctaagggagtatctctgatgcaccctccaatcggatcaccggcatcccaatcctgcggtgacttgggagagaagctctccatacatccacagaatgggactgaattgccattgcagaccgtgaaaggtccacagacatcgtgcaggctgcatggatcagatggttctgcatatatggtttgccaagacattttgggttgtgaccaaacattcagcttaacctgaccagtgatgtctatggaaacgaatacagaagccgattcatcaagggaggtgtacgtgaagtactcctcctcattgttgtggacatatgcaggtttgagcaagcctttggtccgtggatccatgtctagcagctcattgagcaatggtacaagcgtatacgccaattgtccggatgaccaagaccaatacaccacgacgggaggtttgcgacgcctaaggcgcaacaccgtgtttgtgtccatctcaaggatgtaagagccgaggcccatatcaatgaggctcttcttggcaacgaaccgacggttcaaaccggtgatcttgttcctacctaacttagcacccggaagcccaacatctgcagggtagtcgaagctctgccacaacacaacattgctactagccatgaggagtaggtttccattgttcatgaggagagcactggtgtttgtgctggatgatcctgttgtcctattgacaatggtgtgagtgctggaccagattatggactctgaactggtgttgttgttgttcaagacgatggcaagattgccatctcttgagattttgagctgtgcttgcttcagctcagggccagtgatgggattctccctattagcaacccaagctgtagtaaaaacctggatcttgttgaaccatatgccaagataccagccaggcaatgtgttggtggtggtgttaatggacttactgatgcctgcagttggttgtggctggaagaagccgagcgcgaacttgccgttcctcgagacgagcttctcgccgacagaaagcgcttggcctaccatgagagtgtcgccatctgcaatggcggcggaacatggaggagtgtgcagggaggagaggagaagcccactgagtagtagcaagacatagagaggaggtggcatggctggagaagataggtgaataatggctgaattggagaagggaggagtatatgcttagtaacggtttagctatgtagtgctggtatatgcttttatgttttatttggacaagtaagaggaatgcatgaggaatgcatgtatatacagagaacacacgcgggggactgcatcagcctatccatctatcatggggaacacatgaggtttaatgtaattcttccatcctaaaatatatcagcctagtatagaataagatacattctaatactatgaatctggacaggggcctgtttaaattcgtattattagaatgcactccgttttgtattataagtcactttgaccttttttttctgatcaaactttatgaagttttactaagtttatagaaaaatagtaacattttaaacaccaaattagtttaattaaatctagcattgaatatatcttgataatatatttattttgtgttaaaaatgctactatatttttatatgaacttagtcaaacgtgaagaagtttgattaggaaaaaagtcaaaacaatttataatatgaaacataggacgtatctcatatgttgctatattttagaacgaatgtagcataatagatgctgcaggttggagtacatgcatgtttaatttaggcagctgacaggtagaacaggagctgcaaggaccttccttggtcatgtttgttcactctcatagattcagagtttcagacagcaacttggcctggtagaggtacaacggtactcgacacggcaacgtacgatgctgcgggtcatgttggttcacatgtctactaggtcctgcagatagaagagcagagcacattcaagtcggcatgatgattgtgaaaattaatttgttcaagaaactaatggttttatacgacttcgaatcaaaccatgacctctgtatttgtgtttccacataggacacatttgctgaattggctttatgtgtttagctcacatcaaaattggaagtttggttgaaattggaacgatgtgacgaaaatgttgaaagtttgtgtgtgtaggaaaattttgatgtgatagaaaagttgaaagtttgaagaaaaactttagaaataaacacggcatgaaggagagattctttgaaatcggaaagatgaaattagcagttcttgaaaagaagaatggatgagctctgaactctctgttcgtcacaactatgttttatgccgaccaacatcatcttgaaggcttttgcagctgcctgtctttgccttgctgatggcatccacaatgtggatgacaagtggatagtaagaccccttactacttactttaccattgtgaaggactggaggtgggtagtctaccctataattcaccaactcactcttacacctacattactcattcatcaaatctaacggacagtattcctcagtgcccgatctaacgatcatcgcgtccacctcagtagtgtactgccgaggctgctgtaatcgcgtgatttatttcccatcaacgcgcgcgcctcactcccgaaatacctgccaccatctcaatctgtcgatccccttcctcgaatttcggaatcctgaagcgcgagcagtcggcttccgcacctggtgccaacggcctcgtcgatcacctgatctcttcactcgtgcgcggtcgacgttctcgcacgcctgcgaggtcttctactggtgaggaagcgtccgtagaccgctcgctaccgagaggatccggctgctctgtcgccgagcatgcgtccccgggtccctctgccgccagagccagggccacatcccgttctagcggttggcgatccttgcctctttgccatggcatgagagagctctgcagcgatggccacggcatgagaggggccctaccgtttagctgctgccctcttcgctgggccgtccacagcttctcttcgcccattaattgtgacgctgcgcctgtttatctcctccctcttgatcactcacggtcgagaattaaggctgtggcgaagtgggcggtggataaccttggaaggctagcgaccggataatcctgatacattatgcatgtccttcccaaaggagctctgctgccaagcaccataatctctacaagagcacaggctcatatatgcagggaaatatcctttttttcagttacttcagaaaggttaacaggtttgtagcggatctatcgttgctttctgacttactgtttctctgaacactgaaactttggttcctctgctggatttcatgtagatgaacgtgcaggcaaggtattggatcaaccccaataagatggtactggagatcctgcatgctgaatccaggtccaagcaggaaatggctctgctgctttgccaaaacttcatcactatttaagctctccactctagatgttcagggttctgcagatatctaggctggaaagggaagaatatacgaagtagtacaatcctaacatgctacattgtgttaaaaacaaaaactacatctgtagaattgaattgtatagcagaatttacataaattatcatcttagttcaaactaaatattaatacgaagggatattgtccaaactgataaaatgttcattatagtaacgcctgattttcagtacgacttgcctgaacctcacactaactgatcaaaatgtgcattcatgactaaacaaagaagaggctgctctctgtttctcagtcattcaacaaagaggtcggctgatcaagagttgtcttattgcaaccagccaatcttatagatattctcttatcgttttatgcatatgtatggcacaaagttatttagtgaggtgaagtctgatcctaaaaattggggaagatagtttttagatgagttgatgtcactatatcatataatttgaaaccataattgaatgtaatattttaatctgtaattgtccctgtatgctctttttgtttgataatttgagaagtcagattccttgggtgtgcgcaaacgcgcctcataatctaatgttgagcagtattcatgttaatcaatatatagtaggctgcttgggctcatatgttcacacttttggctagcagctacaaggttgcttctatcactttgtccgctgtggataatatcacgagtaaagcagcaccatcaatgcccagtacaagcctacaaggtaattttatcgtcaatacaagtgtcagaaaccatataatgctcaccaatttgtggtttatccttttagacaaactgacgttttggtttcttaccgcataaatggagcagaccaatgtcctctgcaaattttattcataatctgcctattctatataattctatatccactgttcattcattcttcttactgcacaataatcattttgtacaaataaatatgtagtagctttttgatgttcctgcaatatttgaatagatgagtgtaaaggaatatgtttattctttgcagcaggcagctaaccactgttacatcttgattagtaaaaaaatattgctttatttgcatttcgcattttttgaaaccctaggagccatttattaggtttttgggcagcacatgcttttcatgttagatttcagagcaaaatagatggaatgctacaggttggaaaataaatatcaatgccctcagctaaggccaccaatgttggcatcaattgaagctgcctaacaaataagaaaaactttgtagtgcaaaccctatatataatataaacctgaaaactactgtagaattaaaaattgaatctttggttcacgtcatcttgagtaaacttttgctcccagttttaaccatgagcaaaggttttattaggattaaaagttttactcaggatgaactggatgcatctcagatgttcatttttggatcctacaatagtttcccgctttgcactacatataaggtttgtaatacatatttttgcaacaaataatgtgttgtatttcacaacagttatgtattggtctattgtgacatagttctagcaactttaatgatttcttctgctgcggtgtaacctgtaaatatttttcttcttctcagccaaatgttattccattagaggatttaatttgtttattcaaatatcttaaatacaattttttttcatcattactctgatacaaatgacgattattgatgaagcaatagaaaaacattaagtgatgtttgtttatgcctaaagaaattgctcccacttgattgagaattgaactacacaactaaaagctgcccaagtttgtgatagttataataataattaaattagcatggatgttgacatatataaattttttatgcatgcttactaaatatcgccgtagcgttagcacgggcctgctactagtagaggaggtaataactataccgggtaatagcactgctacctggtaataggcataaaaaatattaaactctctcctctctcactccctctcttttttctacccaatcattactttacacgtgggttatatcttactatccacacattatagatggccaaaaggcccgaggcccgatggcccggcccacggcacgacattttggcccggccgccgggctttgcctgggcccctccaccggcatgttgggccggtcggccaggcccgacaaaaaaataatagggagcaaaaatagacatattatatgtcacagttcaaagaatagggacgaaaaatagacttatattagctatatatatgtcagcccaatgaggagggaggaaaaatagacttattttagctatatactagaaaatgagcgtgccagttggcacgctagctaagttagttaatagcatgtgtgtatttcccttcagaaatcatacatttgaaaaggattgttgaaagtccattcccttttatttttatgtttgtgaacaaactaagatagaatagtaaaaccatctagattagtggtattatcatgctgaacagactatataacatcgagaaatgactaaagatgatgtacattaataaaatacatgttttactaatatccaacacaattctcatatagatgtaagtcattgagttcgtattagtaggaaatacatatccgaaataaatgtgtcttcgattactattttttatactaatttcatttagaaataaaggacgatgacatggtaaagacacttattttgatttcatatatccagatatactactatgtagagctcagctggtcaggttctctacctatacgagttaagttctaaacttagcatagacgcttgtatttacggctatttgttttttcaatggtaggaaacccaccattcttcatcactcctaagatatgcctgatggcccagtcttcgaaggtgcttgtagtgattgggtttgtatgtgtgcgtttacaggtgtgtatacacacgtgtatatgaacatctatatctactgtgtttcgcgataaaaaaaatagcagtatgattgttgttacttaccaatgttccaaaataaatgaattcctagcataaaaaagtataatgtgaggagaaaaaaacaaaaatactctgaattaataggaaagtagttataaacttctcggttcacatggaaatttcacttctattccttccgttctataaaaattcaggtattttcctcgtttcaagtaaaccttatctgaagatttttaattttcctaacgcaatccttgctgtcactatttgttttcatttgatttaactatttatttattttattctcttgaaacacatgatattaacatgaagtgacttttcctcattccgagtaatctgtagtaaattgcatttgttaaaagattattatgcaaaggctaaaaatcctattatttttttctccttttctttttattcatattattttattctaaactggcttagtaatatgtacctgtatgtgctagcttcacgctgcatgaggaccatgcgcagcagcgcaggtacattgtggagaaaggccgtgcggcgccaggcccaagctcgcatggccttgcgagatgcctggcccacgttgcaagcgtatatacgcgaacgttttcccgatctctcgcgaagtgaataccgtcactttgactcgtggcaaatttttggagggggtgtaaccaaatttttagggagccacgtggcccaataaaaagccagatcccctgatttcggtattaaagatatgccacagcctaaagaggagggaggaaaaatagacttatttttcaaaaggcacgatggaccacccgtgccttcgggccggcccggcacggcccgactgctggtgggccgtgcctgggccggtggtgcagcccatgggccagcacggcacggcccggtgtgttggtcgggctatgccggcccgacagattttggcccgagcacggccgtgtctgggccgtgccgggccgggccgcccgaatggccaactataccacacattggccgtgtttagttcccctccaccaacttcaaactttcaacttttcatcacatcaaaaactttcctacacacataaacttccaactttcttcaaacttcctaatttttccaccaactaaacacagccattgtgagaggtagaaacaactaaaacctaattatgtggatcccatcttactacccacttgataaaagaatcaatttacagtggtctcgaattccggtgaactaatctaacttaatttgaaatgcttaaaaacgacatctgaaaagtcagtatcaacgaatctgtatcgacgactgcggtgcaggggagccaggaggcagtgactactcgactgatggctgccgaaagtctttagtaatttttgccaactaaacaaggcattaactgaggccgagtttagttacaaactttttcttcaaactttcaatttttctatcacattaaaactttcctatacacaaacttttaacttttccgtcacatcatttcgggcttgtttggtttaataccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcatttccaaatatttggctttaaaccaaatcatcacatttactatttaaactaccaaaacattggtatggcaacattttggtatcaaaccaaaacggcccttcaatttcaatcaaacttttaagtttgacatgaactaaacacagcctgacttggatctgaacttgacaaattttgtaccaatccgatgtagcagaccatggatgtagttcttttgtcttagcgtctgtccacctccaagcatttgcttcaatgcttagaaaattatgacagctcacctctatccttgattgcaaaatgtgctgcccttatgtagattgaaaaatttgaaactattccaaataacatccaaagtagtactagtaaagtagtaagagaaggtatttcatcgaactttcccaattcgcttcctccccatccaaagtagtagtgaagtagtaagatatgtataggagttttgccctctgatggcctctgcatgttactaatgaccaagtgtatggatagctgagatcattagttattattagttattgattggttgaattgaacgtgcttaggttgcactaactgtaatctttttacttatggcaataaaatgtttacctgattcatttacttgcgccgtgtttagttccaaaataattcttcaaactttcaacttttccatcacatcaaaactttcctacacacataaacttctaacttttctgtcacatcgttccaatttcaaccaaacttccaattttggcgtgaactaaacacacccataaacttccaacttttttcttcaaacttccgattttagttcacgccaaaattggaagttaagttgaaattagaacgatgtgacggaaaagttggaagtttgtgtgtgtagaaaagttttgatgtgatggaaaagttgaaagtttatagaaaaagtttggaactaaacttggcttacgtgtgtataaaagttttgatgtgatgaaaaagttgaaagtttaaagaaaaattgggaactaaacgtgggcttactgtgacacacttcttgctgaatgtcaggtgtatgttaaacatgtgttttagttgagattactattgattggttgaattgcgtgtagtctgaactaatggcaataaattagttacttgcttcatttgtttgtgccaaacgtgtactctgcatgagttggtttgagttcagactcttaagtctgaatttcagacaagttcagaattgagctggttgaatttcagagagtttagaattgagttggttgaatttcaaagaagttcaataaattagttacttgatatatttgtttatgccaaagtaataacaccagtagagttgattcggacaatgagggttttaatggtgtcaacagctggaattaccgaggaaggctctgtcgctgaaactgacgccggcgttttttttaaaaaaatattttgatgggtgatgccggtgattttggaacaacagcaactaatgtttctgttttatagagaatacacatgtgcatgcaccgtattgtttaacagctaggagcaatcttaaccggcattatatcaacaaggtttaggacgtgtttggtttaaaaccaatttttgctctaccaaatcttggtagtgccaaaatattggtaagttttgacactaccaaattgggttgtactgaatttgaactactgtgagtaaaatttggtagcaaaccatatatgcactttttattattgaagttaccaaaattttggtagtataataagttggtatcaaaccaaactagcccttaaactgcgtccaagcttttcaaacagctgtccttccattagctttgttaaaagttctgaaaaaactggtccaaggaagagatgaaggatctgaacttcagacttgataatttcatagcacctatccaagagaaattttaccgttcttgaggtaccacaacttcaatcccactgttaattccacaggggtgagatctgtatggggaaatttattgacacaaccaagtcctaatgactatagttggccaaatgggccgcccggcacggcacggcccaggtccggctgtgcttgggccgaggtgttgcacacacgtgctgcacacacggcctaggcacggcccaatacgactcgggccatgctggactggcccgaaggcatgatagcccatcgtgcttctccacagaataagtctatttttcatccctcaactatgtgggctatgttcatatggctagaaataaatctattttgtatttctctcctttttgggtgttgccttatatggttatttaagtctatttttcatccctgtactatttttcttcgatcgtgccatgccgggccaacccaccgtgccgagggtgcagcccaagcatggctcggctgtgaccgggccaaaatgacgtgccttgggcgggccgtgggcctcgggccatatggccatctatactaataatgacttaaccgtaacctgatctttatcctcatctttctctccagggttatcttcctttcacaacaacacggacacgcggtgatggaactccttgtgcgtggctcgctttaggctgtgttcggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggaccgtttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtcaggtgacaccgacgactttcggcaaaagttatgcttaaaatgcttattcatatattataacattatattctaaatataattagcatactataatatcgatagacgataccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggcgaggcgggtaaaaaaggaagcgaagaaatccgtggtatttatattttcgagacccaaaaagaaaaccacgaattcccaataaagaaataggcaaaattccccatctcctcgtctcctcccaactccaaaccctagctcccaccccctctcgccgtcgccgtcgcgtcccatggcgaagtcgcggccgcccaagcggatcctcgagtcctacaccatcaagggctccgacaaagtcatcaagcgtgaggctccccctcccacctccccaaccgctgctcccttcgatccggaatttctgggggtttttttgggggggattttttttgtgggggcgtgggtttcggtgggtcgcggtttgttgaggtctggaattctggggttttagctccggttagattgaatgtcgcggaaatgtttgctctgtttcgggggagcattttaatttccctgatgtttccgtgcgaaatgaaatggtgtttaggtctctggtttactgttgatgtaagctcgattcataatcagaaaaggaaaccatggtagggatatgtgagcatgttaacttaatctgttggagcgttaactctttgtggttttgattgttcatgggtttatctctcttttgcatgggttttaggacggttaatacagaaaaaaatatatgtgctattgagttatgttatgagtttaaactcatcttgattttctgttttagattatgtccagtggagcccctacatggttttgtctgggttgtgagctacagttttagcaccatgagctatgtcattttgctgatatagcgtttttaattgcaatttacgatcgccaatagtttggattcatatgttgctaatcccagttagcattatgatcattgtggtgcttatagtcgtgctgtaattcttgtagcttaacccctcgaaaaaaaaaatttcttgtagcttacgttgtgtttcagttctggttagtattagacatttgcatgaagaacaataacttctactcaatgtgtcttacctttgactttttatttaagaaaatctttatctcatggcttagaccttgtgttaagctaactaattgattctatccagttaggcatcttaagttttttttttgatagatagcgtgctttagccttaaatgaaaaacgattattttgcctagtttttctagtcttaactcttttttgtgctatttattcaaagttgatgcatgcgttctactaatcttagcttatgcaaaggtcagagatgccagattctgagatttctgacattgttctattggcacattgggattctttgggatggaaacctgcctagataaaccttaattaccggtatattacttgcaccaatctatgcaaacttaaatgcttcttctagcttgagcctccttttctatatttatggttaatatccagacgtgtgatagcaccgatgaaccttgatgcttcgattaccttgtgtgtgtgtgtgtgttttgagaacagattaccttgtgtttggtgaacttttgattaccttgatgaacagacgaatatttttcatggtttctaggagggtaatacatatatgtgctgttgagctatgttatgatcttaaatgcactttgatttcctgaattcctgttttagattatgggagttcagtctgtaagtagttttgtatctgtttgtgagctacaatttagcactactggcagaacccttctgctagatataatctagaatctgccttctgatcgtcattttgctaattagagatttttttaccatcttaatggctgtgttcatgtgttgcaaataccagctgtagttacaattgtttatggtgcttatagtcttgaccttctagcctatgttgcatctaagttctggttggttttgacatttgcatgaagactaatctctttctacacaatgtagctactgttggactttttactgaagaaaatgtttgcttaactgcttaaagttatgtaatcaatactatccagttaggcaccctaaagttttgttttggctagatagtgttctctagccttaaatgcaaaatcaatatgttgcatagtctttctagtctgaactccttttgtgctgtttgttcaaggttgattcatgccttctgctaatctaacttatattcaagttagaggtgtcagattctgaagttttgatatctgttaaattctttggtatggaaacctgcccagataaacatagttactacttacaccgatatctgtagacttaattggttcctttagtgtcagccctttgtttaattttataattcatatctagatgttgacagcatccatgaaccttgatgctttgattaccttgtgtttagtacactttgttttactgtaagcagattgcatttcctttgctctgagattatcactgtgatgccagtactatccaataccagctttacatcttgatgatgacccatgtcactattttttataagcataaaattatctcgatacctgtctgattctcttatatgtttcttgcagctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgtaagaatttaatgcaacctccgctatgtgatagccctgaaaagaacttgtttcgtatttgcagttaattccgttgacatctgcacaatattgatctgttatgtcgatgacattttccatatttaaatatcatgttatctgttgattatgttttccagtcttctttagggatttcacacatgccttttatatttgatgtgaaatcccaaggtcaacaagttcgtaattctgatgagttgatatgtgatatatgtatccttatgacctgtctagattctataggcttcagtgcatcaccagttttatctttccaaagagtcacaataactatttccctgtgttgaagtggaatatgaagggatgcataaggttttgtgcctattttcagcttgccacatttgctgttattacttgcttttggagaaaatagaggcacagtaaaatgctcttacaaacttgagatgttcttttaccgaagagccactgcatgccatgatatattatgtggtatgtctatggtaggctcgtgtagtggtgtagcccatattgcacataagtaccaagacagctagaacccattgcttactacaccgccccaatttagtgcattctgcaccttgccccatttaaaactattcttttcgagtcacatgcatgatgcatcacggctggtagaaggcttatgaggggtcagcgtgccaggctcatggaagcagctcatgccgtaccttccatctagctgttggtgtttgagatgaggctataggttgtgctggccatagtactagattagtccggatcatgtagtgttagcgaggttagagataagattggttatgatttattacttctgcctgttagggctgtctccaatcgtatttgttagagacacgatctggacaacctggtgctctcatgtggtagggtgccagtgctgcagcctttttgtccatgaggggccctccttggactgcagccatagccgccacctagaagcttgaggatgagctgctcgaaaggaggggtgcaatgtcataatgtgagaggttatagaatgttctgaaggcagcagcagtagtgaatgtgcatggttctgtcggaagccgctgactggctaacgcatcaagagattaggagctggtgtgcacagtgcacgtgaatgtccaatgacatgttcaactcagataggtatcgaccaagtattggtcgattatacataaaaaaataattagttttcttctcaaatatgtggtcaacttttctctgatcgtatgcgacacggcccagcccacatagccaggatactcaaccctaatcccatccctgtgtgccctcaccaggctaatggaattttggaacatatgggcatgcattgagtattgactgaattctaggagctatggactgtctttgagataagttttccttttttacagcttgccatacattatttcagtgtcaaacaattgaaaataatgtatacataatatttttatttaaatatgtagtgtgtcaccatattgtcgtttccttttggtgggtgggtgggcgtctgtgttgtctgtgggtgttggggggggggggatggcgaattccctgtatcagtaccatgccatgtttacggtctgtatccatgcatcataggctgaagcaacagattgctgtcgtactgtcattaagattgttagctaacttttggataggcatatctcttatccttcctataagtttgacaaggatgtttggcgcatagctagcttatataaggacacgtgactgtgtcattagtattaagcaagaaataacaaaatggttccttaccttcgttcttcttatctccctgcccttgcgatgctgctgccaaccatcagcatggtcgtacctgttcggtagagcctgtggtgttgccaaatcctaagcatatatgacactttgtaatgctgtatgccactctgggtgtttccttatcatgttagttggtttcaattatttctttatttgaccatgattcctcattttacaaaatggatgtcttgtttattatggtagttctatccgaataacatgaataaagatttttggctgtagtggatgaactgcgaccatttttatttactgttgctacattctcaaccaaatatcacttatattgctatgctttgctggcctatgctatctattaaattgatttatgtattgcattaatatcatcattttatttgattttctcatccctttactaacaatatgacaggttctgcaagtgtgagatgccatacaatcctgatgaccttatgatccaatgtgaggaatgctctgattggtgagtaatgaaataattcatttaaattcatctttttcctgaactgcgctggtgtacattttatggttttatccctcttgccactgggtgaataggacaaccaattttttttacctattaatggatttgggtgtcttgcccttatcttattcttgcctattgggatgggcggcaactagttagccgtcagagaaataaatgcttttccattttttttacaccagaacaaatcactcattggctctatttattcacaatccccaaagagatttgtgcagatataaaggcataaccattgcataatgtctatactctaaattcctgagagcaaggctacaaagtgggcctctcaatatgcatggcatgtctttgttgttacatcgccatattaatttgttgaaacatgtgttttgggctgatgttttggccaataatgtaggtcgtgcttatatattgttaatgggaataagcactattacaattgccacactagactctcttaactctttccttgctgtggcaatgcagagacgaaggaaaaaatttccttgttcgcttgtcctaattctaatttaaaataaggaaacaattaatgcgctggtaaaaactatagagagatatatatcctagcaaacataaggaaacaagctaaaccccatatggcctactgagttattgttttttgctagctgtagaaccttggcggttatagtactctacacaccccaacccccacacgctctgaaagaaattcatgacctcaagctacatgtccatggaatccaccatcaaaagttaatagaattgcttttgagtaggcttcacatttcatatacacttttcagtacaatatatatatgaacaccaaaagatgaggaagggtttagcaagtgaagaaagaaatccactctactctaaactatttctctggagctcttaaccccctaatatatatatccagctccacctttcctagacctggagcccaacgaaacagtttcagctccacctaaaaggggagtggaatgggctggattgattccaaaaaatgaactagatgggtgaagcggggcttgggccgctccaccgctccactccagattccactaggagttggagccttgtcaaacaggcccatattcttttgttcattgcacatggcaaactattaaaactaggccacactactactcaacatcatttgtctattttgtttttcttgtacaagtagtaactttgaggtatgacagattacttcgtactattgtgttctataatattttaagatttttcctgactatttcacttggttggaaacacctaataccggtttaaggactgagatatgaacttctatgcaaatgattattacaactttgaaaatatttcttagcatagaatatgatagtatcaaccatcgtggtttgaacttaaaagtactagcaaaaagaagttgggaagaggatggttcactggagtaaaatggaccttttcctgagataataaaacatttaatttgttttgtcttctgcttttacttttgcatgaactttcttatcatttttttgtcacaacaaatatctgctgcttttgctttccaggtttcacccttcttgcattggaatgactattaaagatgcaaaaaaactagagcattttttctgccagagctgtactgcggaaaatggaaagatggctgagaattctcatgaagctacagcgcaatccgaagaaaaggtaaaatatgatatgttgggattactgaattatcattaatgatttgtttagctatcagtagtgcgatggtaatacatcaaggccagggtctcccgggttcaccatgtcgtcttaataacataggctacacataattttcaatgatattgaggcatgctgcttaataatattattataatatatgagatgtctgtcctgttgtatcgctactgtagttgacaaatttccaatacttaatgacacaaagcaccagttgggaaacagtaccaatttattcatatggcagtanaaagtctggtgtgattttacaactataaaggattggggaacttttgcatgttgattactgtggcaattgctgtaacctttnttttggatactgcacaatttgccctactttagcttgtacagtttcactcttatattatgcataatctaatcatacagtaaataaaacccatccaaggtacatgcactatttagttcttttttaatttggtaatcaccattctgcgattctgaaagacaaacatttcatttggactaatctcttcagcaggtggagtcaaaaagacggagaaggtgactgccccccagattcattgacgagatacacctggatgtacaaagccttctcaagttggtgtaatgctatttatttgtcatggcaagtgtgtgtgacccacgaccacgagagtcccttcctgtaatgtcagtcgcatggtgtacataaacttttcaacctgagactgttgtattaggagacgacacgacctgttgttgttgcatgatgtttttagcagcgtcagaattagcatggtagagtcgggtgatgaagcccctcgcgggcattaggactcccgtatggatgttatcactgatcatacattgatactacattggatgcagttgagtctgtcatctgcgtttgtctttggagaattcttgtaccatcaatccatcatgtgaactttgattcttttcgagacgcttcgtaattaatgcaggcatttctgtgtgggtagtcagctaacgggggcgagaaatggcttaagaagtatggttgaaattggaacgatgtgacggaaaagttaaaagtttgtgtgtgtaggtaagttttgatgtgatggaaaagttgaaagtttaaagaaaaagtttggaaataaactcagcccaaatgaaaatttgacatcaccagccaaattttgggtaaggtagtactaatgtacaatcctactaaattttgttagttttgaaattttccactcacaaaagtctactaaaatttgtgaggtattaaaccaaacatcacctaaccttacttttatcttattaaggggctatttacttcatttctgaccttatcagttttgtgttaccaaattttattaaggtaacaaaataaacatgttctcatctctaccttactaaaatttactgtaagttttcgaagtttcctctcacaaaaacactaccaaactttaaaaagattacaaattaaacatatccaatgctatcaaaatttggtagcatcaaaatataccaaatttttatagtgctaaataggggtggaaacgagccaagccgagccaagccgtgaaagcttggtcaagaacaggcttggcttggctcggcttgataaatgaaacgagcaaaaagtgcagctcggcttggctcatttaaaagctcgagccggctcgagccagcttgtgagggagcgctgagcggcactgaggagggaagcccgaggcagcgcagggagggaagcatcaccgcggtggctcggggagcgtctagccatcgaccatcgaccatcgagcgcc

SEQ ID NO: 64519 - DNA, 1612 bp, Oryza sativa
gcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgtaacccagacgatactttgtccatgcatagcaatgttttcatgattctgtcaagataggacagaagtgtatttcgaaaattacatgaaaatgttctggtaaagctagaagtagaaaattgctaaactaattgtctttaatttgtcgaagacggtccaccacatattctggtagtattgcctcgttatcacgcagagtcaaaaggtggatcaaaaattgcctccggaggtagtacgggtcctgcgaaagttagagtattttctttatagctttatgaggacatatttatggtggagtgcggtgtgtgcggatatgaaagcattatgtacctctgtaatagggttcagaagacgacgaccatcgtagttcaccataaagttgaatacgtaaaagccacagtcatccctgtatgtttttgagaaagtagtgtcagtacaagctttgggttggttgtatttcgtttgttttaggagtcactcacccgttctgctgctctggtatattttcaactgtctcaaagtcccaattaagtatgtccatgttccaccctggagatgcaagacgcatgcattccattacacactgtgacaccatgatctttatcttgtcatgcctggtgaaacgtgattccccgagtggatcttctgtgtttagtgaatcaagcaccgataacttcttgctctccatgttaaatacgtacagcacgtaatgattgaataggtgaacaggaatcagtatctgcaaagtttaggtttttcagtggggactacttctgtactgttgtttacaagagtttctacaatctacgaactgcaaatttgtactcaccaggtggctttctgaaacatcatatactacctctgggcccgaaaagtgtgcaagttgatggctagcttcccaaaattcctcaccagctagcgcgtacatctgacaatacagaaagaatcattgaatttatatttttattgatgaaagaaatatattgtttattgcatgcaatgttaccccaaaatcttggttaatgaaatgcctccaaccaaggtagtttgtgttgtgaaatctctcaacttcttgttggaacattattcgaattgcaaggttgagagaatctgaatccatttggctcccaatctttatagtttcttggatgtttcgtagcgtcaatgatattctgaaaggatgggagctctgcagccatgtttttctgaaataaaccatggataaaaatgaatgtcagatttagtggggtgagatactcaattattctggaagaataatgatacttactctaatgatgcatcgtcagaaatagacattatataggaatacaggtcgtcagcaatcctagattccagcctctccgttgagcattgcttgacatgaaaggtgacatgacttcctgtttggtttgactacacgctttgacatgtgcttcatcaagtgagatggtgggttttcaacagtgtattt

SEQ ID NO: 64520 - DNA, 5163 bp, Oryza sativa
aaatataagaccaacattggtaaaaatcatttttatagttgtgttctattgttagtaccaaaatttttgtaaggttttttcgactaccaatatgtaaacatgcttgattttttcaatctgcataattataaatggatcccaccaatatgggtttttccatatggaaacactgtttttttaattgatgcagaagtttctacattgattttcttttaatttgaacaattatagtttggtcccctaaatgcatgactatattcattgactgttcgtaattatttttaacaattttcttccacatatattactcccccgtcgctaaatataaggaaattgagtattcaaaatttatccccaaatatatgtaacgtattgggaagtactacttatcctatcaatgatcacacccatttaattttcttttcatcttatctcagaccaccccctccttacattcattaggcatacggttttttttcctttatccttattttctaaaaactacttaaaatccctaaaatttagggacggagggagcaataaataaataagttaaaatttacatacctccaatccaataatgatgtaattaaccatcattcttgtgttaaactgaagggaacacatggaataatttatttgatttgtcatctgcaacgtaactggcattcaaaagagaactaggtactaactgacaaacatgtgcaagaagagatccccacctactgttctttggggcccaccacacatgcactgatcagattgacaagtacacacagtggctggataatgcagctagtggcacgtaatagaaagtcatagcgtaaattcaaaggtgtttttgattattattctgtgatgaataattggcattggagattattggttttgatatttggaatttattcaagaagtggttttggagatgattggatttcacaggtgaatctacaggtactgctgttatttcatgtgaccggtcagaccggcggtacgtgcgtggtcagaccggctagcccacggtctgaccggccgactctgtgtcggtttcggtttcgggttgtttgttcggatatacgtgattgtttcattgttacgacttctagatggatactatacgtatgtaatactgttgtttgctactaatgagtcaagttagagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatatttatgctagagttgatgcacgtggttggtgaagattccatatggcatacgatataggtattgtgtgcgtatgggatgcggagtcgaatttggaaggagtccaaatttggtatgattggttatgtaaagtttgtttcttgtactataaggtttcctaaggtgtttagaatttctagtatgagtttggttcgtgactttaggctgcctacctcgggtataaatagagggggatcgtgaggcttcccggtatcgcttttgagagcaattgagttgagtttagagttagggtttcgagtttagtcgaaattttagtaaggagtgctgttggtgcactctgtaaacacagagagaatcaataaagtcgtcatccactttaagagttcttcgatttgtgtttcaccgggtttcggcggtctaaccggtgatataccaacggtcagaccggcggcaagcggcggtcagaccggcgtcggcgacaggaggcagcgacaaggttcggcggttagaccggtagatcaacaccggctagaccggcggctacgcttcggtcagactaatctactccggtcagaccgatctccatcgatttcgagggtaacttttatttccgctaaaagttttcggtttttgcgtaccaaccattcatcctccctctggttggcttagttattttgattcgttcttacaagtggtatcagagccttattttcttctttggatttttatcgatctagaatttttgccatggctgcttctgttaggttttcaactaagcctcttgtttttgatggaacagatttttctcattggtgtagtaggatgcaatcttacattatggctgaagattatgatatttagagaaaagtttctcatccttatgtgattcctgaagtaattaatactattgctgcaaaaactgagtttgaacaaaattgcaaagctcgcaacattcttttgagtgggatttcttattatgatcgtgttgctcatcttcaaactgcccatgagatttgtaattctttgagtaattttcatcaaggaacaaataacactaaagaacttcatcgagatcttttcaaaaaggaatacattaaatttgagatgaaacctggagaagctttggatgactatctttctaggtttaacaaaattttgagtaatcttagatctgttgattcttcttatgatgctaattatccacaatctgagatttctcgccactttttgaatggtcttgacatgtctatttgggagatgaaagttacatctattcatgagtcagttaacatgtctactttgactttggattcgctttacacaaaattgaaaacacatgagatgaacgttctttctcgtaaagttgatactaagtcgagtgctttggtttcttcttcttcttcttctttggatgttgatgcttcttcatctaagtcttcttttcttgctatttttaatgccacatccgatgatcaactcgaacagatcgaggaggaggatttggctttggttgctaacagaattgctcgagctatgaacaatgccaggtccaggaaaagaggtggtccaaatcgttgctttgaatgtggttcaattgatcatcttcgttcgcattgtcctaagcttgggagaggcaaaagagaagacaaagatggtgagaagaccaacgacaacaagtcgaagggtacatccaaagggaggaagatcaaggagaatctcaagaaggcttttgatcaagtctacgccgtgtttgagccactaagcgatgtggatggtgatagtggagatgaagctaagggaaagaacatctccggtgtttgcttcatagcgcgtggtgactaggattcagagtgtgagaacaatgaggtaagtgcttttgaggaagctattaatattttgagtgcaaaaaataagaagtgtgagaagatgtatagaaaataggaatttatcattgaatctctttattctgaaattgctagattaaaatctcttattcctaatgatgatgattgcaaaagttgtgaggttttaatgaatgagatttcaaaaatcttctcttggatttaataaatcttctcttgcttgtagttttgctttgcacacacgtacgcagggtgagttgtttttaactaaaaagttgttgcaaaaatatcaaattgcttttcatgctagtttgatgtttaacatgatttgtgctaaaaagttaaaacaatctcatgatgttttggattgctcaacatgtcatttgaataagatgaaattgaaagatgctttaggtcgtgttgagtacatggaagacgttgtgaaaaacaatgaagtactttcttgccccaaatgtcgtaaaagtaaaggtgtcttggtagattgtgaaaattgtgctaatttggaaaaagaggtttcttatttgaaaaattctttgctaagattttctgatggtaaacagaacctcaacatgattttagatcaatctaaggttagcacaaataatcgtggtttaggtattatgctcataattctagacatcctcctgttgtgttaggtgttggtgctagaagtggtgagattttggttaaacctgatactaacaaaactgtgtttaaatctgctggtatcatgtctactttgagtgcatcttcttcaaaatccaatgttgtgcatgcaaaacctcctgttgttgcttgtgttgctaagtcttctaattctaccaatgtgtctaatcatcgtgaaaaatatacttattctttttgtggcaaagatggacatattgttggtttttgtttcagattagctcataaacagaaaaaggagagagagattacttttgcaaaatcgaagtggtaaaaatctggttttccctcaaggaaaccagacagaccgcagtaggtcccgcggtcagaccggcgaccggtcagaccggctactgtgcctcggtcagaccggtggtgaagcggcggtcagaccggctgcacaccctcggtcagaccagcctcggagaaatttttctgaaaattctcaaactgtttttgcacgtggatatatgcctattggatctactggttgtgtgtctcagtactagataatttttattaacttctaaccccagtactgaggcttcgacttctgcttgtgtgtaggctttggtggcaaggaaggaaaacgtgtggatcgtggattccggttgttcgcgacacatgactggtgataaaaaatggttcacctctctcaaaaaggcatcaaagactgaatcgattatctttggtgatgcttctactagtgccgttctcgctataggtttggttaaggtaaatgaaaaatttgaattgaagaatgtagctttggttgaggacttaaagtacaatttgctttcggtttcacaaattgttgataaagattttgaggttcactttaagaaaactggaagtaaagtttttgattcttgtggtgattctgtgttgaatatttctcgctatggaagagtgtttaaagctgattttgacaatcctatttcacctgtgataacatgtttggttgctaaatttgattaagatgtgatgttttggcatcgtagacttggacatgttggttttgatcatctcactaggttaagtggtttggatcttgttcgtggtttgcctaaacttaagaaagatcttgatttggtttgtacaccgtgtcgtcatgctaagatggttgcttcttcacatgctcctattgtttctgtgatgacggatgccccgggtcagctattacatatggacactgttggtccaattatagtgcaatccgttggaggaaagtggtatgtgttggtgattgctgactatttttctcgatattcttgggttttctttatggcaactaag

SEQ ID NO: 64521 - DNA, 2128 bp, Oryza sativa
catccatgatcctcaccctcgccaagttatgggctatcaaaccggaaaaaaacgaaattaataagaaaacatcacattaattacagcgataagaatgttgaagatctctcccaatttttgcgcgtttgatcgagtcttatacggcactatactatacggtgcatgatttctttgatagttgctctcacacgcggcagaacgcgcattattaagagatgctccgcacgcaatcctagtttcatttgtggagacttttattagcttgatttcgacgaaacaattttgcacaataaggcataaataatttttaaaaaatatcttttgaagacagcaactctatgacaatgtccatgtgcattatcttttcccgtcgtccaataaaacgtgtccaaattgcgtgatagtaaatgacgtagcattatattaagtatatagttgtgttaactcctcctagaaaaaaacaccaaacaattttgctatacgtttatcgatatttttttaaaatataaaaaaataattataatgtaattacattgtaaacttacatgtaactaaaatataaatataatttgtacataattaacgttcatgtaattttggatagctagatttactccacatgaaaaaaaatacacggtgcacatggatgagggcattcgatccaacgacctcttgagaaacgtttttgaaattaatttatagataagttatattgtagaaacatgcaaactacaatataattatactcaattatactatattatttacatttgataaattttcgagaggaaactacttgtcaatagatatataggtagtcccataaccctgtatacatatgtgcacacataatatgactatatatcacgtgccttcagaaatatgacttatttaaaaccttatttagaattatgtaaaattgttgaaaaaaatttcttgattagtggatttaaaatttataatgattaaatatcaattcaagtttggattgctatttttgtagtttaataataacaaaaataaaactatgaaaattgtcttaataatatgggatattagtacttccttggttcatatccttagtgaaaaattggtaagacaaaacatggggaattgacattttttttaattcaaagcatttaatttgtttttttctcaatgtcaagtcacaatgttgatatggttgctcgggctttgtgtttgattttgggccaactagagcaacaaacacaattgattgcaaaaaattggcatcttagtgcatggattgggcaaagtcaatactttaacaaaccaaatgaagccaaattgcactactaaaaaaaaaattctaggcggacattcactctatctgtacttcaaggcctgcgaaaatacgtccattttcacaggtggccttcagttcgcctacaaaaatcattttcacaggcgtcctctccatcttcgcaggtgctagatccactcgccgccacccccccttgggccagatttagggttaggtttttgggagggagagggagagggagaggtaggggagtcgcaccgtgccgtcccatccggccacgccgccgccgtcgccactcccctcaccagatctaggagggagagggaggggagccgcactgccactgtcgcccctccccttggccggatttgggagggagagggagtgggagagggaggggagtagaggggagccacaccgccaccgccctctctggctgtgccacggccgctgaccctcccctccgcctgatctgggagggagagggaggggagccgcaccaccaccaccgccctccccccttcggccacgccatcgccgccgcccctcccctccgccggatctgagagggaaggaaggagaggggaggggccgtccgcgccgcctcctccgccgctagcaccggctgtggctagccctccgccgttgtctggtagagggagagggagagaggagggagaggaaaaagtgagggagagggagagaagtgaaggagaagagtggagcgagggtgaggcacgactgtggaacttaatacaatttaatagtgttatcatatcttgcaggcggaccacttaaggtctcgtatgcaaaaatcatattattttttcatgcgaaaaataa

SEQ ID NO: 64522 - DNA, 5829 bp, Oryza sativa
ggcacggggctcggggcgggacgcgacgggcgccggcgtgcggcgcgcggacgagcgacgacggcgacggacgagcgacgcgacggcgacggacgagcggcgacgggacgggcgacgcgatggattttagtttatatttcctatatgaatttgattttataatttctaaatcttgcataaatgaagtttactcaatatgtgtattatctcaactaatgaattcaccctagattaatattactcttattttatttttatgtaatttatttgagttttatttagggttaattcttattccatcgtatttaaatttaattgatccaaatatggtcgcgataatattttatttatttctatcccacctaatctttattttaaattataatttatttatttctttaaccaaatctaattgcagggttaattcctaattatcttacaataggttagaaatttctatcgcgagctaaatatcggacgaaatcctagaattatcttacaatattatacgatttaatttagtctatgactaaatgattaaatataatacatggctaaaatccctagtaattaaatccgaatttctaccgtgaattgattacttacatagattacccaaaaataatctataataatctataagaattcatctaattgtttagttattaattacatctaaattactaccgcgaattgatttcctttagaaattaccaagaataatctataatttatattaaattttgcaattctacgactataattaatctataattaaattctaattattttaaattttataaactattaacctccctattctatttccctttttctcttttcttttctttctttttttctcttttcttttctttgtttttctcttttcttttctttccttttctcttttctctcccacgttttcttttctctttctctcctccctttcttttctttttctctccctcccggcttcttctccctcctctctctctcggctctctggcgacggcgaccgagcaaggggaagaggcggtggcttaccgacgacggcggcagcgacggcggcacgacgacggcgcacggcgtggcggcacgaaggcggcggtgcggcggcgcgagggcggtgcgacgacggcgcacggcgcggcggtacgaaggcggcggcgcagcgcggtggaggggaagggggaaaaaggaggggaaggaggggggtggtgtgggatggaagggcgaccggggagggggggtttatagggcgcgggggaggggcggacggcgcgcggcgcgtggggcgcgagacgatgggacgtcgacggcgatggatggcgacagcggtggcgcgcggctcggggcgggacgcgacgggcggcgcggcggcacgggatgggcgcgtggcgcggggcggggctcaaggcgtcggcggcatgcgcggcgcggcagtgggacgggcgacggcgacggcgtagtagcggcgatgggacggcgacgcggcgacgggacagcgcggggcttggcgcgcggcgatgggacgggtgcgcagcggggcaggggcgcggggcgcggcagcggtgatggtgacggcgcgcggcggcaggcggcgatggcgacggcgacggcgtcggacggcgacggcgtcggacggcgacgcgacgggcggcggtggcgcggggcgcaaggccggctagggcgccgtggtgagagaggacggggaagggctaggagaccacatcgaacacctatgccgtaatgaacagtgacttttcctatttatcccgattttagcccattttctatttaaatatagccctataaattctaatttttgcataaatgaagtttactcaatatgtgtattatcccaaccaatggatccactctagattaattgtacccatattttatttttatataatttacttgattttaattagagttaattctcattccgtcgtatttagatttacttgatacaaatatgatcgcgataatattttattcatttctatcctcacctcaacctttattttaaattgtattccaattatttatttagcccaattaatttttttagggtttattcctaattagttattctttattcacgattaatgaacttcaaaatcaaatccaaataaaatagacgaataagatcagcatgatgcaattaatttaaaagttttcgaaggcccgtatttttagagttttgtttttattggtcaaattttcagggtgttacacgggctcaccattgcaggaggaatggtcggctggggatcattggaccgatgtgcggccatgcgttcatcaaccttccttgccacctcctcttgcatgctgagctcgtagctcgatactctaaactcaaaatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggcgagcagctcgtccctctctctatccggtcggaacgtgccatgagaagaggcttccactgcgtctgttagtcgacgcgcagcctctcatatctgatcgccgaagaccagtgagccatcagctgggttgagcgttccaccgtgagcatagtaccagaacttcgatcgttccggccaattagcggtggccggttcgatacccctctcaagcaagctagcctccatctcctcccacttcggcatcgagacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcttgtacaactctcccttgaagctctgaaactgttctaccattttcttcagagtccaccttttcactttgtcctctgtacccgcgggaagggtgaatgtctcgagcattgtggtccacagcatctctttctccgaatctgggacaaagctctcatgatctccgcgtgcccttgttcttcgccagtacaccgtactgacaggcaagttatcccgcacaacccaaccgctgtgacgtacatagttcttggcggcttctgccggggcactaggtcgtccatcttcttccacttccgttatgatgtgccgaccctcaagcttcttcgcggcacctcgttgcccgcgtgccctcttctgtccaacggagggttgacttccactagcctcctcctcctggttcccctccacatccctttccacgtgcccctcctggttcccctccgcatccctctccacgttcccttcctcgttcaaatactggtttggatcctcgttcccctcttcttcgttccagtactggctgcttccctccacgattgaatcgtacaatatctgttcctcatcgcgatcagccatctgttcatacaggaaacatctgctaagtcatgagacatttatgttttaacaatcttatattaaaactcaaataatcttatatgctaagactaaacgaacagtcatgtatgctaagtgtaactgtcgtatattagaaccctacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactcaaataatcttatatgctaagactaaaatagtcatgtatgctaagtgtaactgtcatatattagaaccctacacaatcttacatgctaagtctaattacaaatctaataatcttatactaaaactcaaatagtgatgatatatgctaagtctaggtgacgtatattataggaccctagctagtcaataattatatactaagtctaattacaaatataataatcttatattaaaactcaaataatcttatatgctaagacaaaaatagccatgtatgctaagtgtaactatcgtatattagaaccctacacaatcttacatgctaagtctaattacaaatctaataatcttatactaaaactcaaatagtgatatatatgctaagtctaggtgacgtatattataggaccctagctagtcaataattatatactaagtctaattacaaatataataatcttaattgcattacaaatataacaatcatatatatatatatatatatatatataggaaaatggttctatactcctagggagtacgtactccctctcccatccaccgttcatctgatcgatcagatatgtactccctccctcatcataacgggtttggctcggtggatccgattagtttttctaattaaaagaccggactgcttatcccgtaatttggggtttgctcccaacaggccaaacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttcgatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcatgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataattgactagagaattttttaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttcacaatttaatttaatataattgctatgctaagtatatatgatgattacaatttttattaattttaaatcataccgtatgtatatacatatgttaattagagtttttaccaatttaataatatcattcatatgctaagtatatatgattattagaatttttaataattttaaatcatatatttgcttattacgttttatccacttaatttattacagacaacaataatttttcgaagtaattgtcattaatctttgtactttaaataattgtaatgcattatcttctattttagaaacacatatgtaatggataataatatttagtgcgcttatcagtagtctcggttcttaaccctaaccgggtttaaaaagaatttgaaaatagcgggaaaatatctttagtcccggttgatgacaacaaccgggactaaagatat

SEQ ID NO: 64523 - DNA, 2192 bp, Oryza sativa
catctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgggcctgtctctttaattctgatggaaagtaaacaaaaaaaaatcgttgaccatttatccatgttgaatttttctgcagacctcacgagaagcaaggaccacagaatttgatcccgctgcattttttttttttctaattggagtgtcacgtatacgtaaaattaaagtcacattggattaaaaccggttgaaccgtgaacataccatgtagaccgaaactgctatcaatattatcgagggattagatattattggttttagaagtcgggggaagctatacacggtacctggtattctgggatcgagcagatgtgcaatataaactctgtacctgtcatggcaggtaactctcaaagtcaaacttttcttgactggcttaacactggttatctgataatatcggtgccatcatgttctaactgcctatcaatcttgggaccactatgtagatgaacagtataaccaggctcatcgagctccactgatgatggctctcactgtctggtatctgggctcgtagctgtcttgtctgggcctgtactctcacgctgggctttgggactcttcgtgagccactcggtaccgctgtctagaatccgacatcgaaatctgcaaacacccactcgcctaacgttttacccaccacaatcatgatatttttacctttggagacgaattgcagttatgaaagctacattttagccttgtatttgtgcttaaaattttgaaacgccaacttgtcgaataacatatatgttttaaaagcaacaccgaataacaaattttcgtgagtgggtacacatatatatatgaatatataattttgggacatattcatcacagtacctcctgtcttgcatagttccatgcatgatctgaatggttgacacatgcacgccaggttgatttgcaaatatatagtaattttcaacagaaccagtacgtgtaaaatcaaaattctagcaaagaccgtagatatataatactccctcgtttcatattataagttcgtttgattattttcttagttaaacatctttaaatttaatcaaatttatagaaaatataacaatgttttcaacacaaaacaaacatattatgaaaacatattcaataatagatttaatgatattaatttcatattttagatgttaaatttttctataaacttaataaagtttgactaggaaaagagtcaaacgttttataatatgaaacggatgaagacacaacatgaagatcaacgacaatgcatcaatccatggtcctcacatatatatcggcagtggtagagtttgatctgctgatcagttacacgaatcagagcacaaacgtgctgtttatatatatatatatatatatatatatatatatatatatatatatatcatacaacacacacaatatggcacaatggtggcaaggtctgtttaatttgtgcacgtacgcaattacgcatgcagctgatgagcagccacaaacgctagcttgcaatgcatgctgacacatttttttttcacaacgcctaatgacaatactggttatgatgatctgacgaacacatagaattactgcatcgatttcttcaggttgatcacgctgttacgtagccgcgggtatcgacgccttcagatttcatctgcaacagatacaacacactttcagatttcaactacaagagatgtaagaaacagttactgagttaattattaagatgaatgccagtaatacatatactcccttcgtttctaaataactgacaacatttactttccatttgaatattgaacattgttttctctcaaatgttagaccaaagtgaacaaaagtccgatgcttgtatttaagatatagcacactttaataaca

SEQ ID NO: 64524 - DNA, 3086 bp, Oryza sativa
tcaaaggttgctaatttactatattttgggacggaagaagtaactatcagtactagttaaatattttggaataaaagccgtactcccttcatgccaaaatataagtacgtttggactctgatatggtctccaagatgctatttttggctaacaatatatataaaagtaagatgttttaaataaaaagatttgcatattatgatagattgtttaaaaataaatctagtaacatcaattttacatgattactcttttatttttgttgcaattaatagttacagttaaaaatttgatttatcaccatacttaaaaatgactatatttttaattttggagccgcgagatacagtatgacctgacctctgatgagagtggttgaggagggtgatgtcaaagcgggcgtcggtctgcgtggttgcgatttttctctcacctcacgttgtggaaaaggatggggatgggactatgggagaggttgggcggcggtcggcggagggtcctcgcgtgtgagtgccttcttcaccgaatgcttcgcattcgcatgcaccttttgtttcttcaacgttcaatggaggaggaaagcgtccccgctggcttttaattatttttctgcctgcgaagctgaccgttggtacatggtagtaatagtagcctccgtcccctactataagctattttaacataatattttacttatattgtttaactactcgtcttatttaaaaatattatgtaaatgtaaaaaacaaaaagttatgcttaaagtattttagataataaagtaattaaaaaaataatagttccattttttttaataaaacgaatggcaaacagtgcaagcaaaatgtcaaaatcccttatattagggatggagggagtagcgtttttacccgaccgggaaaagcctatccctttagttttcaattcttatttaggtcaatttttttaagtatagtacagtggacatacacaccactatacacaacatcacactctcacatattcacgaaaacgccctcaagcacatgtctaatgaaatggaaaccaactacgcatgtctgatctcattaaaatttcattaaatacctacttatgtgtgggtaaaaatggtggatttgaaccctcgcatacccacgactctattgttacaccatcagatatcggtgatgaataagtagataatttgtggtaattacttgaaattacaaacaactaaagcacagaaagttttgcctaaagaatattacgacgtttagaagttcaggaagagagcctgttaatctattcatcgtgaacaaagtcaacatcaagttgcttggtttccgtagtaaaatagcacatccgtagcgctactagtggtagcttactacgtttgggttacgtacgtggttatcacgttaagtttttattatctttcaatccaccgtgttcatgttttctatgtagtggttaatttgggatgactaacgaaaggcctcaagccattagccagcaggtaaacgtttgtactccatgtgaccatgtagtttatttaaccatataatacccctagttgtaactcgaaatatatccaaacgacatgttctgctttttacagtttcattgttttgcttatacatatgcttatctgtattgcttatcaataacttttaaaataatttataaggtattaacataaataaatttgcatactaaataaatattgtattgctctctccatcccaatttaatcattagaatactaatatgcattactcattatgtaaatgattagataccatactacgatgtcatttatttttacacaaataaatgagtatataccggttaaatgatgataaatttaaaaagatcacaaaaatcttttcaaattgggataaagaagaaaataaattcattgcatttgttcccgtcagctactagcgagacttcccggcacataaaacgaagcagcgttttagtacgtgattaattaagttttagctatttgttttaaaaattgattaatatgattctttttaagcaactttcgtatataaattttttttttataaaaaacacaccgtttagcagcttaaaaaacgtgcgcgtgaaaaacagacagaggagttggtaacttgtactaccgaatagagacttggtcctggtcggtgctccacccaaagatacagagcacctacacacagtgacacacccaccacacagagagagagagagagagagagggggttgtggtccttgtggacttgtggcgatgggtggtgggggtgctgggggtagtggatgggccgcggagagtcgtcgcgtgcgctttccgttgttcatttttgggttttgcgcttgacatccggctccggcgttgctgcaagaaaaactgaccgttggatggatggatggccgtggtccactggtcctcgatactgttgcctgttggtacggcaccacaccactctgtttttattagaggtaagtttgatagtacagcccactaccagctctaaatcagtcaatgtagtagctaattcatataatagttgcttgctatactattaatatctggttccacctgtcatacacacattacgtcttggagcctgtgctgcaactggctatagatctgtagcccgctgctcttctctctcttcatttatctctttaaaatatatttatagctggcttatagcctgctattatacctactcttactgcaccaaacccacaaggtcactgtgcctttcgcttcggtagcagtcaggtaggcgcctaggtgcataggcctctctctctctctctctatctctctcggtggtgttctgttcatcacaattcacagctcatggcttggccagtttggcctcatcactgcactactcaacgtaaaacaaaatgaagtactgtagaaccaaggcacagaagccacggtagatgtcagaacgcagtattacttgtttcatcaatcacttttaataatttatattttttttcttttttacttccaatcatcctctcatatctaaccataaatcatttaataagagacattataatatttttttcctcgaacctaatcaatactgcaggcctgt

SEQ ID NO: 64525 - DNA, 2546 bp, Oryza sativa
tcagttaaccatccaaaactattcatactcaaactcccttaaactattaatccatcatttcgcctataactagttataagccataacatttactagcaaacaaaagtaatacatagataaaattagaggttgttcatattatagccaaaataaaccttacaattttggcaagttgataatattattaaaattttgataggatttcttatatatttaccaaagtttggtaattaaatgtagacactttttttttaacaatcttgtcaaaaagaagttatggttaaaaataacatcactctgaacaacccctagtatacatatgttgtgaactatgatgaaaacatcaaaatcaactttaaaattaagattaaattccaattgtgattgatgctgataaattgaagagcaattttaacttcagaaaatattttaaaaataatttaggtttttcacatattttcaaccacttaatttggttaaaatttggccactcaaatcggtttttactttttaaaagtataaagttttattccaaaagtactctcattgcttcggtttaccaccttttcaaccacaaaaggtaaacggtaagaaaacactacaagcttgtttggcacagctccagctttctttttctgagttagagtccaatcaaacagtttcggatccatctaaaatgggaatagagctagatgaaacattatcacaaaataaaagaggtggagttgagtttaaacggctacacaactccactccaaacctaactcctagagctaaaattaagtgtccctttgaatcacacgatttaaaaaacaaaggtatagggaaacataggattcagacaggaatgcaagtctaaaataaaggattgcaaaacataggaaaaacataagaatgatcgtttgattgttggatcacagtaaaaatacatgaattagataaagagagatagtcttaaaagaaattttctaaaaggttagagtttttgctaagttttctccaaaatctatatgcaatgagcaaatttcatatgatttaaaaagtttcaatcctttaaatcaaataaccacgtagaaaaaaagtcatatatgagtatgaaattacagcgtagaatcctttgcttggggccctaagagtgacactctaccaaacaagtcctacttctatgctaagcgaaacgatatatttacgaacacaaaatataatttgtgaataaaacttttatatacgtgtagcgatctaaataaacactgaaaatttaaatttcaataaaaaaccctaaaatcaactttaaatttaacactgaaaatttaaatttgggctaataaacatatgcaaaagttaaagccgtaaattgccatgtctgttcatcttgcttatcagaacggaataatctttacacgcgtggcatatagtatgttcttgcaaatttgaacactcgaggccgcgaaagttccagaagaaacgcgttccactgcaacacgcggacgagcgtgacgacgtcagcgtcctcggaacgcaagggcactccggtaatttctccaccccttctcttggcctataaattgccacctgcgccgcggcgaaagaacgcaatctcatcgcaagaaaagaaaaaaaatcctattcaaatcgaaacccctctctttgatctcgtcgccgaggaattaggaggagagagagcaatggccgccgaggagggagtcgtgatcgcctgccacaacaaggacgagttcgacgcccagatgaccaaggccaaggaggccggcaaagtggtacgtttcctggcgcagaattttggggattttttttttggggttttgttcaccagggggtcgcggttcgtcttagatcgataggattttgaagaaatttaggatttaatttcttgctgagatttgtggcatgtggtgaaatcgcgaggagatcgattgtttctattttggcgattggggcgtagggttgtcgcggatttggggattgccgattctggtgggggagattttagtagtagattttcatgaatatattttaggatgatataatgaacaattcttttaaaagaaatctgttgcagtaattacagggcactctgtatttgacatgattaatcgttgatgtttggattttaccatgagatggggcgatttgatgcttacatctgcaagcgaattttcatccgctatctgtatagtatttgactccataggcgaaattgttagtgtttaaatttaccgtaagatgggatggtgtgatgtgatgtttaggtttgctccagttgtttcatgctgatgattctctaatttgagtataagctttgtttaaatatatagatatattcttaaatagtactataatttgacatgattcgccagagttgaaggaaatctggttctaatctagttcaattgttgttatggacaatagattgccacttcacatgtcttggcattgttatgatgtgatgctttgtacagataagcgtccgccctgtagtattggatttggtttcttgctgcgcggcataaacgaggattttgaccaag

SEQ ID NO: 64526 - DNA, 10129 bp, Oryza sativa
aagggaaattgttcagggggtaccatttttcagtcaagatgatgccacatcacacccgtgtggcatgccacatcagtgccacgaaggatcctagaggagctgtgatgaattggaacctagatgacacactttgacaacttctgggacttagatatgcattttgagagtttagggatctaaatgacacacctctataagtttaaggaccgcctgtgcactttactcttttaaatatataagcacccataccagattttgctcttgttcagcaaattagtttgcctttaatcatgaaatgtccatcttgatttgttttggaaaaactgatggtcagaaatcagttagtgtaacttgacttgtggaggaaacaagtatcatatgtaggtatcatccctttacaagacaccgacagctgacagcccaagttttttctctctctctaatagacagccctaatgatatttcttaccatgatcagggtagccctacagagtatttgacattgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttataggaagagcaagaagaagctctgaaacaactaaggaagaatctggttattagagcaaaacccatgccaagcttctatcaagagggtcccccacctaaggttgaacttaagaaggtgatgcaccgatctcctgctatatgtgcttgagctaaaatgattatttctgtttttcgatgtgtgctcattattgttcatgttgttgaatgcaattttaattcaagtgataatatctcaacccattactgtttagatcttttccctttaattgaactgattgcgtatctgtaaaaacatactcgactacatgcttgttcctattgttatctacataggccctgttcaactgcacttgtttcaactgtagtgcagccaatccaaacagtactatgtgtctgtagctgctgcagcaagggctgcattgcagtgcagccgaacagagccataattaaattgggaataccctgaatgaacaataagagtacgagagatgtcccaggcttttacattacttaaaagtagttaatgttttttctcgaacacgcagggaaaaagaatagctaatgtaaatgcagtatttatgttttcctgtatgataataatagaagtgcacaatgttgcatgaagcattggtatgcaagctgctggttcaactggcgaccattaacttgccaacttttagtatgtgctaaacttgccagcttttagcatgtgcaatgttggtattcactttgtcttttatttataggtgcctccaactcgtgccaaatcaccaaaattgacacggagaaagagctgcagcgatacccctcatacaccagagggtaaaaatggaagtgcagcatgttgccggttacatcgtcacagtattgggaactccaaagaagttaacagcaggacccaatgttctccgaagagtgctccaaagactggagtagccgcaaaacccagagcgaccaagggcgtcatgaagaatgtgggaaagccaggtgctgcgaatgttgctgtacaaacctaactcatgatccattcccattcccgtgcaatttttcgatttaatttatacctcacatcgccgatgacggcatcatgtcccgacaacagtgtgtttgttgctggattattttttttgcattctccttgtaagaaccttggtacagagaccatgtggtattccgtgttgtaaatttgtcgaggttttgtaagggggtaaccgagtcagtgctgtaagaactaatctggcagccgataggctgttggtgtgacattgttgttgatgtatggcggcgttcgcagatcctatggtattgtatttaagcatcaacttgttattgttgatattgttgcaaaatctgcgaagaatgtctgcatatttgaattcgggatcgccaaaattctgggaaaaagtacagagaagtactgaaatggcaaatacctccctcatgcattggatgtctctctctacgttctgctgctgccatttggttcaaccccattatcacatggaagtacaaaactttgaggagaaaataacttcgaaatgttggatgcacacttttctttgcaccaaaaataagttgtcaaaagacttgaggtccacatttgtacgatttggttgataagatctgactttgagcaaaatcgactctctgcaaaatctttcttgcagtgagccagctgaggaagccatgcgaaaggcaagcaatgcatgcacgccaccgaccggctatatctctatatatcagcatgtgcatattggttagtgtcatgactcatgagcagttgtcaacatgtcaggcgcttctagtacagcgacctgacgaaacaaaaaaaagttggaaagcggcaaaaacacacttttgagtcatcaagaattgtctttaaagccatttaatttccaaggagacttttgagccatatcatttttttaaaaaagaaacacgttataaaaacaggtgctcatatacgtgtgtacatacggggtacggcatctacccaaaaaagaatactagatttaaaccactcatgacggaggaagtaactagttgcatagctcaacttcacacttttgagccattttctagaacaacttatttgaaatgaagtttccttttctcttgaaaacgtttgcaaaagcctagagcccaacaattaactgaactaaacatgcagctctcatagaacaaggggtggcgatcgagctcagggttcactatctgggattgccgaatcatttcaggacaccaaaaaatttaaatttcggatgttgaaaaaaaatctgaagtttaaaatggtttactaaatctaaagaatgattttttttccatggaaaaacgtcctacatgaacccatcggtacatccaaaattgggaaggactggggaggattatgtttgtatggaaaaacatcctaaacgaatccaccaataaacttgaaatttcaaaaaattaggtcagaaattgtgaatttttacgtgttacccctgtttcaaattataaggcctataattttttacacgatttttaataacatattttgattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaggacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaattcaccgagcctgttcaataatatggattttacagtaatttcatagaaaatagtttaacctgtatatgattgtagcattctagaggaagtaaaataacttggtggcactatgaggatgtgctacttcaaaaatcctctttccaagtcctataataatcaatggattgacgggctgatagtggtagagctatgaattttgtaaagccatgacaaaccttataacccaaattaactaagactatatatgttacaaatctttagttaatttgggttaagactatatatgttacaaagtaaccttataacctcattattttgtgtttctagctgggatgtcgctcggcaatagccattgcatgttcttccacctgtgggccgggccagctgattccacaagtttttgcacatagttatggtatatatataccattgatacttgaatcaaaattcatgaaattttaaaggttattgaggaattgactcccttgcatagggcgtgaaacattggcaatcatccattcagcccaaaaggtggatcctcctagtagatgatagtcgattcgactagtgttatcctagagattctaggatcgggagttagaaacagagtacctattagtaatgagtatgtgcataactttctagtatgatttcacagttaaacgttaggtactataaatcattaatatttgaattaaaaatcatgaaattttaaaggttattagggagttgaccatcttgcagggcttcggttctaactctgtcattgtcgctcgaccttaatggtttgagggcataaactcctagccatccatcccgcctagaaggtggatccgcccttagatgatgaaagtcgaatctaatcagtgtttatactgctaaagattctaggatctggggttagaaatagagtacgtgtattaaggaatatccgcatgcacatagctaacttttctaatatcaagccacaatcgtgcaacatacatacatgcacctaaaagttgacaaaaactcctaaccatccactgttgctaaattagatcgtgcagacaacattctccttcttttgacacatgagcagggaaaaggtcaccctgcgcacccatgcatttccatgttgcttcccctggaaaaatgcatgcacgtacggcagtctgaaaatgacaccaccgatcactgatgagtcgcacaccgtggtcgctctgtgaattgatgatatatatccattgacaacctcgtcaactctgctcgacagcttatctagcaaaatttcaatttgaaagttatttttttactgatcgatctaggtatttttacatcatatatagtctatatattttctaactcttgcttataaaatattaagggcccctttgaatcgtaggattgaaaaatcataggaatatgaaaaacacaggaagtattatgataggaatacaagtataaaacagagaattgtaaaacataggaaaaataaaggaatgaacatttgattggaccgcaggaatcagatgagagagatagactcaagtgaagttttacaagaggttagagtggatgttaaatttcctacgtttttcctctagaatcgtaagaataggaaagtttcctacgtttttccttttctcatttctacgaatcaaaggcatggataacataggatttcaattcctttatttttccttcatttatcctcgaattcaaagaacgcctatgtttatattgtgtttcttaaaaaacagtggaagtgcaaaatattgttttaaattatttttggatgcttcgtttatcctttttatgatttaccagccgtggctcaaccaatcagtcacttcgtctcccctttgcgacaaattattaacgttgtttctaagtcaaattccaacgcaaaacgtctctctctccccatactccagtaactccactagtgatgacactgcacacaggcgatcgacaatatgtattcatgcatgcatatgcatccgtgtgactataaatatgtgcagagagtgcaaggacctactgcaagattgggcaccgatagaattaagcatttgatccccagtcaaaaaaaataaaaaataagcatttgatcgatcgatcgatcatgaggtttaccgcagtggtagcagctattgttgccgtcattcttctcgtcttcctggtctccggcggcatggcggcgcggccgatggtcaatatggagaagaccacggccgtgccggttgtgaggaaaagtggtgtggtggtagagtcgtggacgatggagagctcgtcgctgccgtccggctgcaccaacgggaatggcgccggtggctactgccgccctcctgctcctgccggtcactaattaattaggttgccgtcaaccatcataccatatggttctatataaggtttaccgatcacaaatttgatcatgcatatagttaagatttagcagatgaagcttgatcgtattcttatagcagtatataggatgaatgggaaataaaatgtatgaacatgattgtaaattcttggtacaccacgcctccagatatgtaaccccaattaaagattatatatttatatgatattgataatatttgttgttatctttatcctaaactagcatggtggcccgcgcagattgtgcggctagcatcattatattttctctcatataatagcatatatgttttctcattatattattcaaatatattaaaatgacaacataattttaaattttgcaataactttacaaaactactaatgtttaatattcatattatattttatatatgtgttagttattaattatttttaatattaaattttagttatttgtaaattatatatattcctatatggactccagactcgttttttaatatttctttttttttattccgaattttctgtaaattgtatttctatatagaccctatgctcttcttccaatattatttattttaatttctgaatttttattatttctaatggtatttctatgtggactctaaattcatctttcaatattctttaatttttaatttcgaatttcagttacttctaaattgtattcctatattgaccttaaactcttcttcccatgtttttcttaatttcgaatttcagttatttataaattgtatttttatacggactctaaactctacttttaattttattatatttattccaaattttagttagttttaaattcctatatggactctattctctacttctaatattccttaattttttaattccgaatttctattttttttcttaattgcatttctatatggactctatactctacttctaatattccttatttttaatttcaaatttctattatttcctaattgtatttctatatggactctatactctacttctaatattccttatttttaattccgaatttcagttatttcctaattgtatttctatattgactctatactctacttctaatattccttatttttaatttcgaatttcagttatttcataattgtatttctatattgactctatactccacttttaatattccttattttttaattccgaatttcaactatttctaaattatatttctatatggactctagtctcctcttctaatattccttattttttaattcgaatttcagctattttctaattgtatttctatatggactttgccttttctttttctccgattaatgtgagaatttctaaaccatgagagcgaacatggaggctaccttttctattcctttaataatataatagattatagtaatttttaactatatgtccgaacatactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatattttcctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctctaaaggggtagcttaagacttggcgctgatgataattaattagatttattttttcacgaacgcgtaaaagattgctcgtaaatatatggtaagtagatttagatgtaactacaaggtgcctttgaaatttcaagggatttgacccatcaaaagccagataattataaatatttgatctgtagtcatcttagataaactaatctagttatgtgttggctaaaattgagacccccccctttttcacttaatttcggtcatttttatcctatttgattgcttcctctcctatatgtaaacatgcttatttctcctatctcttcttccaaatggataataaattatttttaatcctaattctcttatacatcgtgtattagaaaaatcacaatgaaaattacaatataattactctttaaatttgaaaaggcacaatataattataaatgcaagaatatatagtttatacaatataaaaaacaatttgattgttcttttgtgaaaatatgacgctataagtataactactctcccttttgagataacgtgactctacaacagacgagagaattattgccatctatatttggtgagtcccagccgtatctatagattcaatgaatatggccacatgcccacatatagctagcactaatatataccatatccagagacatttacagtatataccaggccccgggtcgcccgggccactaagatagactttatgctccttcggttaaaaaaattattttaacttttagacaagtttttatcatacttttagactttggccatcataataatttctcaaatgcttaatgtaaaaacaatgaagtgatatgcatagatatatcttgaaagatataatgatatcacagatttattagattttttactcttttttaaattattctaatagtattggtttcaaaagtcaagagaatattatcttataaatgtcaaatatttacaacatgaggaatagcattagttttcatcatggtagcaacaatgtgtcctaaagggactggcccaagccgtggcccattttggttttctcctgacccacaatgctaatcactctagaatgcagttattcactttttttcttaaggggctaataatactcatacttttccataattccattggtttgttttgtgctacaaattcaaaaagtaatagcacaaaacgccatgttagaactataactactactccatccgtttcatagtataaaacgctttgacttcttcactaatctaattttttaagtttaactaagaaaaacatagcaacaatttcaacaaacatactatagaagtattttcaatgtgggattcaataaaactaatttagtgctatagacgttgctaaatatttttataaattaatcaaacttaaagatgtttgcttgaaaaaatattttataatataaaacggagggagtacaaatctacgacgatgatcagaatatcagatcacactgtgcagtgtggccaaaatgtccatgggagaaaaaccagccactcctgggccgatagcccggcccatatctggtcaagcccaccaccagggcccacgggcccatcgtccctcctactcctccttcccctcgcgaaaaatatattttccttttccaccattcccaccgccgcttcgttcgccggcgatcgatgagcgcggcggagctgtgc

SEQ ID NO: 64527 - DNA, 29897 bp, Oryza sativa
atatatctcatataatctccggcaatatcgttatctaacctccaatcggctaacatctgttactagaaggcagccgattaggttaagtagtgacgttgacatagattatataggatatccaccactctatgaaacatccacgggcttgattgtctagatattgtctttcttttcatacttatagttgtatcagttaagtttgaccttataagtcgtgattaggatctcaatctctagcctgcttttggttgccgattagggtagcatcggggtttcagccaatcttacctaatttaactatatttatctcatatgcttgattgacatgttaaatctgccctttatgttaagatcttgctgcatttaagtatattaggcttttgtttggtatattttacttgctttgatatcttaatatagagtggtatcggagtattacccaagacacgctagatctatctgatcggctatgctatgaacatatatagtcttattgttaatatatatttcgatctaagtgatttatactgtctcggcatggcgaccgatctatcccaatcacttgatttaagtatatatcgacataaaggctacatattgttaatatctacagccgatcgagtagatttagttctttcttacttatttatgattgccgatcgatctatatgtgacatcggcttaaaaataaatgatatgtcatcggccactagccgatcggctatcgtttatagatttaaccgcggtttctttgtctttatttcatgttgattgcatgatcaaatcaactggcatgctcacgaacctaaaggccagcttttggacctgcactagagttaagcagatttctcaggccttgtgtttttacatcaacaatagtctaggaaaggtctgcacgtcgacagtgcaagaagcgatccagggtggcaagcgacgtgtgcggcgatgaagagcgtgtacaaggtgaagaatagccacgcacgggggccggggcgtggagatggcagatcgacttggtagggaggtgtagcaggacctcgagctacatgtctggaagcaagatgcagtccactgcggcggaggatgacgtcattgaggatgaggagttgagactagcggtgaaaacagatgtgtactttggccagcccgcccgactgactatacataattcaacaattacagcttgcacctatttattccattctaaaactataaaatttgcttaaaacaaattttttaccatgtagaccacaaaagcatttataaactattatattgaagccacatcagagtgttctattatagctgcaagtagtcttggcatcgggggcatatcaagctcatgtagaccctcaatggcccggaccacttcacccattgtcggccgatcagactcaatttcttggatgcaccaacatgcaactttgcaaactctttcagcctcttccaaactgaagtcgtcatgtaatcgtggatccatcaaactatgcacatctcccacatgaagcttgttaattgctcgcacaggaaaataagcaccatgatagctgttgctagcagatactttaggtgaatttctccttcctgatatgatttccaatagtaccatgccaaagctgtaaacatcaacttttggtgtaatagcaactccgctaagccactctggggcaagataccctacagtacctctgaatgtagttagaactcggctaaaatcccttcctacaatcgctgccatcccaaaatctgcaatcttaggaacaaatgattcattcagaagtatgttttctggtttaatatcacagtgtatgatgcattcgcgacaactctggtgcaggtagcacaatcctctagcaactcctatagctatttgatacctggtgctccaatttagaacggtagcattgctctgaaatagatgggcgtcaagagacccatttaacatgcgttcatacacaagtagcctcttatcaccttcgcagcagaaaccaatcagtttgattaggttgatatgttgggtcattccaattgagctcacttctgccctgaattgcttctctccctgacgagcaccatcaagccttttcactgctatagcagtctggtctcccaacattcccttgaatacagaaccaaaaccacctcctcctagcttctctgagaaacatttagtagcacgaactaaaccggtgtatctaaaggctataattccaccatcattaccttgactgccatataatggcacaccacaccacttggatttgttaatccaaatcgttaacaaaagcatgagcattagtaatccaaaactaacgacaatgcttacaatggcaacaactcttggtctccgtttgttgttcttccttaaactttgtgaatctctggcggcgaggcgaaggtaaagaacattttcagaatgattatcaatgccatcattctgattcacacttcgcaattccccatgccagatagagcatctgttaccattataggtataagcagtgcaagcgcagtcatgaagacaagcttcttcgcaatcgctctgggtcgaagcatcttccatgctttgagggtacaagggcagtgtaacaggagctatggggtggaacatgtctgttgaacttgtgttgttttgtttaccagatgcacaatctaagggagtatctctgatgcaccctccaatcggatcaccggcatcccaatcctgcggtgacttgggagagaagctctccatacatccacagaatgggactgaattgccattgcagaccgtgaaaggtccacagacatcgtgcaggctgcatggatcagatggttctgcatatatggtttgccaagacattttgggttgtgaccaaacattcagcttaacctgaccagtgatgtctatggaaacgaatacagaagccgattcatcaagggaggtgtacgtgaagtactcctcctcattgttgtggacatatgcaggtttgagcaagcctttggtccgtggatccatgtctagcagctcattgagcaatggtacaagcgtatacgccaattgtccggatgaccaagaccaatacaccacgacgggaggtttgcgacgcctaaggcgcaacaccgtgtttgtgtccatctcaaggatgtaagagccgaggcccatatcaatgaggctcttcttggcaacgaaccgacggttcaaaccggtgatcttgttcctacctaacttagcacccggaagcccaacatctgcagggtagtcgaagctctgccacaacacaacattgctactagccatgaggagtaggtttccattgttcatgaggagagcactggtgtttgtgctggatgatcctgttgtcctattgacaatggtgtgagtgctggaccagattatggactctgaactggtgttgttgttgttcaagacgatggcaagattgccatctcttgagattttgagctgtgcttgcttcagctcagggccagtgatgggattctccctattagcaacccaagctgtagtaaaaacctggatcttgttgaaccatatgccaagataccagccaggcaatgtgttggtggtggtgttaatggacttactgatgcctgcagttggttgtggctggaagaagccgagcgcgaacttgccgttcctcgagacgagcttctcgccgacagaaagcgcttggcctaccatgagagtgtcgccatctgcaatggcggcggaacatggaggagtgtgcagggaggagaggagaagcccactgagtagtagcaagacatagagaggaggtggcatggctggagaagataggtgaataatggctgaattggagaagggaggagtatatgcttagtaacggtttagctatgtagtgctggtatatgcttttatgttttatttggacaagtaagaggaatgcatgaggaatgcatgtatatacagagaacacacgcgggggactgcatcagcctatccatctatcatggggaacacatgaggtttaatgtaattcttccatcctaaaatatatcagcctagtatagaataagatacattctaatactatgaatctggacaggggcctgtttaaattcgtattattagaatgcactccgttttgtattataagtcactttgaccttttttttctgatcaaactttatgaagttttactaagtttatagaaaaatagtaacattttaaacaccaaattagtttaattaaatctagcattgaatatatcttgataatatatttattttgtgttaaaaatgctactatatttttatatgaacttagtcaaacgtgaagaagtttgattaggaaaaaagtcaaaacaatttataatatgaaacataggacgtatctcatatgttgctatattttagaacgaatgtagcataatagatgctgcaggttggagtacatgcatgtttaatttaggcagctgacaggtagaacaggagctgcaaggaccttccttggtcatgtttgttcactctcatagattcagagtttcagacagcaacttggcctggtagaggtacaacggtactcgacacggcaacgtacgatgctgcgggtcatgttggttcacatgtctactaggtcctgcagatagaagagcagagcacattcaagtcggcatgatgattgtgaaaattaatttgttcaagaaactaatggttttatacgacttcgaatcaaaccatgacctctgtatttgtgtttccacataggacacatttgctgaattggctttatgtgtttagctcacatcaaaattggaagtttggttgaaattggaacgatgtgacgaaaatgttgaaagtttgtgtgtgtaggaaaattttgatgtgatagaaaagttgaaagtttgaagaaaaactttagaaataaacacggcatgaaggagagattctttgaaatcggaaagatgaaattagcagttcttgaaaagaagaatggatgagctctgaactctctgttcgtcacaactatgttttatgccgaccaacatcatcttgaaggcttttgcagctgcctgtctttgccttgctgatggcatccacaatgtggatgacaagtggatagtaagaccccttactacttactttaccattgtgaaggactggaggtgggtagtctaccctataattcaccaactcactcttacacctacattactcattcatcaaatctaacggacagtattcctcagtgcccgatctaacgatcatcgcgtccacctcagtagtgtactgccgaggctgctgtaatcgcgtgatttatttcccatcaacgcgcgcgcctcactcccgaaatacctgccaccatctcaatctgtcgatccccttcctcgaatttcggaatcctgaagcgcgagcagtcggcttccgcacctggtgccaacggcctcgtcgatcacctgatctcttcactcgtgcgcggtcgacgttctcgcacgcctgcgaggtcttctactggtgaggaagcgtccgtagaccgctcgctaccgagaggatccggctgctctgtcgccgagcatgcgtccccgggtccctctgccgccagagccagggccacatcccgttctagcggttggcgatccttgcctctttgccatggcatgagagagctctgcagcgatggccacggcatgagaggggccctaccgtttagctgctgccctcttcgctgggccgtccacagcttctcttcgcccattaattgtgacgctgcgcctgtttatctcctccctcttgatcactcacggtcgagaattaaggctgtggcgaagtgggcggtggataaccttggaaggctagcgaccggataatcctgatacattatgcatgtccttcccaaaggagctctgctgccaagcaccataatctctacaagagcacaggctcatatatgcagggaaatatcctttttttcagttacttcagaaaggttaacaggtttgtagcggatctatcgttgctttctgacttactgtttctctgaacactgaaactttggttcctctgctggatttcatgtagatgaacgtgcaggcaaggtattggatcaaccccaataagatggtactggagatcctgcatgctgaatccaggtccaagcaggaaatggctctgctgctttgccaaaacttcatcactatttaagctctccactctagatgttcagggttctgcagatatctaggctggaaagggaagaatatacgaagtagtacaatcctaacatgctacattgtgttaaaaacaaaaactacatctgtagaattgaattgtatagcagaatttacataaattatcatcttagttcaaactaaatattaatacgaagggatattgtccaaactgataaaatgttcattatagtaacgcctgattttcagtacgacttgcctgaacctcacactaactgatcaaaatgtgcattcatgactaaacaaagaagaggctgctctctgtttctcagtcattcaacaaagaggtcggctgatcaagagttgtcttattgcaaccagccaatcttatagatattctcttatcgttttatgcatatgtatggcacaaagttatttagtgaggtgaagtctgatcctaaaaattggggaagatagtttttagatgagttgatgtcactatatcatataatttgaaaccataattgaatgtaatattttaatctgtaattgtccctgtatgctctttttgtttgataatttgagaagtcagattccttgggtgtgcgcaaacgcgcctcataatctaatgttgagcagtattcatgttaatcaatatatagtaggctgcttgggctcatatgttcacacttttggctagcagctacaaggttgcttctatcactttgtccgctgtggataatatcacgagtaaagcagcaccatcaatgcccagtacaagcctacaaggtaattttatcgtcaatacaagtgtcagaaaccatataatgctcaccaatttgtggtttatccttttagacaaactgacgttttggtttcttaccgcataaatggagcagaccaatgtcctctgcaaattttattcataatctgcctattctatataattctatatccactgttcattcattcttcttactgcacaataatcattttgtacaaataaatatgtagtagctttttgatgttcctgcaatatttgaatagatgagtgtaaaggaatatgtttattctttgcagcaggcagctaaccactgttacatcttgattagtaaaaaaatattgctttatttgcatttcgcattttttgaaaccctaggagccatttattaggtttttgggcagcacatgcttttcatgttagatttcagagcaaaatagatggaatgctacaggttggaaaataaatatcaatgccctcagctaaggccaccaatgttggcatcaattgaagctgcctaacaaataagaaaaactttgtagtgcaaaccctatatataatataaacctgaaaactactgtagaattaaaaattgaatctttggttcacgtcatcttgagtaaacttttgctcccagttttaaccatgagcaaaggttttattaggattaaaagttttactcaggatgaactggatgcatctcagatgttcatttttggatcctacaatagtttcccgctttgcactacatataaggtttgtaatacatatttttgcaacaaataatgtgttgtatttcacaacagttatgtattggtctattgtgacatagttctagcaactttaatgatttcttctgctgcggtgtaacctgtaaatatttttcttcttctcagccaaatgttattccattagaggatttaatttgtttattcaaatatcttaaatacaattttttttcatcattactctgatacaaatgacgattattgatgaagcaatagaaaaacattaagtgatgtttgtttatgcctaaagaaattgctcccacttgattgagaattgaactacacaactaaaagctgcccaagtttgtgatagttataataataattaaattagcatggatgttgacatatataaattttttatgcatgcttactaaatatcgccgtagcgttagcacgggcctgctactagtagaggaggtaataactataccgggtaatagcactgctacctggtaataggcataaaaaatattaaactctctcctctctcactccctctcttttttctacccaatcattactttacacgtgggttatatcttactatccacacattatagatggccaaaaggcccgaggcccgatggcccggcccacggcacgacattttggcccggccgccgggctttgcctgggcccctccaccggcatgttgggccggtcggccaggcccgacaaaaaaataatagggagcaaaaatagacatattatatgtcacagttcaaagaatagggacgaaaaatagacttatattagctatatatatgtcagcccaatgaggagggaggaaaaatagacttattttagctatatactagaaaatgagcgtgccagttggcacgctagctaagttagttaatagcatgtgtgtatttcccttcagaaatcatacatttgaaaaggattgttgaaagtccattcccttttatttttatgtttgtgaacaaactaagatagaatagtaaaaccatctagattagtggtattatcatgctgaacagactatataacatcgagaaatgactaaagatgatgtacattaataaaatacatgttttactaatatccaacacaattctcatatagatgtaagtcattgagttcgtattagtaggaaatacatatccgaaataaatgtgtcttcgattactattttttatactaatttcatttagaaataaaggacgatgacatggtaaagacacttattttgatttcatatatccagatatactactatgtagagctcagctggtcaggttctctacctatacgagttaagttctaaacttagcatagacgcttgtatttacggctatttgttttttcaatggtaggaaacccaccattcttcatcactcctaagatatgcctgatggcccagtcttcgaaggtgcttgtagtgattgggtttgtatgtgtgcgtttacaggtgtgtatacacacgtgtatatgaacatctatatctactgtgtttcgcgataaaaaaaatagcagtatgattgttgttacttaccaatgttccaaaataaatgaattcctagcataaaaaagtataatgtgaggagaaaaaaacaaaaatactctgaattaataggaaagtagttataaacttctcggttcacatggaaatttcacttctattccttccgttctataaaaattcaggtattttcctcgtttcaagtaaaccttatctgaagatttttaattttcctaacgcaatccttgctgtcactatttgttttcatttgatttaactatttatttattttattctcttgaaacacatgatattaacatgaagtgacttttcctcattccgagtaatctgtagtaaattgcatttgttaaaagattattatgcaaaggctaaaaatcctattatttttttctccttttctttttattcatattattttattctaaactggcttagtaatatgtacctgtatgtgctagcttcacgctgcatgaggaccatgcgcagcagcgcaggtacattgtggagaaaggccgtgcggcgccaggcccaagctcgcatggccttgcgagatgcctggcccacgttgcaagcgtatatacgcgaacgttttcccgatctctcgcgaagtgaataccgtcactttgactcgtggcaaatttttggagggggtgtaaccaaatttttagggagccacgtggcccaataaaaagccagatcccctgatttcggtattaaagatatgccacagcctaaagaggagggaggaaaaatagacttatttttcaaaaggcacgatggaccacccgtgccttcgggccggcccggcacggcccgactgctggtgggccgtgcctgggccggtggtgcagcccatgggccagcacggcacggcccggtgtgttggtcgggctatgccggcccgacagattttggcccgagcacggccgtgtctgggccgtgccgggccgggccgcccgaatggccaactataccacacattggccgtgtttagttcccctccaccaacttcaaactttcaacttttcatcacatcaaaaactttcctacacacataaacttccaactttcttcaaacttcctaatttttccaccaactaaacacagccattgtgagaggtagaaacaactaaaacctaattatgtggatcccatcttactacccacttgataaaagaatcaatttacagtggtctcgaattccggtgaactaatctaacttaatttgaaatgcttaaaaacgacatctgaaaagtcagtatcaacgaatctgtatcgacgactgcggtgcaggggagccaggaggcagtgactactcgactgatggctgccgaaagtctttagtaatttttgccaactaaacaaggcattaactgaggccgagtttagttacaaactttttcttcaaactttcaatttttctatcacattaaaactttcctatacacaaacttttaacttttccgtcacatcatttcgggcttgtttggtttaataccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcatttccaaatatttggctttaaaccaaatcatcacatttactatttaaactaccaaaacattggtatggcaacattttggtatcaaaccaaaacggcccttcaatttcaatcaaacttttaagtttgacatgaactaaacacagcctgacttggatctgaacttgacaaattttgtaccaatccgatgtagcagaccatggatgtagttcttttgtcttagcgtctgtccacctccaagcatttgcttcaatgcttagaaaattatgacagctcacctctatccttgattgcaaaatgtgctgcccttatgtagattgaaaaatttgaaactattccaaataacatccaaagtagtactagtaaagtagtaagagaaggtatttcatcgaactttcccaattcgcttcctccccatccaaagtagtagtgaagtagtaagatatgtataggagttttgccctctgatggcctctgcatgttactaatgaccaagtgtatggatagctgagatcattagttattattagttattgattggttgaattgaacgtgcttaggttgcactaactgtaatctttttacttatggcaataaaatgtttacctgattcatttacttgcgccgtgtttagttccaaaataattcttcaaactttcaacttttccatcacatcaaaactttcctacacacataaacttctaacttttctgtcacatcgttccaatttcaaccaaacttccaattttggcgtgaactaaacacacccataaacttccaacttttttcttcaaacttccgattttagttcacgccaaaattggaagttaagttgaaattagaacgatgtgacggaaaagttggaagtttgtgtgtgtagaaaagttttgatgtgatggaaaagttgaaagtttatagaaaaagtttggaactaaacttggcttacgtgtgtataaaagttttgatgtgatgaaaaagttgaaagtttaaagaaaaattgggaactaaacgtgggcttactgtgacacacttcttgctgaatgtcaggtgtatgttaaacatgtgttttagttgagattactattgattggttgaattgcgtgtagtctgaactaatggcaataaattagttacttgcttcatttgtttgtgccaaacgtgtactctgcatgagttggtttgagttcagactcttaagtctgaatttcagacaagttcagaattgagctggttgaatttcagagagtttagaattgagttggttgaatttcaaagaagttcaataaattagttacttgatatatttgtttatgccaaagtaataacaccagtagagttgattcggacaatgagggttttaatggtgtcaacagctggaattaccgaggaaggctctgtcgctgaaactgacgccggcgttttttttaaaaaaatattttgatgggtgatgccggtgattttggaacaacagcaactaatgtttctgttttatagagaatacacatgtgcatgcaccgtattgtttaacagctaggagcaatcttaaccggcattatatcaacaaggtttaggacgtgtttggtttaaaaccaatttttgctctaccaaatcttggtagtgccaaaatattggtaagttttgacactaccaaattgggttgtactgaatttgaactactgtgagtaaaatttggtagcaaaccatatatgcactttttattattgaagttaccaaaattttggtagtataataagttggtatcaaaccaaactagcccttaaactgcgtccaagcttttcaaacagctgtccttccattagctttgttaaaagttctgaaaaaactggtccaaggaagagatgaaggatctgaacttcagacttgataatttcatagcacctatccaagagaaattttaccgttcttgaggtaccacaacttcaatcccactgttaattccacaggggtgagatctgtatggggaaatttattgacacaaccaagtcctaatgactatagttggccaaatgggccgcccggcacggcacggcccaggtccggctgtgcttgggccgaggtgttgcacacacgtgctgcacacacggcctaggcacggcccaatacgactcgggccatgctggactggcccgaaggcatgatagcccatcgtgcttctccacagaataagtctatttttcatccctcaactatgtgggctatgttcatatggctagaaataaatctattttgtatttctctcctttttgggtgttgccttatatggttatttaagtctatttttcatccctgtactatttttcttcgatcgtgccatgccgggccaacccaccgtgccgagggtgcagcccaagcatggctcggctgtgaccgggccaaaatgacgtgccttgggcgggccgtgggcctcgggccatatggccatctatactaataatgacttaaccgtaacctgatctttatcctcatctttctctccagggttatcttcctttcacaacaacacggacacgcggtgatggaactccttgtgcgtggctcgctttaggctgtgttcggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggaccgtttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtcaggtgacaccgacgactttcggcaaaagttatgcttaaaatgcttattcatatattataacattatattctaaatataattagcatactataatatcgatagacgataccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggcgaggcgggtaaaaaaggaagcgaagaaatccgtggtatttatattttcgagacccaaaaagaaaaccacgaattcccaataaagaaataggcaaaattccccatctcctcgtctcctcccaactccaaaccctagctcccaccccctctcgccgtcgccgtcgcgtcccatggcgaagtcgcggccgcccaagcggatcctcgagtcctacaccatcaagggctccgacaaagtcatcaagcgtgaggctccccctcccacctccccaaccggtgctcccttcgatccggaatttctgggggtttttttgggggggattttttttgtgggggcgtgggtttcggtgggtcgcggtttgttgaggtctggaattctggggttttagctccggttagattgaatgtcgcggaaatgtttgctctgtttcgggggagcattttaatttccctgatgtttccgtgcgaaatgaaatggtgtttaggtctctggtttactgttgatgtaagctcgattcataatcagaaaaggaaaccatggtagggatatgtgagcatgttaacttaatctgttggagcgttaactctttgtggttttgattgttcatgggtttatctctcttttgcatgggttttaggacggttaatacagaaaaaaatatatgtgctattgagttatgttatgagtttaaactcatcttgattttctgttttagattatgtccagtggagcccctacatggttttgtctgggttgtgagctacagttttagcaccatgagctatgtcattttgctgatatagcgtttttaattgcaatttacgatcgccaatagtttggattcatatgttgctaatcccagttagcattatgatcattgtggtgcttatagtcgtgctgtaattcttgtagcttaacccctcgaaaaaaaaaatttcttgtagcttacgttgtgtttcagttctggttagtattagacatttgcatgaagaacaataacttctactcaatgtgtcttacctttgactttttatttaagaaaatctttatctcatggcttagaccttgtgttaagctaactaattgattctatccagttaggcatcttaagttttttttttgatagatagcgtgctttagccttaaatgaaaaacgattattttgcctagtttttctagtcttaactcttttttgtgctatttattcaaagttgatgcatgcgttctactaatcttagcttatgcaaaggtcagagatgccagattctgagatttctgacattgttctattggcacattgggattctttgggatggaaacctgcctagataaaccttaattaccggtatattacttgcaccaatctatgcaaacttaaatgcttcttctagcttgagcctccttttctatatttatggttaatatccagacgtgtgatagcaccgatgaaccttgatgcttcgattaccttgtgtgtgtgtgtgtgttttgagaacagattaccttgtgtttggtgaacttttgattaccttgatgaacagacgaatatttttcatggtttctaggagggtaatacatatatgtgctgttgagctatgttatgatcttaaatgcactttgatttcctgaattcctgttttagattatgggagttcagtctgtaagtagttttgtatctgtttgtgagctacaatttagcactactggcagaacccttctgctagatataatctagaatctgccttctgatcgtcattttgctaattagagatttttttaccatcttaatggctgtgttcatgtgttgcaaataccagctgtagttacaattgtttatggtgcttatagtcttgaccttctagcctatgttgcatctaagttctggttggttttgacatttgcatgaagactaatctctttctacacaatgtagctactgttggactttttactgaagaaaatgtttgcttaactgcttaaagttatgtaatcaatactatccagttaggcaccctaaagttttgttttggctagatagtgttctctagccttaaatgcaaaatcaatatgttgcatagtctttctagtctgaactccttttgtgctgtttgttcaaggttgattcatgccttctgctaatctaacttatattcaagttagaggtgtcagattctgaagttttgatatctgttaaattctttggtatggaaacctgcccagataaacatagttactacttacaccgatatctgtagacttaattggttcctttagtgtcagccctttgtttaattttataattcatatctagatgttgacagcatccatgaaccttgatgctttgattaccttgtgtttagtacactttgttttactgtaagcagattgcatttcctttgctctgagattatcactgtgatgccagtactatccaataccagctttacatcttgatgatgacccatgtcactattttttataagcataaaattatctcgatacctgtctgattctcttatatgtttcttgcagctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgtaagaatttaatgcaacctccgctatgtgatagccctgaaaagaacttgtttcgtatttgcagttaattccgttgacatctgcacaatattgatctgttatgtcgatgacattttccatatttaaatatcatgttatctgttgattatgttttccagtcttctttagggatttcacacatgccttttatatttgatgtgaaatcccaaggtcaacaagttcgtaattctgatgagttgatatgtgatatatgtatccttatgacctgtctagattctataggcttcagtgcatcaccagttttatctttccaaagagtcacaataactatttccctgtgttgaagtggaatatgaagggatgcataaggttttgtgcctattttcagcttgccacatttgctgttattacttgcttttggagaaaatagaggcacagtaaaatgctcttacaaacttgagatgttcttttaccgaagagccactgcatgccatgatatattatgtggtatgtctatggtaggctcgtgtagtggtgtagcccatattgcacataagtaccaagacagctagaacccattgcttactacaccgccccaatttagtgcattctgcaccttgccccatttaaaactattcttttcgagtcacatgcatgatgcatcacggctggtagaaggcttatgaggggtcagcgtgccaggctcatggaagcagctcatgccgtaccttccatctagctgttggtgtttgagatgaggctataggttgtgctggccatagtactagattagtccggatcatgtagtgttagcgaggttagagataagattggttatgatttattacttctgcctgttagggctgtctccaatcgtatttgttagagacacgatctggacaacctggtgctctcatgtggtagggtgccagtgctgcagcctttttgtccatgaggggccctccttggactgcagccatagccgccacctagaagcttgaggatgagctgctcgaaaggaggggtgcaatgtcataatgtgagaggttatagaatgttctgaaggcagcagcagtagtgaatgtgcatggttctgtcggaagccgctgactggctaacgcatcaagagattaggagctggtgtgcacagtgcacgtgaatgtccaatgacatgttcaactcagataggtatcgaccaagtattggtcgattatacataaaaaaataattagttttcttctcaaatatgtggtcaacttttctctgactcgtatgcgacacggcccagcccacatagccaggatactcaaccctaatcccatccctgtgtgccctcaccaggctaatggaattttggaacatatgggcatgcattgagtattgactgaattctaggagctatggactgtctttgagataagttttccttttttacagcttgccatacattatttcagtgtcaaacaattgaaaataatgtatacataatatttttatttaaatatgtagtgtgtcaccatattgtcgtttccttttggtgggtgggtgggcgttttgtgttgtctgtgggtgttggggggggggggatggcgaattccctgtatcagtaccatgccatgtttacggtctgtatccatgcatcataggctgaagcaacagattgctgtcgtactgtcattaagattgttagctaacttttggataggcatatctcttatccttcctataagtttgacaaggatgtttggcgcatagctagcttatataaggacacgtgactgtgtcattagtattaagcaagaaataacaaaatggttccttaccttcgttcttcttatctccctgcccttgcgatgctgctgccaaccatcagcatggtcgtacctgttcggtagagcctgtggtgttgccaaatcctaagcatatatgacactttgtaatgctgtatgccactctgggtgtttccttatcatgttagttggtttcaaatatttctttatttgaccatgaatcctcattttacaaaatggatgtcttgtttattatggtagttctatccgaataacatgaataaagatttttgcctgtagtggatgaactgcgaccatttttatttactgttgctacattctcaaccaaatatcacttatattgctatgctttgctggcctatgctatctattaaattgatttatgtattgcattaatatcatcattttatttgattttctcatccctttactaacaatatgacaggttctgcaagtgtgagatgccatacaatcctgatgaccttatgatccaatgtgaggaatgctctgattggtgagtaatgaaataattcatttaaattcatctttttcctgaactgcgctggtgtacattttatggttttatccctcttgccactgggtgaataggacaaccaattttttttacctattaatggatttgggtgtcttgcccttatcttattcttgcctattgggatgggcggcaactagttagccgtcagagaaataaatgcttttccattttttttacaccagaacaaatcactcattggctctatttattcacaatccccaaagagatttgtgcagatataaaggcataaccattgcataatgtctatactctaaattcctgagagcaaggctacaaagtgggcctctcaatatgcatggcatgtctttgttgttacatcgccatattaatttgttgaaacatgtgttttgggctgatgttttggccaataatgtaggtcgtgcttatatattgttaatgggaataagcactattacaattgccacactagactctcttaactctttccttgctgtggcaatgcagagacgaaggaaaaaatttccttgttcgcttgtcctaattctaatttaaaataaggaaacaattaatgcgctggtaaaaactatagagagatatatatcctagcaaacataaggaaacaagctaaaccccatatggcctactgagttattgttttttgctagctgtagaaccttggcggttatagtactctacacaccccaacccccacacgctctgaaagaaattcatgacctcaagctacatgtccatggaatccaccatcaaaagttaatagaattgcttttgagtaggcttcacatttcatatacacttttcagtacaatatatatatgaacaccaaaagatgaggaagggtttagcaagtgaagaaagaaatccactctactctaaactatttctctggagctcttaaccccctaatatatatatccagctccacctttcctagacctggagcccaacgaaacagtttcagctccacctaaaaggggagtggaatgggctggattgattccaaaaaatgaactagatgggtgaagcggggcttgggccgctccaccgctccactccagattccactaggagttggagccttgtcaaacaggcccatattcttttgttcattgcacatggcaaactattaaaactaggccacactactactcaacatcatttgtctattttgtttttcttgtacaagtagtaactttgaggtatgacagattacttcgtactattgtgttctataatattttaagatttttcctgactatttcacttggttggaaacacctaataccggtttaaggactgagatatgaacttctatgcaaatgattattacaactttgaaaatatttcttagcatagaatatgatagtatcaaccatcgtggtttgaacttaaaagtactagcaaaaagaagttgggaagaggatggttcactggagtaaaatggaccttttcctgagataataaaacatttaatttgttttgtcttctgcttttacttttgcatgaactttcttatcatttttttgtcacaacaaatatctgctgcttttgctttccaggtttcacccttcttgcattggaatgactattaaagatgcaaaaaaactagagcattttttctgccagagctgtactgcggaaaatggaaagatggctgagaattctcatgaagctacagcgcaatccgaagaaaaggtaaaatatgatatgttgggattactgaattatcattaatgatttgtttagctatcagtagtgcgatggtaatacatcaaggccagggtctcccgggttcaccatgtcgtcttaataacataggctacacataattttcaatgatattgaggcatgctgcttaataatattattataatatatgagatgtctgtcctgttgtatcgctactgtagttgaacaaatttccaatacttaatgacacaaagcaccagttgggaaacagtaccaatttattcatatggcagtaaaaagtctggtgtgattttacaactataaaggattggggaacttttgcatgttgattactgtggcaattgctgtaaccttttttttggatactgcacaatttgccctactttagcttgtacagtttcactcttatattatgcataatctaatcatacagtaaataaaacccatccaaggtacatgcactatttagttcttttttaatttggtaatcaccattctgcgattctgaaagacaaacatttcatttggactaatctcttcagcaggtggagtcaaaaagacggagaaggtgactgccccccagattcattgacgagatacacctggatgtacaaagccttctcaagttggtgtaatgctatttatttgtcatggcaagtgtgtgtgacccacgaccacgagagtcccttcctgtaatgtcagtcgcatggtgtacataaacttttcaacctgagactgttgtattaggagacgacacgacctgttgttgttgcatgatgtttttagcagcgtcagaattagcatggtagagtcgggtgatgaagcccctcgcgggcattaggactcccgtatggatgttatcactgatcatacattgatactacattggatgcagttgagtctgtcatctgcgtttgtctttggagaattcttgtaccatcaatccatcatgtgaactttgattcttttcgagacgcttcgtaattaatgcaggcatttctgtgtgggtagtcagctaacgggggcgagaaatggcttaagaagtatggttgaaattggaacgatgtgacggaaaagttaaaagtttgtgtgtgtaggtaagttttgatgtgatggaaaagttgaaagtttaaagaaaaagtttggaaataaactcagcccaaatgaaaatttgacatcaccagccaaattttgggtaaggtagtactaatgtacaatcctactaaattttgttagttttgaaattttccactcacaaaagtctactaaaatttgtgaggtattaaaccaaacatcacctaaccttacttttatcttattaaggggctatttacttcatttctgaccttatcagttttgtgttaccaaattttattaaggtaacaaaataaacatgttctcatctctaccttactaaaatttactgtaagttttcgaagtttcctctcacaaaaacactaccaaactttaaaaagattacaaattaaacatatccaatgctatcaaaatttggtagcatcaaaatataccaaatttttatagtgctaaataggggtggaaacgagccaagccgagccaagccgtgaaagcttggtcaagaacaggcttggcttggctcggcttgataaatgaaacgagcaaaaagtgcagctcggcttggctcatttaaaagctcgagccggctcgagccagcttgtgagggaggctgagcggcactgaggagggaggccggaggcagcgcaggggagggaggcagcgccgcggtggcacggggagcgtcgagccatcgaccatcgaccatcgagcgccgctggggagggaggctagagccagcgcagctgcacaggggagggagggatgcagcgggccggtggcgtaggggagggaggcggcgagccggtggcacagaggggcgactggggacgggggagggaggcggcgccacggcggcacggggagcgtcgagccgtcgaccgtcgagcgccgctggggaggaaggccgaagctgtgcagccacacaggggagggaggcggcgagccggtggcacagaggggcgactggggacgggggagggaggcggcgccacggcggcacggggagcgtcgagccgtcgaccgtcgagcgccgctggggaggaaggccgaagctgtgcagccacacaggggagggaggcggcgcaggggagggaggcggcgagccggcggcacagacgggcgactggggataaaggagagaggcggcgggccggcgggcggcggcgcaggggatggagccggagacggcggccggcaactcctctcgctagtcgccgccagacgccaatcgtgcgcgcgtgcggcggcgtgcctgcgcctgcgtgggatgggaaatggggagggtcggacggagcagttaaggtagggttctctgttttttatgggccagacggagacaatttgttaatgggccaggtcaggtcatgtttttcataggctcgacgagcctaccgagcggcttgcgagctagctcgggctcggctcgatttgcaaacgagctgtggagggaggtcgggctcggctcgtttagtcctcgagccgagccgagcttcacgagctcgagccaaagcccgagccgagctcacgagtccaagctttttgtccacccctagtgctaaatgttgataaggttgattttggtaataaatttgatatgttttttttccccaagaaggggaacacaccataagaacaagttcctgatgagcaacggctttcttacctgaaagttgagtgggctgattttacctcctaatgggcctaaagtgcagcggtcagcccggtccttaatcgggccgagagcaccatggccgcaataattccatgctggatctgtgttgaatttttttagtttttagattttttttaatatttacagaaataatctatcggccaaaaaaattacaaaaatagaccctgctgcccacctctagggcggcaagctgacgtgacaaacgggggaggaacgggcggtgacggagggagggttttttgcaggaaaacccttgccgccctgggcccgaatgcaaaaaagccagtcggggccgggcattttgcaggcggccccttgccgccctctggccgggcgggaagtttttttttctataaaaggcctgccgcccagcccccagccctcattcctcccccctcaaatccagtgaaaataaaagaagagaggggaggagaagagaagaaggggcgaagccctgccggattcagacgccaatttcaggtaatattcatagatcctatatgtgactattgagttaaatagtgtgtattttttaaaaatttgtttgaataaatgcattatatttttagggttttagttgtactaatctagaagtgcgtattgtagatatcggtaactacgtacatctgctagtttggaatcaatacattaccgttgcattggcttacacaagaagatattacgttgtagatgtttattgcatgaaagagtaatatgatctagttaattcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtctacggcttgcgcatacatcgagtgggtcgatacagaaaatcccgttctcgacctaaccacttgtttacaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtagtgatcgttgtcaggttcttcgttccataaatcctacaacattggatcgaaggttctttgtttgtccaaatattcttgacgacgatttcatggtaagaatattttgattacatgaatccttattttctcacaacatttactaactttactcgctttacatctattctttcctcccaggaaccaccaaggagatgtcaatacagagaatggatagacaccagaagggttctaactccacctagccgtgttgtgcagtttgaactaccagaacaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcaaatctaatatcatctatgtaaccgtaatgaaaatagttgtatcatgttcaaattgtactactatttcttcatgttacataattctccttgtttaagtccatataatgtttctacgaccgagattgcgataggcctatattaattatccgagtactaatacgtcgaatgaggtacaaaataatacctcacttaacatatgaaattgcgcaacaaccaacttcaatacatttttataacaatattaacaagttttaccaataaatacttctttatttattattaacataacatagaaaaatcttttggccgtactttttactggggcggcaagggacccagatgcaaaaagtacggccgcaagctctttatgggcggccaaaattgtaattagccccttgccggcctctgtatgggcggcaagggcctaatcgcaattttggccgatggcggcagacggcgcggtcgacccaccgtctgccacgtcagcttgccgcccaccattggggcagcacggtctatttttgcgattttttttggccgatagattatttatgtaaatattaaaaaaaaatctaaaaacgaaaaaaattcgatctgtgttaactgttaggttgacccaaattatgtccggaaattcaattaagccgacatttcgcgattacttttctgcaagtcagagatgacagctgcagtgcagccacactgctgtagtgtcgtctactcaatcccccgcccttcgcgtggatggctccggcgaggtccgccgtcgccgccgccgccgccggtagcacgtacaggcaacggaagctgcagcgtcaggtatagagattttgttggttggttccccacctctccttggttgcatctgttgaacggttgtcaaattttgtggccgtacttgtcctcgagatgatctcaagaaccagatcagatcttgcggattgcctgttattagtgggataattggtagtgagtggctggtagagaaaagattgtttgggttttaatttcttggcttccacttggtggatcctagtgagtgaagggtttgattcagggatctcactggagatcctcctgttgcagggagagttgtatcggcttggcgatgttgattcttgtttctatgcaatttatggcatgctggggcttaaagaatcacctgtagatgagtaatttttattcctgtggagttgttattgatgctgaaacacaaattggaagagtccttttttttttttagagaagagtattttttacccggcctctatatccaaccggatatatgcagccttttttctaataggaacttagcctatcgaacaaggaactagccctcaaataacccaatctgaaattcactcctatagagatttgaactcaggaccttgaggtgctattcaggtcactgcaaccactaggctacatgaagagtcctttgttggtgcttcacatgcatttcagtggagatcggagtattgcggtgatgatcagtgttgtggatgatacacctgctgagactatctcgttcggtgtcgatgtcagttgtgtttatgtgatgagttaatggcagtgtttcactatctaggttatgtcaatctaatattagtcttaagaaaaaaaagccaacctagtattagttgtgttttctcagggtccaatcttaggtaaggaatacttgttcaagcaagcataagtccataagggtgctggcttttccataatccacaatgtccagctatggaatgcctcctattctcaacatttactcatgtaaattggttttctctggttgcaggattaaacccgcaaaaggatagccaaggttccagacttccagttataggtttaaagctaaaatttgaacatggtagaagctttggtcatagcagttgttcaaaagatttcatcggcacttgcagaagaaggatcgaagatacttgcttctaagttgaagaagcaagcacctgaccttcttgaagtaaccaataaaatgagactacttcaaagcgacttctcaatgttgcaagcattcatagctcaagtggctgtggacaggtccaatgatatggtacttgaggcctggatggaacaggtaaggctagcagcgcatgaagctgaggacattgtcgatgaatacacttatcttgttggccaaacggaagggactggcagtttcctaaagaaagcattcaaccaagcaatcgaagttaagaaatggcgcaagctttcagctcaggcaaaactagtagaggatcgtctacaaaagatttctgaagcgaaaaatagatttgatatctcatttgcaagcagtggaagagagaatacagcgagttatccaagtaggcaccatcatttatctgaatattcatacttgaatgatgatgatgatttagttggtaatgcagaagagatgaagcgattaatagaatggttatgtgatgcaaaaaaagatcgcagtgtaatctccatatgtggaatgggagggttgggcaagacaactcttgctagtagcatttacaagaaggaagaaattaaaagaacatttatttgccgtgcatggatcactgtctcacaaaatcacggtgttaaaaatctcctgaaaaagatcttagtccaactcatgagcaaaactgaaaatattatggatggggctgataccatggattgtgtgagtcttgtggaacaacttcaaagatatctaaaagggaggagatacttaattgttctggatgatgtatggagtagggaggcctggcctttactagataatgcatttgttaagaacaacaatggcagccgagtagttatcacaactcgaatcgaaacggtagcatctctagcagatgcaaactatgaactgaagcttacacttctaccaaagcaggaagcctggactcttttctgtcaaaaggctttctcaagattagatgacagaagttgcccccataatctgaagaccgtcgctgaaagaatcgtggagaaatgccaaggtttgccactggctcttgtagctatagggagccttttatcgtacaaagaaatggatgagcatgagtgggagttgttctataatcaacttaggtggcagctcagtaacaatccagagctgagctgggtcgctagtgttctgaatctcagttacaatgatctccctagttatctaaagaattgctttctttactgcggcctgttccctgaagattatcgaattgagagaaaacggttaatcagattgtggatagccgaaggatttgttcaggatagaggacctgagacaacattgacagatgtagctgcatgttacctgaaggaacttgctagtcgatcattgcttcaggttgtgaataggaatgaatatggaaggccaaagagattccagatgcatgatcttgttagggaaatatccctaaccatatctaagaaggaaaaatttgctactacatgggactgtcctaactcagatggagttaccgatggatcacggcgtgtttctttacaaaaggatggcaatttagtccaagcagcaaaatgttcatctcagcttcggtccatgctcatgtttacagaggaaatatcgttgtcttggttcacagattgctaccaaagctttagattgctaagggtcttgtgcctgagaaattgcaatgttcacaaggtaccagattctgtttctcagctgtttaacttgcactacctagacttgggatacacaaaactgaaagagataccgagttcgataggg

SEQ ID NO: 64528 - DNA, 9430 bp, Oryza sativa
tttttcagttttgtttatataagggcagggctctgcctgccaatctatcaaggaagaggagggaaaggagtcatagcatgttgagttgttgttgggctaaatggttcggcccgtctctgagtgggccttatcgtcgtcttcggggttagcccaaaatttaggggtactacatactgagggaaagagaaggcgaccggggctctgctttcctctatccttcggttttttagtggttttaacgaccggaattgtaattttctcacttgatttgaagatgtggcttgcaagttggaacaattaaacactagatccactgatccacatgcataataagatgaaaaagaaaagaaaaataggccttggatttgcccaaagatttccaagtcggcaatttctccaatccacgctcgcgagcactcgggctagccagaactggtgggtgacaaattgtgggagtctgggagagattgggccagctatggactaaagaaactcaattcgactatagaagtaattgaagcaaggaataagtatattttttgtcgttcatcttatgtactcttgcttaaattgtctccctcaaccataaaatcagatataacacattccttctctttgaaaaccggtgcaaatcgactcattcaatagtacgggaaacggttactacaggtgaggtccatatgtgacatatgatatgtcattgagatatgacaaaaatatgtggtaagccccacgtgcaccggaaaatctttcgggcctgtattttacaccagttttggatcaattatgggccttccaagcaggccctaagtttaatattttgaacccagcgagcaggttagggcttatttagttggcaaaaaaaaatgttgccgcttcatatcacatcagatatacgaacatacatttgaagtattaaacgtaatctaataataaaacaaattacagattccgtcaggaaattgcgagacaaatttattaagccttattaatccgtcattagcaaatattttactgtaacaacacattgtcaaatcatggcgcaattcaggggcgtagccagctaggtggcaccgtggtccatggaccacctaagaatttgaaattatagtatatgtgctagttaatataataaaaattgtatagtggaccacccttttaattggcatattacatatagatggaccacctttactttaaatcctagctacgccactggcgcaattaggcttaaaagattcgtcttgcaatttcctgacgaactatgtaattgttttttttttctgcatctaatactgtccaaacattcgatgtgacaacgtgaaaaattttgtttggaaactaaattggaggaaaaacataggaattttggatgattccaattctataggaaaatttcctatgaagccctttgaaacaaaggattgaattctatccaatcctttgaaattcttatggaatggacaatcctatagagattttggaggaaatttagcaagagcttcaacctcttggtaacttttctttgagtctatctctctcatccaattcctgcgtttttcctgcggttcaatcaaacggttattcctgtgttttgcaatgctctgttttccacttacattcatatcaaaattctacgttttttctattcctacgtttttttcaatcatgcgattcaaaggggccctaagcaggctcctattccacgaacatacatacacagtccaactaaactgtactcttatatatacaccattgatttctctaaatggaaaaacacaacgcagagctttcatataggttgtgtttagttcagcgtaaagtttaaattttggttgaaattggagatgatgtgactgaaaagttgtgtgtgtatgacaggttgatgtgatggaaaaggactgaagtttggatccaaactttagatctaaacacagccatagtaaggtacaacagattgcagtcctacttttatttcaagagcaggtagaagctgatgacaggttgatgtgatggaaaaggactgaagtttggatccaaactttagatctaaacacagccatagtaaggtacaacagattgcagtcctacttttatttcaagagcaggtagaagctgatgagagaacaaaatgctaacaacaaccctatgtttaggaggaaattagtaccagctggctgtacaaaaatcactactggagtagtaccgtgcatgattagcaccagttcagctcgagacaaatcaatcaccagcagctgtctgttgggttgtgttcacatcattgctacttccaaacctatcaaagtttaatagtaagatttagttccaaacctattaaattttaatagtaaaatcgagtagtttcagaaactctctcataaaaacattaataaaatacgataagggctctaaattaaaatagattcaagtataagcacataaattggaactatccttccattgtcgcaaatattaacaatgttctacttatgtatatgcatatgcccctatccagatacatagctagaaattatcatatttaggatccgatggaggtatgaaaattagtactacatccgatggagggatggagtggatgagatggcttcccagtttggacggcccagatgagagcacaactgccaaccgcaccaaccaccaccccagtagtccagtacaccgaaccctgagcacgcgccacgtaggacgcccgcgtgtgaacggaaccccacgagccggatatttcgtggaccaaacgcgcatatgcgccacgaaaaaaaagtccatattgccaaataaaattccattttcaaaaatcgcctaaaaaacaagctaggtttcatctgggcgaggccgtagctgacaaaaaacgaatgaaaattaaaaaggctatgtgctacacgacacgagaaatttaaacatggaaatttatcgcaactggagcaagttggaatcttcccagcaaacacgtaccagccgcatacctacctacgaatacgttttttttaaaagaaaactgagtaatatttactttttttttgtaatgtactgggagttagatgctgctgtgacgatgagtaagcacagcgtgtgttttatagggatgtgaatgtgcaaaggggctagaagacttgtattttattgatgaaggaatggttcgtaggaattgttgggaattttattttgttacagttgagtcgttttcaacgaaaacttaatttgagaaaagaaactggtagaatgcattatatcagttttttttttaccctctatgtatggtgagcttcattggtggcgaggagagctgacatgagacgacaattcaacataaatcaagtctcataatctatttcatggtattttggttcgtcatgtttacatatcggcctctagccttgctgctttgctagcttgatccactagtgatctttgttttttctttccttattggtagcaaccttgtgtttcaaccaaaatatatatatttcttttgttgttgaaaagtgcaaattaagaaacaggaaaaaaaaacaaaatactattacacactattgaaaacacatgtaaaattcaatcacatgtacatgtgtacagtgaggtggtttgtttagaaaaacaacatttgtttttttttaaaaaaaataacaccggaagctttgatggaaaagaaatattagagatgcaagtgaggcgggtttgtaggctttgaggcccactaagccgtaattgtcattatcttttttatctgtttatatactagtgggtgaaaaataaactgatgtgtatgtcttacgcatgatagcatgctgcccgcttgcattcctagaaaatacttcctccgtttctccgtttcttaatgtaagtcattctagcattttcatattcatattgatgttaatgaatctagacatatatatttatttagattcattaacattaatatgaatgtggaaaattgtagaatgacttatattgtgaaacggatgaagtacttttgaagagataatatatattagtgggacaatcgactttggaaaagaaaaattcaccaagtaagagctctagtttattctctatgcaattagaaacacacgaaagtagtccagattcagaacaaaccatatgtgctaggcgacatcattcattcttagttaagctctatagaaccatatgcattgaacattcctatacgcttaaatataaaacttgtatttgaaaaagtccacagtgaaagctcctaatctttctttttttaaaaaaatatcttaatataatatttctccattgttcctatatttctaggttcccgcatggcccatatgtgtaaagaaaaagaaacctcacgtcagtgttgtggtaaatatgtgatgtcgtcttttaaaaaaagatatgaggtgtgttttttttttcaaaatgtactccctccgtttccggttataagacgttaaactattttaaatttgactaattctacagaagaaagtattaatatttacaacaccaacattgtttcattaaatctataatttaatatattttctgtaaaattagtcaaatttacagtagtttaactttaaacaaagtcaaaacgtcttataacctgaaacggagggagtatattctagagttaatgaaaaatcatgctctcttattggatttttgaaataaaaacatgggaatcgcatgcctctccagtccctagttggcgaaaagaaacgaaaataaaaaaacaaaaacgttttctttctgaaaggcaggcgaagaaacgcatctgtcacgcagcacttccacgcgttgctattcacacaaaagagagagagagagagaaaccaaacgaaacgaacgccaacccaagccaacccagcccaagcgagaggaagaagtaaacacggcaaataatcaacaccgcattaaaaatcttccatccaagtcaagcctcaagcgactcctcccccctataaaagccccctctcctctcctccaactctctcctccccaaagaaatcgcttcttcttccgcctccgcctcccatggcagctcccagctcgtgggacacctccttccacgaagcaaccacagcaaggcaatagcgccacccaccgctcgcatccacagctgctgattcgtaggaggagcaggccagggagggattcgttgattttatttggcagggaaggagatccgagaggaagaaggggaatatagatcgatggggaagtacgtggagctgctcgacatgggggtgcgcatcgccgcgcggttccactcccactgcccgcagacggcgaggatgtactaccacccgccgccgtcctcctcctcttcgccgtcttcctccgccgccgccggttcggccgacggcggcggcggcggctgcgcgggcttcgccgcgaagaggatgccccgggccgccgccgacaccgcggagatcatcctctacgccgtcgtctagagttagcctctagactctcgatccagacgcttcacgaggaaatggaggaatgtatttttcttttgtttttctttaaagaggaaaaaaaacaaagtggacttggagattggttggtttattgatggagtgaaatgaaatgaatggaatgatttgatatttacgtgattttctttttgttttcatttaagttcgtactactactatctttttttaatgcggacaaatattttcaaaatacaacaaaaaagaaaaggtatggacggctgaggatggacgcgtcacaagctaagcaatcaaaatctcaaccaaaccgaatcctaggaaagctccaccaagaaataaaaacaagaaaaaaaaaacgagaggcgcgcaggacaccaccagaggcgcagatctttacctttttcccccgatttcttggtgcttgtgcctaaattcacgccgaattcgtgtgtgcgtggggggcacgcgtttgggtgggcagagcagagcccaagcatcgcggagggctgagttgctggtctgtagagcatgtttggtatagctctaagactcctaaattttgagtctgaagtagtttatcttgtgagagagctctatccagctccactctcagttttagtggagagagcttcacccaacttgttttgatggaccttaaaactgtttgactgagctctagcttcacacacgagcgttttggtgcgcacggcgcgggggggttagctgtagctgtgtggtcgcggtgatgaaatgaatttgccaaccgatctgccgatacgatacgggtggtatctggggaaggaaagatttttggaattttcgtgatctcacgtcgcacatatgttgtgcgtctaggggtaggccggcggggcggcgattctgcggtgccacaccaatttacttcatcatacagagtacttacttgctactccatccatctcaaaataaaccgtaattaaatttatttattttaagataaaaaattatttgtttacttaaaattatttattttaagatgaaaaattatttgtttattttttttaacaaaaggagtacgggtaaattgatagtatatcgtatcctctctagcaaacgattgggttaaagtgaaactgctaccaacgtcttttttttcttcacttgatattttggacatatggacggtttacaccacatctccgcatggtaggatttagtatcaagtttacagctcgagcgttcaccacccaaaatccagtaaattttcttcggaacttttgtggagtacaaccaggcatatgccaccgaacacaaggctgtgtgttctaaagaaaaaaaaaacacaaggctgtgctccatagttttcttgatcgaaaacggtgacggaaattcataactgacggagcatggtttccgtaaaacttgtattgtttttgcctctagccatatataagatcttttttcttctatattttaccaatgccgtattgcaatcatcactaatcactaaataattaacgggaaggctaaatggctgtatgatagatggaatttcctaaccaacacagaacctttattcccttacaaacaatatggttttcgactgttctcatcccttcccgctttgattcactacaaataaaaaactctgttactccaagcaagacctatgtattgttgttagagggatgtttagatcgagggacgtaaagttttgacatgtcacatcgactattatatagggtgtcgcatagtgtcggtgatatgggccggggtatcaggaccagagggaggaggttgcccccgatacccacgtggcactcctccgagggggttaggcccgaggtagggaggcggccgcccctccatgcctgggggtcgagcactcgggctgccccgaccccctccgcatgacaccgcgtgtgcggggttaagtgggcgcccccaacacccacctaaccgcatttaaggcaacatgagtaggcgcgccacatcgcattaaatgcggtgcgttgtgcgcccgaccggtttgtgaccggtcgaatgattgatgagaccggagtagtgcgcctgcgtgctgctcacttgtcaggcggcgtgccgcctaacatgccccctcacgtcatgatgatgagaggttatttagcctttcatcccagccggagtcggttcatccgacctagtcaaaagtagggtttccatttctcggtgtaagtgaggactcagaagtcttcactcatttaatggtgaatggcatgggtgtcccccgtgtcagctggttggatatgacggccccatgccgcggcgtctgtgtgtggcttccaagtcaagcaacaagacatgcaatgtcctccttcacccttaggtagacttctacgcccatgtggcaacccattgggatataaaaaggaggtccaagcttggtgagggagagagatcggttcttggctaactcacgcttgaatttcagagattgaagtgcgtgtattccatactcgatcaaccaagcacaggagtagggtattacatgtataaaccccttttgtctcatcatttctggggccccgaccccgtctacatcacatcttccaccgagtcctcgattttcacccgctgcccccgaccgaactaacaaagggggcctcactgtcccccgcttgaggagttcacccttcgatacatagggtgttcgggtactaataaaagaactaattacaatatccgttaacaaaccgcaagaagattttattaaggctaattaatccgtcattagcatatggttactgtagcaccacattgtcaaattatggagcaattaagcttaaagattcgtctcgcaaagtaatcacaatctgtacaattagttattttttagcctatattaatactttatgcaggtgttcaaacgtttgataagatatggtgtaaaattttagagtgggatctagatatgcccttatcttctggatgaacacaacagagaacagatcagtggaacagatcagcatgtttggaccatgataacgttattaccagctgcatatttgtatgctgcgtttgctcgcccgtgaacctgacttgccgagcacaagaggaagggaggaggaatatgcttttgtttttgctctaccttttttctcccatccgtcacagctgctgctgctacggttgcttggccggtagtagctgtaggtgaggcaaaaaaagacagagcacctagacagaaacacacatgcaagatgactgtgtgtgagacattggagtatggccgcattcagcaagcaaggcatagacggcacatgacgtgataccctcacgcagcagctagtggcatacgtaatccatttgcattcttgcttgcagctgggtgctaactcctgttaatttgtttattacaactagtagtacctttgagggctggattagtttttttttcttaaaatacgatacaaacgcaagcgtccacaatacatgtacaacctccctctaagagttatcacgaagcgtcttgctgtcgatgggtaagtcgcttaccattgaaagaaaaattactcgtaaatacaagcactcatgttaaatctagggggtttttatattgtggccaaaataaatcttattttggcaagttggccactaaatgtaggtattttttatagccttaaaaaatagtatggttaaaaatggtataaatatgaacaacctctaggatttgaacccgagaggattggttccaccacaagaaacctaaccagtaatttggcaagcttagagtactccctccatttcaagaaaaacataattccgatgttgatttaacataatttaggataattaatatggatatgaggttgtccagattcgttattctatttggtgttaaatcctcgcttaggttattttttttatgaagggagtagtaaagaatcaatatttttttcttctaaaatatgaagtactcccttcgtcccaaaatatagcaatcttcgagcggatgg

SEQ ID NO: 64529 - DNA, 3454 bp, Oryza sativa
cctcgtcacgacacgacgccgcgccacgacgacgccgcgccacgagacgccacgacgccgcacgccgccgccgcgccacgccgatgccgcgcgcggcgccacgccgccgccgccccgccccgccgccgctccgctgccgccacaccgagaacgtgaacgagcgaacgaacgtgaacgagaacaaggtgaatgaatgtgaacgagaacgagcgaatgaacgtgaacgagccaacgaacgtgaatgagaacgagcgaacgaacgtgaacgagaacaaggtgaatgaacgtgaacaagaacgagcgaacgaacgtgaacgagccaacgaacgtgaatgagaacgagagaacgaatgtgaacgagaacaaggtgaatgaacgtgaacgagaacgttgtcggacgaacatgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacatgaacgtcaaatgcaatatatgttacttcgcgtttatccttatacatctttttgtatcttgtagaaagacgttgtcggagtcgtccctcaagccggagtggtagagctagccctcgaaggaattcgcccaggcaagtgacataatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctttgaatttcgccgtgtgaacttgagcgattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggctcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcataggagttcagtatgttgcacagaaaattcagaacatactatatgctgtcgtataacaaagttcagtacatagcctcccatagaaaaatttagtatatatgtgaaaaattcagtaaatactggtgcgtatcaaagttcatactacgaatcactatggaaagatttagtatacatgtggaaaatgcagtatatgctatcgtctagagaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctgggataccgatggaaaggtttgtatcagcatgttacggatttttacgattttttttgagccaggatattggtggtattttatgaaaactgattgtacattttcttttcagaatggtggtagataatgttgatagcagtgctgtcatacctcctgagtatgctgatcctcaaattcttactccgatgctgggacaaagatttaagactgagagggatgcctataatttttataatgtttatgctgttagtaaaggatttgggatacgactggacaaagatcgcaagaatactaaaaatcagagaacaatgcggcaaatatgttgttctcaccaggtacatacattatgtaacaatatcttagtagcagaaatttacctaaataaagacttgacgtactatgtgttaatttcaaaatcttttatgcaggggaggaacccaaaaaccaagaagccttccgttcgaattgggtgcccagcaatgatgaagataaataggtctagagctggtagtggctggtcagtaacaaaggttgtttctgcgcacaaccatcctatgaaaaaaagtgtaggagttattaagaattatcagtcgcacaatcaaatagatgaggggactcgtggtattattgaagagatggtagacagtagtatgagtcttacaaatatgtatggtatgttgtctgggatgcatggcggaccttccatggttccattcacgagaaaagctatggataggctagcttatgcaattaggcgggatgagagcagcgatgacatgcaaaaaacacttgatgtcttgaaggatttgcaaaaaaggagcaagaatttcttttatagtatacaagttgacgaggcttgccgtgtgaagaacatattttggtctcatgctgtgtccagattgaactttgagcattttggtgatgtcatcacatttgatactacctacaaaacaaacaagtataatatgccctttgcaccatttgttggtgtaaacaatcactttcagagcaccttctttggttgtgccctgcttagagaagagactgaagaatcatttacatggttattcaatacattcaaagagtgcatgaatgggaaggttcctattggaatattaacaggtatgtgagtatttggccgaatttataatttggaatgaattcgttatactttacttattttaagtatatgatgggttattcattggatgcttattattgtccttaattttgcagacaattgtccttccatggcagctgccattagaacagtatttcccaatacaatccatcgtgtgtgcaagtggcatgta

SEQ ID NO: 64530 - DNA, 2424 bp, Oryza sativa
aaggttctccaaaaatattcttcaaagatcttctgttcatgcatgctactgtgaagtgactgctagctagctcatgtcttttcactacaacctttgaaattttcctttgtccaaacataaagcgtgcaattgctgcataaaatgactaacagacaatcatatcaaggcagcgagcactatcaatcccctccaacccaaatgaagattttcaggcaagaaattacttaatccctccatcctaaatataaaaacttttttcacctgctcctcaatatcaacctaccacaattatttcctattttatttcacctactcgctgtcattccttagaatttcttatattttgggtagcaaaaaagatgtccattatctaaaaaaatgcaaaaaagatgtcacattacagtggtaatgtaccagtaaacatattgttcgaggaccaaagaaattggagtaatggtagtactgaagtacagacatcaatcctactatcttcctggcaagaaagaaatgaaaccttaggattctcgagaacgctatttggctgcccaatgtgaagctgggcacaggatttcacatgattgggcagcaacagtgagactggttttaacccaatggacaaacgagggcaacaaggcagcaacgcacacacagagactacactacacaactgtaggcttttacccattcccattctgaccaaagccaccagcttttcttcactcctcttgtagtctcccaatacaaatgcaggcccagtagttgtaccattgctgccacgccattggacgccatttctactgcgacagtggctgcatggacacgtgtcatccgtacaagagaggcttctttttctttctctttttttttttttggtgaggatacatgagaggtttctgatccccatgtttaagcagtgcaacaaaacgtatatatgtgcttctaatttcgtttttcaaggaggattgattagtcgcgaagcaaaaaagaaaaagtcaatatgttttattaattgatttcaaatacttcatgcagaccacagtttttcagttttttcttcaacataactagacaacagtggccatgtgtgtaattttttttatgcctgcatgacatgttttcacataacattgaaactgatattttggtacacaaattttagttttctttatttgatgaaaaaacaaataagcttatcctgccacttttttatttacatgcatacgacacataactagaactaatagtcataacaaaatcatttgtaaaaaaagactagctaatatttttatataatcacattattcagtatgtatagcttatgaggaaagggagacatgcaaaaaatatggaacaatcatctttgtgtaaattctttcagtaaatcaaacgcatgcatatgtactcccctatatactttactgtatttttttcatctttactgctgtttctttgttggatcccttctttgtgtttggttcctgttcaaaagtacagtggtgctgtcaggcatcacctgccctcgtgaagttgctcgggactaaaatttgcaccacacagccacacacactcatgagagagagagagagagatgcacatggggatgaagccctaaccctagcagctcattggttggaaacaggagatgatgcaaaagaaactggaacacaagagagagagagagtgttatatcatcagctgcttgtttatccctctacccttatcacctgatcaaacatacatacactaacacttggcacattcatgtacaaactaactactagtacatcaatgccatggccaaccatacacactctccttgctatctagagatctgcttctacacaagcaaagctacacaaaagggaaagatgatgaatggagccccaggatgctctatattttttgtgcaaatatgtgtgtgatcatacacatcatgaggtgtgagagagatcttaaagctcacctctctctctctcttcatctatctctacagctagctctgccacacagacatacaagcacacagcttgccacagtggagagagaaaggaaaaaacataaatacagcaagaaaagagcaggaccaccaagccaaagaagaacatctctctctctctctcatctcacacacacaagagagagagagagagagagagagaaagaaaggaagcagcagcatactacacacagcaagcactgtcctagatctatctcaaacatctagctcacctcaccagaagcacaaaggaaagcagcaaaagaagctagctagcacacacacacaagcaagcaagagagaaactgttgcgattttctttctttccccccagaaacaccaaataacacgagacagttaataacagaagtaacaaaagatgcatctcccatttgaccctcccctctctttgcccccatgaaagctat

SEQ ID NO: 64531 - DNA, 3013 bp, Oryza sativa
tgtgaccggacagttccacgtacgtctaacgaagagaagtgtgattccaggaattttattaaatttttaccgccatcaatggctctagatgggatctttgaaccagagcataagtttaggggagatagctctggcacatgggggttgttttctattggttccttcatcaactgaacagcatgtatatcggaaattagctaaattttgcagccagaaataggcatattacagccagggtatagtacatacctggagtttcccataacgagggaaggggaatcctgggttatgtttactaactacatcttgttgaatcatcctagcaatttgatcatcctcaaactgagaaatgtgacatgttttaacacatgtgatcccaaccttccggaactggagatttctcaaatattttacctgcaaaaatgattcacaatgacaatatgtgtgttgattgtatgctgcattaacaagtcagttttaaatgctaaccattagaaagatgatacacccgttaatggatagttgagccttattcggaaagtaggtgggcattgattctgctgctttcttcacctcatctacaacgaattgggaccagttgtactgttttatattgtcaacatcagaaacaaccataatatacctaggagatatgaagtttgcgcaggattgcggtgccaaaagcttcgttgtgacataaagcacaaaagccgccatgaaaaccctcttttcatctattgtcatgggataaccatactgcttctttaggattctctctaagagtgatattttcatgtgtgaaaagtttggtatctcaaatatttcgcacaatatttgtttcttcccatccaattcatcttgagagcaagggataataggttgacctgagcatggcaagccaaaaactgcattcacatcattaggaccgaatggcaactcctggttgacatctttaacaatagcgcatgatttcggatcaactttgctcagtagccatgcaccaaactgcctgtttaccttagtaagcttgatatccaaaagtccatcaaacccaacttcaccaatcaactccttcttcctatcatcgaattctttaatgatattcactacgcatttgggctgacacctgcagttgataccaaaggtagtgttgtctttcttctgtctatttaaaactctgctttgccgatacctggataccacccgtgcagcagtcttatttaggctgccccttgtgccagaaaccttcaaagcctgcagataattagttttttcatttcataaatagacaatactacatggaccagtgtatttaaaaattcaacatatacttctgtttttaaaaaaaaacagcatacactcatatatgtatggaaagatgaagtacaaaatactgcgtagcaaattctacctatgtgtaccctcttaattaaaaaaaaatcatgtgcactgaaagaaaagtcagaatatgcaaagtttacagaatattactgtgtgtaaaaaatcagcatatacctctctatgtaaaagtgcaggatatacttcttcgtaacaagggtccagtatagtaaaccactatggaaaagcctctgttatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaatactggtgcgtatcaaagttcagtctatgaatcactgtggaaagattcagtatagatgtggaaaatgcagtatatgctatcgtccaacaaagtagagaataaagctccccacataaaaattcagtatatactattgcctaacagagagttcagtaagaaccctgccacaccaaaaatcaatacttaataccgtctagcagattccaaaaagtttccctccaaagaaaaaatgagtatataccgttgaaaattcagtacgtactaccatctacatttttctttatgggggtgggggctaaaacaacattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctgctttggatgaaatccactgctatggcccatcgattttgccattgttgccccgctcctgcattcagccgactctagatcgattacttctgcttcaggaacacatgctgttgagagaggatccatcgctggaggaaggggaggagtcatcactggaggaaggaacgaactgctatctctgtactgccgccagccacacagtcgccgctgaatcgctggtccgtcgccgcgccgccccccaaaaccccgaaagctgaatcgctggtccgtcgtcgcgcaggtccgtcgccgcgccgccccccaaaaccccaattttcgggataatctgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcatatatatatatatatatatatatatatatatatatatatatatattaaatttgtttggtgctccatggtgcccgggcaccattgttgaaattgagtatatacccaattcaaatgagtatgaaacttttttaattactttggtattaatattaactactttactaactagttcaaagcaac

SEQ ID NO: 64532 - DNA, 862 bp, Oryza sativa
agcttttaagttgtctcacaagcttcctgtctttgccgctcatgaactgtgttgctatggttcttgactctttgagcccctcaagtatgggagtatttcttcttttgggcttaggagccacgtggttaaatagacatacttgtgattagtcaagtttgatcaagttatacatttgttgtgttttcgtagtatcgagtgtcgcaatgcagttttgatcccatacatgcaccagtgttcattgaaagcatggcgtgggttttatatgcaactaaagcgtgactgatttttattgttaaaggttggcaaatctagacattcttatcatattaaccaatcaatcatacagtgtgagcttattgtggataattttgctattctctaccgttctctccaagatgatagtcgctaatatcagcaagaaaattattatatatagccctcatctagaaatttggcgaacaatatgccaatgacacaaatcccttcttgcatgttatctaggggtcctacttttacaaactttaaattcgacatttctttatctataatcgaagcctatttacggaaaaccttaactttatttgcttaacttgttattagaggagagaaatgtgaccaagaggaatcaaggtattgacatttacctccatttcaaaaatatccatccttcaaggtcctcaaatgcaaaaggacatagagagaagccattaatcagaaacaaccctgcaaaaagttacaaacaaaaccacgaaattagaaacaggtccctcccctcaaagacctagagagaagccattaagcagaaacacccctgaaaaaaattacaaacaaaaccgagaaattacaaacaggtccctcccct

SEQ ID NO: 64533 - DNA, 9397 bp, Oryza sativa
cacgattgaatttgatcggtggttgtaaacggctgcagtatatatgaacatgctctattttgattgatctatggttacatgtctctaatttatatataaccatagtatcaatcaaaattagagacatgtatgagttgtacgatcgtacgtgtattagtataagaaaagcgtagagaatgtaagacgaagactagtagaagacgacgttgaatttacttctcttggattgagatggaggtgagagtggtagtagagcagtggtgtggtagtagtagcatttacaactgtagcgtgtctcgctccgtccccatgacaactttaactactgttgctcctcagaggcagtgaactaaatgcgcattcatggccgctggatctaacactcgtactactactaccgcgctcaaatagtcaattctacctcagctcatggtcatcggtgacatcaaaaggaaaccaaccgaacgatggatgaccaggtggcgtttgaatctagggactttaactttagtccctttatttagacactaatttagagtgttaaatatagactacttacaaaattaattatataaatgaaagctaattcgtgagacaaattttttaagcctaattaatccataattagaaaatgtttactggaacatcacataggctaatcatggattaattatgctcaatagattcgtctcgcgaattagtccaagattatagatgggttttattaatagtctacgtttaatatttattattagtgtccaaacatccgatgtgatagggacttaaatttgtaagcagagagaaatttgtaatcccattatgttcagataccacctcaaatttgtttcttcagatagttcagattatgttgggtgagagaagagggagagacaagcagagcaagccggccagccactggtggtggtcgtcttcaacgtcgtagtacgtacgtgcgtactctaatggcgccggccggccagccggacggccggacgggcaggcgagctggcatacggcgagatttgtcaggtcggccagtgcaagcaaaggctgctgctactgctgcagctgcagctgcaacgacgatggagagattgctactgccatttgcgagcaatttgcaactgcaaattaaaatatggccaaccgcgtggcccctccatctatctatagggtgtgtttaggccgtgtttagtttctcccctatttctaactttacatcacatcatatcacattataaaaatttttatacacataaacttttaattttttttctaaactcctaactttcttcaaactttcaattttttcaggaattaaacacaccctatagatagatgggagttggaagtttgaaaaaaaaaagtttggaactaaactcggcctatctaccgatgcccttgtttagttcccaactttttcatcacatcaaaatttttctacacatacaaatttttaacttttccgtcacatcgttctaattttaaccaaacttctaatttttgtgtgaactaaacacagccgatattcatcgatcgatcgatcgtcttctgactcacttgttactgctcatcaccgagttaccaacgcctattgccgatgcaaaaatgcaatgcagtaattcaatcgcgtgtactgcgtactgtcgcatgtgtatgtacgcgcgtactgatcgaaccgttcgatcggaagagagatcgagaagaacagatcaccatgcatgttcttctgatgtgtatctgcacggccggaaaatcgatcggggatctgtcctaccaagtgccccgggccctctgttttttaagaaattatagagacttttaaaacgattaagaatgagaacaaaaagaaaactattataaaagaaggggttgaaggtagaatggaaagaaaattaaactacgggtgattaatgtactagtactactaatcttttatatttgtgtacaaatgatgagctaccatgtcccttttattgtgaacggatagagtattttggatgtctctcatcgtctgtttgtagtcatgatcaaattttatactttaaaactttaattttgaacttaattttgatgttttctcattgtagttagtttttgtgtcattcactttttaaaccgctaagaagtaagaatacatatataaaattttatctataaattatttttagttatttagttcatttttctacctccgtagatcaaactatcatagcctagatactaaagccatgcatgcgtcggtgcattctaaggtgctgatagataatatattaatgataaaaactgagtttatgacaattattcgagagtaaaaacaaatgaattgaattttatgaaggttagtaaagttgatttttaaaagttttctaagaaacgttgacgaagaaagttttgggatgaatgagcttaattagaaagtgtgcatataataatccataatccaattaacacacacagattgctgattaacttgagaaagaaaaaaaatgcattgagagagaaggaataatcgaaaggactcatcttttggcttatgtgcttatcaactaaaatttgaacacctttaatttgaaggtgattttggagtttttcactgaagtttattttccagcctttacttttagatcgctaagaacacatatataaaagttttattcacaaattatttttcgtttgtaaatatgccgtttgacttatttcacagataaatcaaacgatggaggccctgttcttttatccaacaaaacttagattaaattctggatactcatggcacgcttttcaaactgctaaacggtgcgtttcgtgcgaaaactttctacatgaaagttgttctaaatatcagattaatccatttttcaagtttgtaataattaaaactcaattaatcacacgttattacaatctcgttttgcgtgaaatacttaattttcatcttcatcttcagagcattcaaacaccagtgtactacactattacatgcagtgtgaggtaattgcttggcaaattcgatcgatcgatgggggtgtgtggttaattgcactttcagtcttgcactactacacaccaaggactcttctgattttgtagagatagacgcatgtgaaggccacatggagaggctcgtgccactgtaaatgtaaaatgcccccacaaaccaattcaatactctactcctctcttcacacacgcatatgtgcgcattcaatgggatagatggacttttgtgagatgctgctacgtttgattttgattagcagggacttgtccttgggtagatggagttcatcaacagagatttttcagtgtttgtcaccagagaaaatgccatcaagagcaaggctttctttcttgattcttgttgaaatataacaccagagctaattaggactcatgctaaaatatgtttcgttgttggattattgctatgattgttaattaatttggagaatgaccagtggtaggtcactttatgaacgagcaacacacgagatataaccaaagcaagaaaaaggtaattaattatcaggacataccctactaataaatgtcatgtacctgcatatgccgttggcgaatggtgatggatctagacatttttggagtgtccgaaatatccgagaatgttgtgctctagagagtgacaaattgacaatccctttgcactgtttctttctcttttttttcttttgcaattatatgacagacagacgcatacgcaatgactgtatcctttaacatatgctcatagagatgtaaaccatcggcacatttctgatccaattgaattcctttaaggtccatttgcacgtgcgtaatattcataagcatcaggatttgaaccccgataagtttagtcatacacatccataactccaccaccacactactggtgctcccctcccccaggtccactaaatctttcctattcttgctatatatgcttgattcactgttgttattttgatttgtcacggaatttatcacctttgttcttgataatttgtctttctttctttcctttttgtattcaagctataatgggatgcagaaatttaaaacaaccacgcatgatatttacggtaaaaaaatataatgtttgctgtgaaccgtattactgcatatctcacaacatgcatgttactgtactgctacaaattaaaatagccataattgttccaaacacaggcccagagctttgcaaatgaaaacaaaagccccaaaacaacacacatatatatgtggagcccagaaccagacgaccacgtacgcagtaagcaacaagcaagcgaacagcactacagctaaccttcattaacttgatctgcatcaatggctcatggtggctcttctagtacagaccgatggcgacgccaagtcatcaagatctcacgaccagcacacaggaacgtcaacttgctgtcgatctgcaggatcaatgaaactcctacttaatttgctaacttaggacagccatttcagtagtgtaatgcagttaatactcccccaataacaaaatataagcatttctacacggtctatttatagagcttctgacagctacaatttctcttataattaaatgtctctaggttatttagcaaacactaggggttgagaaatggaaaaaaatttccatttcaatcacttgagtgatccaaatttgaatgtttaaatttcttagatttccctaccaagcacctaattggcgaaaaatgtattgatttccgtgcattagaatcaatgcctctgaagtatttatagtgccatacaaatttgaaatctaaaaatattatattttgaaatggagggacgtattttgtgtaagcatcagtcaacatatgtataggtggattgatatttcagtccgaagaattggatgtaatttgacagattctgtagtgaaatacatatataactgaaaactaaagcaactctgttttttatttagaaaaatggactaaaatccgatctccacgtctaaactggtttattatcacccgtcacggataactattagtatcgactgatagggacatgacacaggtgagtttttcacataagcgatcattctcctatgatcaaatacccaccacccgtcacatatacaagggttacgaacggttgcagctctaattgagggctttgtttagttcatgaaaagaaaaattttttgtgtcacatcggatgtttgaccggatgtcggaaggggttttcggacatgaacgaaaaaactaatttcataactcgcctggaaaccgcgagacgaatcttttgagcctaattaatccatcattagcacatgtgggttactgtaacacttatagctaatcataaactaattagactcaaaagattcttctcacgatttcccctctaaatgtgcaattagtttttttaatctatatttagtgctccttgaatgtgtccaaaaattaatgtgatgttttttaggaaaaaatttaaggaactaaaccaggccttagttgtgcgcggttgtgccttactagatcaagactccatgggaccgagctagcatggtgttcaagcgtgcttaatttggtcaatgtgaccagtagaagaccagtcttgctcaaaattgacaactcatggaaatggacgcatacacgaagaggagaaaaggctgaacaaaatgagagcttggcctcaagaagcaaagaagttaaagccataggagaagatgagcacagacgagtccagctaggtattgctagctagcttgaccatggctagcttctcttggatgcaaagagagaagagagaggcagcaatgaatgccctccccaaccacccgctgtgtcatctgcgacctcaatttaagctcaccatcaattcccatggcgccagctagctagccactctgttgtttccccctcccccgctatttatagccgcgctgtccttcccacgcttcactccaccaccaccaccccccatggcggcagcaaggatgaagaacaccaccatgggttgcgccttcctgctcgccgcgttcgccatggccgccgccttcgtccccgtggccgagtccaggaccacccccgtggagaagacgaccaccacccaagcaggtacgcacgttcatggcgtagagagcttgcattcttccatggttggtttgagtggtaatgtgtgttgttcgattacagaggatggtgtcaagaagccggactgcgtgccggcgttcgacccgcgctcgttccccggccacggcggcaccacgactccgacgccgatcccgggccaccacggcggcggcggctcatccgggaccacgccgtcgcacggcggcggcccctccgggggcgcgttgccttccccgtcccacggcggcgcggcgccgtcccacggaggagggtacggggcttccccgccggtgacgccctcccctggcggcggctacggcggcggctccccggcgccgtcccacggtggcggcgcctacgggagctccccttccacgccttctggcggcggctcctccccgacgccgtcccacggtggcggcgcgtacggcggcggcggagctccggcgacaccggcgtcgcacgacggccacggcctcatccccaccacccccgggacatgcgagtaagccacgtggcacctcacaaaaaaaatactccattaaatttcgttgctaatttagtcgctgacgagtggggcccctccatgcgtgcagctactggaggtcgcatccgatggagatgtggtcggcgctggggcggtggccgagctcggtgggccacttcttcggctccggctccggcggcgctggaacggggatgagcatccaggacgcgctggccaacacccgcggcgacggcgccggcgagctgatgcgggagggcgccgccgcgctgctcaactcgatgacccgctccggcttcccctacacggccgagcaggtgagggacgcgttcgcggcggcggcggggggaggctccgacggcgccgccgcggcgcaggcggcggcgttcaagaaggccaacgagggcggccgcgcgtagacgacgacgacgacgtacgcaacgtacgcatccgtgcatgcatgcatggcttaattgtttaattaggcgggaaaattaaaaagtacgtgtgttaaattagttgtgtggttgatttgatggtgatggtctggttgtgtacgtgtggttggtgtgtttatgcgtgtaaaatcatgtgtaatcactctcgtgtttaagtttttttttttttgctgtttcaaattcgatcggtggcaaatgaaggaagtgagcttatccttacatggttactgctggtgaatatttcttctggatttattttttcgtgttatactattcaactgcagtcataaattaaattgtcttggactggttcggtggaggtgaattgaaattgaccgtacgtgaaccattatagggccggataagtatcgctcgaagtgtcgtacgatacgagtgaattctgggccatttttccccgtgcaaagatgccctccggttagaggaaaaagtccatattacacaacgttttcttagttattaccaatattgattcatatttatgtcccaaacagtttcgatggtgattttatcataagtggttgactattgaaacccatatgtcaaatgtgagaagttaagaaatgtctatttaggagagtaagattacgagaaacagcttgttagtagccatctttggtaatatgaaaagactattttttcagcttatgccttctagttcattttctgaatagtacatctatatcttttgaaactgtagacgaaacactgattattttagtgagcttctaattttgatagaagctacagctgccaaaaactaaatgacattgagacctttgcacttaacccacatagcgttggcccccaccttcaacacatacattatttgtactatccttgtcatattcattgaactaagtcgcatcatacgtaatatatcattttaagctccgctctccttatattggagagacttgtttgggggttggcattggtttttccaacgagactgatttcgagaatctgaacatgagcggtagattgaacacccacacaatctcgatttgacataataacacttctcatgtggacaagaggaacagagcaactagaacacatagttatcgatatgttaggctacgacttaaacatagattcttttacccaagtgatcgggactcgtagaagtatctaatatgattaagaggggacagagctcggacctgcagtctccagttctcatgagcttgatgggaaactttaatttctcctgaaattttccaattttaccaaaagaaattcaaatctggggaaaaaggggtccaaaatgcaaacttattgaggccgaaatattctgaaaatttcgaaattctttgcctttcggcgacacatatagaaccctacacatataaccttcagagatcattatcattatgcgcttctacgcaaggggccggaatcaccaaattaacacaacaattaatcaggcaggcaggcaatcacgtagtgaaaggaaaataatgacgccagagccactacgatcaacgacgcctgcagcaacgtcgacaccgacgccacccgcgactccaccttcgtcctcgcctactccggtgccttcttcgaccggcgagcgcctcatctgtcaccaattagccaagtcagctgccatacttgttactttctccgtttcataatgtaagtcattctagcattttctacattaatattgatgtaaacggaggaagtacgtacgtactccgtagtaattagctagggtgatgggcccggctactaccaattctctgaactcaatatataggttctttgtcaaacatatgggccatgtaaatagggttaatttaccatacatctcagtttggattggcctggcccaaactagtagggaaagaaacagccttggttcttgggagaaggtcaggcctgctagctcaggcttgagctcggtgccactaagctcataaaccaaacgagccgagcccaaactttgtgtgctgggctcgttaagcttggtgcgagggccttgcgatggagctcctcccctaggctcctttagtttatccctatctcctctagctcattccttggataccgtaggtttcttttttcgcgagcgcgtaaaaggattgcacgccaatatattagaagaaaagagttatagttacacgacgcaattagccagaccggcttacgccaagggaaggggaaaaaacaaaggaaaaagtacgaattaccccctgaagtattgggtgagtacgaattacccccctaaacctgaagaccagtaatttttcaccctcaactatcgatatcggatgaaacccccccccccccccgaacagctt

SEQ ID NO: 64534 - DNA, 1500 bp, Oryza sativa
tttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccacatggaggataacgatggccggccggccgcctcgagcacacgcaactcaaccctgcctcaaagctcaaaaccagtagaagggtaggataggatgctggagatggagtgagctctactccgccaacgacagccaggcgcgacgacatggcactggctgtcgtggcggaacctagaaagattttagagcccggacaaatctaactacaagatgatataacgttagttatggtggcaaaaccgagtaaacttttagagtccggacaaatctaactacaaacgacataacgctagttgttgtggcaaaaccgagtgaacttttagagcccggataaatctaactacaaacgatcgaaacgatatgacgctggttgtcgtgacagaaccgagtaaacttttagagcccagataaatctaactgcattaagtatttgatatctattggttggctttagtataacggagccaaaaataacttttagagcccgaacgaatctaactactggctggttatgtgcatctcgcgatgcagaggctgggatttgacctctcccaagcatcgtccagcggtatttgacatctcactaaaaaccacgatgcaaatacaacggcagacagactgctagctggaatgaaacagggagagatggtttcacgttgaattattctccttttcaagctgtaaaaggatggtggttcagaaacagtaaaagaagttgctgccactttgatgccatcgtcgttgtctactgttctttgtgtgtgtgtgtgtgtgactgaccatgacagtcagcaatacatacacattgccggtgtgtaaatacggccgtaaatttcacaattaagacgggagga

SEQ ID NO: 64535 - DNA, 1373 bp, Oryza sativa
ggggggcaccggcagctgcagctagctaggctaagcaacagtgctactgcagggggacagtggtgttgatgtgtaatgctacagctactgtatgttggttttggctccagatcaatctatcagattcagatatacaaactgtacattccaaacaagatggggatcggatatgatcatccatagatgaacagtcaggtggttagcgatggaaggaacagtgccggatgctgctagctgcagctgctgctgatagctggctggtcgagaggcatcatcaactccattgcactggggaaagctgcatcatgcatgtaatgcagatgcagatgccgttctgaacatctgaatgttgcagggctggggctgggcttgctatgctagctagtagcaaagcaatgcaatccaatgacaatgcccgatacagtattgggttatctaccctccttggaatggatgcagagacatgcagtgaatcattattgtgttcgcctctcatgcaggagtactccctgcatactcataagggtacccacaatggttatctataggctctatataagagatccatgtcagcatattttcctacttggaagagattaaatgaagagagagagcaaagctatctactaacctggagatagtctatagagaaaaacgaggcaatgtattagagagctatagatacccatgtagacatactattgagatgatttactattaatctagtctattgctgagatgtacatgttttatagataacaccttactttaccattgcgggtgctctaaagcatactcataaataaagccgtttaggacaatgtttaagtcaaaccttggaatataaatcatgaataaagttgttgagtttgaaaatataaaaattatatgaatagatttgtcttgaaaaatactttcataaaagtatacatatatcacttttcaataaatatttttatagaaaaaagaagtcaaagttatgttttggagactcgtgtcgctgtcctaaacgacttcttttacgagtatgtagggagtactgcacaatactactactccatccatcccaaattataagacactctttttaaggaaaatcaaacttgataatttttgacaacttttaactagtaagcatactaatcatatataggctaagtattatgaatgttatatcactatattcatattttaaaatattttcatgtgatactaatttcatattcgtggagagcataaaataaaataaattaataatcaaaatatataattgaagacgtataaaaaagattcttataatttgggatgtacttttcaacgagcagtgcttatcagtggcagaaagaaaacagtgtatgcatacaaatggaact

SEQ ID NO: 64536 - DNA, 11860 bp, Oryza sativa
cagtggagggtgcggaggagcttgaagcggcgggaggaggggtagtgaaggggacggcggagctcgaagcggcgggaggaggaggcagtggaggggacggcggaggatggagctcgaggtggtggtgggggtgcctgtagccgacagcgcgcggctcgtcaaggcaatgttggggacgcctgcagccagtgacgctcgaggaggtggagaaggcggcggaacgagccaagggcggcggccggcggagcttgggcgacggaggaggcgctcgctgccgccggcacgcgagccgtaggcaccagcatctgatgagagagaggggggtgagagggaaagagatagagagaagaaatatctgacaggtgggccctattgtttttttaataaaaaaaattgctgactggactgccacgtagaccaaaaccgcttgcaaagttgctcgggggagtttttcatctggtatcgatagttgagggtgaaaaatgtctggtttttgggttttagggggtaattcatactcacccaatacttcaggggggtaatttgtactttttccaagaagctgaagcttaaaaaactatgacggctaaacacaaactccaagcagcggaaaggggccgagccatgttgtactcccaacaagtccccaaaagtggcaatgccagctaaagaccacaaatggccctctgagtggatggactccagaaccactgagaccgaagagagcgcagagtcgaaaaccctagagttccgttccttccacagctgccaagagactaggaacaccagggagtcgaagccggccagcgcggagatgctcaggtaagcaggccctggaggatggccaccagtcctagaactagctgccacggggggagagagggcagcccagctaggcggcgacagcacatggagtcagacctgatgagcaaacacacagtcgaggaggatgtggtaccgcatgttcctttagctcctcctcctcccggttattggctgctctagttcattcccttgccttcttttggcagaggctttcgaaccctcgcgagccaattgaagccaataaactatagccgagccaagcttctgccctagcttgttttggtaatcgagccaatctttgacaccagggagcttttacaagttttcaagccctagcatatggtgtacttactaggttgtttgatatgttgcatgaatcaatggtaatatcaaaatttcgtaaggtaaaagatatcgatgatacgatttggttctaagtcctagtaaattttggtggagttaattagagtgtgaatttctaaagttaccaaaatttgatggagtaactatagcaaaaacatgtttggtctattacttaccaagattccatatgttagaatttgtaatttattcgaacaaagggacccctgttgtaacataaaccaatagtagttctcaagtgtaaacaaagaagaaaaatgtccgtattgattctcaaagcccttataatgtccccatagaggtctattgatagccataagattaggttttacatatgcttttatatgtttactctttgatggggacagttataagaatgtcatagtactctcatgtctcattggttttattggacttatgttaagtcttaacaggccttggtctactctatatagggccttgctctgaagatcgcctggtaggccggctacaagatggtctcggccattttaatgggcttagccatcaccatcttcatgggtattcgccaaatgggtgctcatggctctggcttcgtcctttccaccagcctttgtaccgaacgaaggggagtgaggccgccagcctgcctcgaacaaaccctagataacacgtgacaaaaagcccaccccacatcttatatttacttaaaccattggatcagctttgagattcgtgatactctcgcaaccctaattcccacccccaccttcgatccctcccccacgccgccactcctccgccgccaccaccgccgccacaattttttgtcaaatgaagttaaaacaattccattgaacaaatcgaatatactcctaggatgctactggtacatttacagccttccataggcaaaacccccctcaccaaggaatggtgtgtgtaactcctccatgacagctttacccagtagcttgaaacggctgtcacagctaattgctccaccacgaattcattgatccaacggtaacctacaaacattcttgtgtatatatacacgacaacacgatcacgcactccttagttcgatcgtgtctctctcctcacctcactcgcggacgcttcgtcttctctacacggatcaagcagctaatccaccatagatctctctctctctctctagtccggcgtgtgtagtggtgtactagctagctagctactagtagaagcgtacgcgtagtggaaaggcaatgacgcggcgtgtcgccggcgtggctgcggcggcggcggccgtcgccgccgccgtcgtggttcttgcggcggcgagctgctgcgaggcgcgcgacttctacgtgggagggcgcgacgggtggacgaccaaccccgccgagccgtacaaccggtgggcggagcgcaaccgcttccaggtcaacgaccgcctcggtacgtacgcggattcgcccgaatattccggcgatcgatctcgccggcggcgtgcgtgttcgtttgtgtgttcgtgtcgatcgaccctgtcggaattttttgttaaatttggcgcgtttacggttattgcagtgtttaggtataacaaggaggactcggtggtggtggtgagccagggccactacgacggctgcaacgccaccgacccgctcctccgcgacgccggcggcgactccaccttcgtcttcgacagctccggccccttcttcttcatcagcggcgaccccgcccgctgccaggccggcgagcgcctcatcgtcgtcgtcctcgccgtccgcggcaacgcaaccgccacgcctaccaccccctcgccgccgccgccgccaaccgttccggcggcccccaccccacgcccgtctccgccgccgccggccgcgggaacgaacggcacggcgagggcgccgtcgccacccgttccagcaccggcccctgcaggctcgccgccgccgccgccacctcctccggctgggggaaacttcacggcgccgtctccggctggagggatgaacttcacggcgccggcgccggggacgaacgggacggcggcgccgccgccgcggccgtcgtcggcgccatcagtgaggggtggtgccttgctgatgctgctcgtcgtcgcgacagccggagcaatggctctcgtttgatttgttggtcgaacggtctagcctagctagttgcaaattatgtttccttttttgcatgcattgtgtttttgtttttgttggtaattcgtgtcagtttgcgtttgaattcggtaggatttgatcatcgggccaaaataattcagattgttgctttgcttagtcgtcaaaattaatctctcatctgtagcaagtggagatatatgtgtaatgttttgattcataggtaattgcattaaagaaatgttgtttatgcgtttttgctcgatcaatctttacgtctgcctgatctgtaaatccgtcaagtagggcaagtagctggtagtaaatcttaattaattcatatacattcaatccgatttaacatctctttaattttcttccattttaacgtaaagttgccgtttatcctccaaaatagtactgtaggagtttcctcgataattaattgacatgaacactaaaaacccatattcccttaaattccataatatccataatccatagcactcacttaatttgtgactgcatgtttcaccgtagtactactaaatatttgcttattaatgtattggatcataaaaaatgattatgttatatatttgtggacaaattttctgtcagatgtaaatacagtatgattataatgtaattatattataacttgtatctaactacaatgtaacttgtatataacttaagtataattttaaaccgttagatttacttcaagatttgtacaagttgggaagaaaaaaaagtatagcacacatagagatgaggagaatctgtccgacctgcgctttgcaaaaataatatattacatacaaattgtaatgtagttatgtaagttacaatataactacaatgcgctatatttatatttcataaatatttaggagaaaatttgtcaccgattgtatagctagacccaacaaaaaatgaggtccaatatgaatatgtaactggtcgaatacacacaagattgaggcccattaaggcccaaaatggtgaagcccatttcctccagtgataaataaagcccatcgtgtaatgggcccgtcccaaaattagccttcgaacactaattcacaggaggtattccgtgatgtttcagctaatgtttcactaggtcattttaaagtgttgcacatggtattattttgatgttataccaggtactttgtgatgttttagtaggcattttgtggtgtttcaacagttactataatataaaattgtttcatatataatataaaaatgtttcatatatattattatgttgcactatttcatttgtaaatgttgcacatggtattcttttgggtgtttcagcaaatactatatttttttatcaacaatgacaactgatttaaaaatatttcaataaaattaagtatatgccaaatatatatgttgtatgctttgtatgattttgtttatgtttcattgatagttaatgtcttgtgtactgtttataattgttgcagtcaataatttttttatatattgtatttcactgaaacgtttcatgaagtgcgctgaaacatttttacataggtgatgaaacatttttataagtagtgaaacaatgaattttttttgacacacgtggtatgtgtatatgtgtttgtcgaaatataactatgtgagatcttgtcacaaagatttaattataacgaatgtaaatatgtaatggaatcatatcttgcatatgtattttaggagaaaaagtagtttaaaacacataaaaagcaaggacgtgtagtatgaaaaggaattggagacatagtagtgagatagcacgtcactgacctgcatgtaacaaataaagacaaagcaacgcagcaagcatccaaatgcacatgcgcgaagcaacagggcaaccatccgatatttggtgcaatatcggacgtccgcgccgtagctctctcccaggtcgaggcatgcatggcagagaccgccgccgcgcgtcgcggcggcaccggccaccccagcgtgcggccgccctggttcgtctcccctcccctccatcccgccgcctctcctccttatcccctccatcttctccgccgcctcctcgtctccctcctccttcaaagccaaccaagatttcatcagggtaggctcgcgtacatcgcgcgcggagggagatcgatcgttcgttcgtcctactcgtatccatcgatcggaagaatcccagtcgccggcgcccaagaaacacaccgaacgctcaggtgatcacaggcatggcgccgcctctcctccgcggcgtgcccgtgctgatcgcgctcgtcgtcatggcggcggtggccttgctcccggccgcggccgccgacgacatgggcggcgtggtggcgtcggcgtcggggcggaggaagatggcggcggcggcggcgacgtgcgacggcgccgtgggggagtgcgacgtggacgacgaggaggaggtggaggagatggcgctgatgggggcggcgggcgccgcctccggggagacgctgatgcggcggtcgctggcggcgcggcggccgacgaacaggtacgtgagctacgcggcgctggacgccaacaaggtgccgtgcaacaagcgcggccagtcctactaccagaactgcgcctcgcagaaggccgccaacccctaccgccgcggctgctctgccatcacccgatgcgctcgcaataccaactgatcatctcctcttcctccgccgtcgccgccgtcgtcgccatcgccgccggcggcggcggcggtggcggcgaatacgctgctgtcataagtgtatgtacatatcgactcaatccaaagcgtatgtgatgagcaactgctgctgctgctgctaaaaaatcttcagtgctaaaatatctatacaagtggtagcatgcattctattatttgtcatcatcgaattaattgcgttttcaaatgttggggaaatattttttttgaagagaatgtactgaggatcagttcatgcatgtttctcggttgcactattgaaaaaagagagaatttaagcgggccaattttacaggagtttttttgaaggcccggataatgggctttgttgatgggccgggccacacgggaacatttacaggcctttagttgctgacctgaaagcaccatttttcttgttctttttactgcctctaatacttgttgctttgagttttttttaatttttgatcttttgtcttatttaaaaaattatggaattattatttattttgtttgtgatttgttttattatcgaaagtactttaagtatgacttctctatttttatatttgcactaattttttaaataaaacgaatggtcaaacgctataagaaaaaaagtcaaagcgactactaatttgggacgaaagtagtatatcaaccttgcttaatctgatcgaaactgttacttccatcccagaatcgtcccagaatatccaataagttaatccgtactccctccgtccaaaaaaaattctaattttaaagatgaatcgggatacatttgtatccacattcatctctaaaattgagttttttctgggatagagagaatacgaaatatgatacagtatatcctaacactatgtccatatttatagtactaaattaacttattctaggacaggtgtacaccggatcccattgcatgctttttttatatgaaaatttttacatataaattatcgtataaaacttcttaaaataggctgaaaacacacgtgcactaaataccaatcccctaatcagagttgtttatcgaattctgtcacctcgcacaagtgacaaccgtgtactgaacatgctcctcctgatcattgcaatggcaacatcaaagtcactttttttaatctcccttaccaaaaaaaaaaaaggccacaccttttttctatggaaaaagccatgctgtcactttgtcagcgtctagtatgaattcagattcagacattgcatgcagatgcaggacgctttctctgctcccatgtccatccaatcgcccatgacagacgcccgtgtacattcctgcgtgcactcaagaacaagcgcatgcatgcatgaacaaaaaagactcctcattaattaatcactaaaaaactactccctccgtcctctaatataagggattttaagtttttatttgcactgtttgaccacttgtcttattaaaaaaatttggaattattatttattttttatgacttactttattatccaaagtactttaaatacaacttttcgttttttatatttgcacaaattttttaaataaaacgagtggtcaaacaattgaaacaaaaacttaaaatcccttatattataggatagagggagtagctaagtaggcccaagaaaaaggtgtttaatcacaaaaaaaaactaagctaagtaggtccatatgatgtctgtttgtatagtgttaattaagtgtagcttgtgttttgttgttttctgcatctgttctgctctcagcctctccttctagccttgttgagattatcatattgatagtatatcatagcttggttatgtttaattagtctcgatggccacttgattattcagctcgatcggcagcagtagaagctactccagtagttgacagaacgacagtaactcaccttgttgattttctacggtgcttgtagctgcaaaactctgcaatcagtgaccactgtgttaatgtatatctaaaggtgattataggtgaaaattggatgatggttttgcgactctaattgtttcagttttaaaagctgcattgcctgcatgcctccgtccatcacgctgacagagttgagacgagagagtgtgcagatagattctctcctcctttttctcgagcctaaagtctgaacgctactgacttttttttccagaatataagcatttatagcacgaaaaaaatcttgagataaaaataatttaagaaagtttatgattgattagaaaataaagtagataaaaaaattaaataaagaatgattttaattgggtaagagaagtgagataggtggaaaaataactttattttaaaataaattattatattaaaattagcgagtacatattttaagtatattttgaaatagaggtagcctcgtcctttgttttctccgagctagctcctcctacattgcacaggagtacagtagaaaacgctgagctggatttcttttctcgcctcggatatcgtgcctgcctgatttcagagagtgttcatgcaataatgtctgaattctctgaatttctgacgaagagaaagaaagcaaacgaaagaaagagaaaagaaaagaaaagtctggatgcgtgtgggcagcagcgggggagcccacgatacaaatagagagagagggggagagaaacacaacacttcaaaagtcaaatcacacactggcgcacgttgaaaagtacgtgcttttattgtcccatctccacgctgatagcattgcctacggatcctctgctatgcgtaccgcagcttgtgtacacgcagggtgtgtttagttcacgctaaaattagaaattttgttaaaattgaaatgatgtgacaaaaaagttagaagtttgtatgtgtaggaaaattttgatgtgatggaaaagttgaaagtttgaagaaaaattttagaattaaactcggccgaaactgaaaagagtaccggatgctgttgttggagcgtatctgtcgatgctcgatcattttcagtggaaggactagatgagtacttcttctacctagctagtatccgtctttttttcttttctcatgcaaggagaaaaaagatatgccgatgtagcctcaaatatctttgtattttgttatgagatactcttgcatttttacgactgtctgataggcatgctacatgtgatgctcatttgagagcatataggctagtatcatatggatcaattgtaatgctcgttttccattgagaatagttcattgtgttgtctatggccaagcctcgaaccttgaaaattgagctagatctaatagagcatctccatatatagcctcaattgataaagcataaaatcagtctagatttgttcggtgaaaaatatatagccatttttctacacttatcatattgaatttataccataaatcagccatattatactctctattcacactatttatattgtaagatgttttggtttgttacaagtcaggcttctctaattttgattaagttcgttaaaaaatacactgccatttgcaacatgcaacatcaaaatagttttattaaacccaccaaaaatgtgttttaatagcatatttcactggtttcatatatgttaatatatttttctattaactaagtggaagttaaaatttttgagttagtacataccaaacaacttagagcaagcactataagagtaattactttaagcattaggtgttacctataaaaaataccacttgcaattatgtgatgaggtaaaagagagaagtaaagccaacccctcatgtaaaggataaacctttatttcaagagagatgaaagaaaatgatcaacagattaagatcaaacgatcaaaataaaattattatatatgttgtattggggcaagcgtggtagagataaattttgtactatatattatatatcttaattaatgagtagatgatatctaggaaactatacttagggcttgtacgaaacaaattatagaaaaggaaccggaatagaaaaaaaacgtaagaatatgatatggttgcacgtggaaatggaggataagaaaaacagaggaatatataggatcgaattttcagaacacaggaatagaaaatagagcattagaacacatgattttatcctataatagccaatgataaaaaagaaagagagaggttggagtggatgtttagaattcctgtgtgtgtttacgggaatgctacaatattcctctaaaattcctttgtgtgattcttacaatccgaacacatcaacggtagaaaaatcaaaggaatcattaatctaaaaaaaatcccgtgtaataaaccctttaatccgaatacgctcttatcgttacaatacggaaaagtgaagtcgtagtactcccacgaaagaaggtactccactggtgtactccaatatgtgcgcacgcagcaaatcatgctcgtaggcgggagcacccccgagaagaaagcatgacgattcctttccttgggatctgattagggcacgcacacacagacaaggaggagcagaggaggtcttctccaagtcaagggcccatccagttttaagccgcccccaaatccaatccaatccccccatgccttcacaccatgcatgcaaaacatatgctgcccactactccgaggtaacctaaaccgactgaaaatgtggcaactcatcccacattttgctattccttttccttttcacctcttcctgctcttcgattcattccagattaatttacaatatcatttctctactatttaaaaagcgcaatcatccatcctccaaaaattcagaaaaaaacaccaaacaaccgccctttagggggggaaatgggaccagtagaaaaaaaaaagaacattacggacaaccattagccctcctgtaaaaaccattgacacatcccgttttaatgtaccggtataccctagtttatttaagatgtgagcctccaacgtgatgaagagtttcacgaagtttaattaatttttttcaaaattcaacacaaaccaagcggtttagggtagctccgaatttcgtgcggagagactcaacggaatttgtgaataatgtacgatggactttcactgaaaaaaaaaaagcacctcatgtgtatatagtactagtagtatgttttaggccccgttcgtttactttgaccagaggatattttcagcacacataaaacgagaaaacttatttaacacacgatcaattaagtattaactattataaaattgaaaaatagatttatttgatttaaaaaaacagcttctacatagaacttttttttttttgccaaaaacgcatatttaacctttaaaaagcacactaacaataaacgagaaagttgaagtttaaagttgagaaaaataaatgggccttattaggagttgatgggatccttttggattgtagtttgttgagatctctataataattatggttagtaggaaactgggtaaagccgtaaaggtgcagcctttgaaactacgagacaaatatggtggaactaattagaaaccatcatgcatgggtgctaatacatctagcaggactttgaggtcaatccaactgactgactgactggccactcgatctttctaaatctgcttgacatgctccctaattattttttggtcgacttagtgcactgctgtgacagtgacatgtgtgtggagatgatcagcaattcattctgaaattgtagcgatgttattgtgagtaattaacctgtaatggcaaaatctacaagtaactgaaccatggcagtcgatatcaaagatggtagtatgttttactgctagctgcacacaatgctgatcttgattaat

SEQ ID NO: 64537 - DNA, 5708 bp, Oryza sativa
gtgctacaataacccacatatgctaatgacggattaattaggctcaaaagattcgtctcgcggtttccaggcaagttatgaaattagtttttccattcatgtccgaaaaccccttccaacatccggtcaaacatccgatgtgatacccaaaaattttgttttcgcaaactaaacatgcctatgtcactactagaattcacaagtatccctagagccaaaaactctagggaacagccaaaatactctagggatcgggtttctctagagtgaaccctagggaatggccccctagagaagcattctacgggaacaaattggttcccttgggttttcttggtagaatctagggaaagaagctttccacgtgttccaaaaggtagggattgaatgccacctgaacagaaaaaatccaacgtggaaagtggtacagcaccctagggaacatttttattggagtagttcatttagaaattaatgcagattaatttagctcttgattaatcgttgattagttttatttgtttattttatttcttttgcaaacaaccagtaagcattccaatcatattttcgtcaactgtcttgaacaaaaaatatatatactgcattacaaagttaatctcaacagtaaaaattgggagtacatgcagagttgcccatcgaaaaacaaaagaaaaaaacacacacacgcagagggagagtacatccagagttgaaaattgacgaacacttaatagattgtggctttgctctctcaaaagtcaaaataaaacacaaatatagccttctgcagtagttgtatccaattgaaatggtacgtaatagcacttccagaagtcatcaagctgcaaaatgagtaggaaggttgaagaaaataagtacttatggaaatctgtagctacatacgtgggattctctatttgttcaatataataagcacatgatttctagctttgattactaaccgcagtaatatgattcatttatcaagttttgcaagcatagctcaagttcttgacttctcggccttaccgatctgcatcaagcacataattcatcaaaaatcaaaacttcaaaatatgcacagaaaaatatctgctcgagtacctttgctaaatgctaactagagagcagctcggcaacaccacgctgcacaggtcgccgtggccttgattcacccctgtcccggcgtcgcctctcacccgcaaacagatgcaatcagcccacgcccaccacggccttcaggagtgctgctgcaaccaccctcgaaggtcgaagctcctatcgatctctactacttgagggtagatttggtggtggagactggagagggagttgatttggggaggaagagatgaaagaacatgttgaaggaagaacaaaggggaaagtttagcagcttggggtactttattactttccaatggaaagagaatatggtgcacagtccaaattttggattcacaaggcgggagaaactattacaacctttccacgtggttggtttctgaaaaagtcaatggaccctgccaccgtggttctcctatcagtgccaactgtactagtttccctaggagcaagcaaaaactctagggatcatctcagttcccttgagttttagtttcggctctagggaacttattatccccttgggttctaattagggctctagggaacatttgaaaaccctagggaccccgtggaattccagtagtgtgtatacctcctccacctttccattctttttaataaagcttgatcattttttctcatgaggatcaacatgctataccgtgttacgaaaatagaataaaaattagtgttaacaacatataattcttgaaattattgcacacatatcatggagtaaaaatgagcatgtttcacatgaatccattcaaatgacaactcttgtggacccaatgacgacagaatttggcgggttttcttttaggtactatcaagctgtaaaaaggagtgtgcaaaccatccatgcaaccttgtatttttcaaaaagcttgatattttcctatggagatcaaactaatgctaagcattgttcaaaatagagccaaaaaaatattaaataattacataaattgttcaacgcgtattgtgagcaaaaagaagcatgcttcacctaaacccatacaaacggacgctcttcttgtggacccaattgaaaatataatttgatgtgttctattatcatggtgttacaatgagtttgaaaattgtccatacattgtgtcctttataaaacaacatgatgttttgagaaccattaataaggcttagcaggtaaatctatctttatttttttacacataccgtgaagaaaaagaagtacactttatgtgaacccgtacaattactctcttcttatggacccaatgatagcaaaatttggtgtgtttcatactatcaagcggttacgaggtgtttgcaaactcttcatgcattgcatattttctaaaacaacacaacactttgaaaaccgccatagacttagcatgcatctctggaatgttgtaaaagtccattcaaaagatagaacataacatctaaccaaaaacttgcatgaatttgatgaattcaatttctaattcttgtgcccatgcctttccgtaggcattgatcttttcatccgaagatcaaactcatattaggcaatgttaaccatctatgcacctttgtctttccaaaaagcttgatattttcctccggagaccaacccatgctatgcaatattcaaagtagagtcaaaagaacaatattaataattctagaaattatcatatgcatatcatgaataaaaagaaacacgcttcacataaagccatacgattgaacactcttcttgtggacccaatgccagcagaattttgacgtgttctaccatcgagccgttacgaggaatttgcaaaccatctacacaccgtaccttttctaaaacaacacaatgctttgaaaatcgccccagcttggctgacaactgtatcttttgggattttgcgaaaaaacttttcaaaagaaaaaaaacggaaccttcaattaaaaacttgcacgaaaagaatgagagaaatccactggcgaagtatgtatattcacccttacttaaacaaccatagccttttgattgcaattacaaacgtaaccctcccttacaaacacaataaaaattctccttgcattaagaaaccacagcaaattcacccagccaaagaacaacaagatccaaaccaaacccaagaattcaaacacacatccagctgacctgtttggtcatccagcacaacaagaactgatcttctgagttcctgaagttatgccaccatcactactactagtagtagtactggtatgaccacatttcttcaagaggtcaggtcagaattcagatctagcccccacactcagccagccaagtcactcacaagcattttgccaacatattccggagaggagaaaatccagatcccaaagctcccaatttttttttatttcaccttccaaaaagcccaataaaaccccccctcactcttctctcctctatcctcccctcactctctctctcccttgccaaaggcgacatttttatcatggccaccacctccacccacgcgccgccgccgcactcgccgctgccgctgccggcggcggccgccggcgacccttccaacccgttcccgaccacgttcgtgcaggcggacaccacgtcgttcaagcaggtggtccagatcctcaccggcaccccggagaccgcggccgccgccgcggcgggcggcgcagccgccgccgcgccgcccccggcggcggcgaagcccgcgcccgcgccgccggggccgaagaagccggcgttcaagctgtacgagcggcggagcagcatgaagagcctcaagatgctctgcccgctgctccccgccgccgccgccttcgccgcgggcggaggaggggggttctcgccctcgccgcgggggttctcgccgcgcggcggcgggatggaggtgctgtccccgagcatgctggacttcccgtcgctggcgctgggcagccccgtgacgccgctcccgccgctgcccgggtccgacgaggccgccgcggccgaggaccgcgccatcgccgagaaggggttctacctccacccttcccctcgcggcaatgccggcgccgccggcgagctccagccgcctcccaggctcctccccctcttccccctccagtctcctggtcggcagtgaccatctcgccatcttcttcttcttcttcttcctccttggtatgctctgcttgtctggttaatgatgctctaattacatggctcatggagggcgatttcatcgctggattgtccaaatcttcatcttcatcttcatcttcagtctctcctgtgagctctgggaggatcgaatcgaatccgtgtatgtcagtcatgttgtaatcctagtgtttgtaacagtaaatttgggcgcttaagagagattaattgatcgccgagcttaaagtaactgttctttcctcttttgtttttcttttcttcctcatcttgatggaatttgcataggttttagcttgttttttttcctttcacttctcttgcttcagaagcttgctttggcaatttgacttggtagagtaatttggtagtccaaatcttgtacattaaagttttctaaattgagttatatgcgagaggcaagtggatgctcaagttgacattttttttatggcagctaatatacgcgtattaaaaacacacgacacttcactcttgcagtactttccttagaactggtctcatttcaaacaaatcaaatgcttaggttcagggcgaattcgtcatgccacatgctataaagattacaccctcttttttttttctgtttgtttctaaagccagccagcattattgattactctcatcaagatcaggtaagagttttgatctgaacagaggagctcactgacacttgacatttgagctaggtttgctgagttgtttcaaggaagtggcagctcaagaccataatcagagctctttttctgaggaagaccatcaataattgctctccatcttcaaatcttggcagaatctggttgaaatcgggcatctggaggaggagatgcaaacacaaagtgaaaacaaatgctgcattttcgcctcccctttttcataataaaatcagccatctttgctgctgctagtggagatggtggtggtgggagtgggaatatgagactgatcaaaaaggagaagaggagaggaagaaaaaaaacaataataaatccggtggtggtggcgagtgagctccaccattttgcatcggggaggaggcattagtgaaaaaaaagaagctgaatttagggagaaaggtgacagcttttggattggggaaaagaaattctgcatgattttttcaatttttttttttagaggaggaggaggaggcccacatctgtcagtgtctcgaggtgagctcagttcttgcgcccacaaactgaatctgtgtgagtccatcatcatctctctctctctcaaatgcgttgcgatgcaaatgcaatgcatacatgctgtagcaggaacagtgggctgtcagaaatcgagccgagagagagtatctcagatctgtctgctcgcgtcgcagccggactgaagagttcatcagctctgcaccatcgccagcggcgggaagaagaaagatttgggg

SEQ ID NO: 64538 - DNA, 14209 bp, Oryza sativa
atgataggaaaagaattattaagtgtcaaaattttttgaataagacgaacggtcaaacatgtactaaaaagtcaacggcgtcaaacatttcgaaacggagggattatatatttttcttttcacgtctacagtgtggaccatgtgcttacagagagagataacagtacggtgttaatccacactgttgcgaaaattcctaattactactctgtaaaaaaaatcaaatcaaatcctaactacgaagctgaacacgtatttgtctagatttgtagctgggattaggtttctttgggacggaggggtacttcatatccaaattcgtactagtaagacatgttttatctaatcaaaatctttatattttgggattgatggagtattgtattttgcaaatgttttaagcattatatttaggaagttactttttatagctatagtggtgattctgttattggcctaccacccctactgtataaattagtccatgatattatctaatattatgtaataatttaatatttatttaaatcaagtgaataacatatattcaaaatatggacattttactcatagcaaagcatgaacattttactactactctaggtaaaaataacattttactactacattcatatcagaatataatattttttaggtttatttgaacacggttattaagaaaagtagaaagaattaaatgagagtaggttgcgatttaataagaagtgaaggtagatggaaaattgaatggtagagggttgtgattagttgagaaaagaatgttggtcaaaaaattattatattttaggacaaattatgaaggctaaaaatatattttggaccggagggaatagtgatatagaaataaacaagcaaccattagtttttttaaaattctcaatagggtaccccatgactgcttttaagaatatctaactactccctaaacagagttcacagtaaaatgctaccaagatgcctttagccctaaatcatttttgacagaataacacataataactctttccttcaacactcaatcgctaagggttcttcatgcttctaacctaaagcttttttttagacatatttctaggtggcttttattggtagtagaatcttttatttttcatcgataaaccgtatttatttatactaccacctattgatacactttagtaaaatttaaaccagagttcaatcagttctaactaaattttaaaatgtgcaataccaaatgtatggatggactcatcggtgactccttgatatgttaacaaagagaacggctttagggatatactgtatttccatattatgtttagcatgtaaaccatgcaatgacatgttcgcatctatttttcttactagttggagcaaagctaccactaccaagagaattgaacataacttttccatgtggtgattgatgttgtcgttcattatcatattcatcgcctatgatgaaaacttcgtcaaggtttccatcatttgtttcctcccttagcatagtggtggatctgccatgagggcggcgagggttcgagccctcactattgacaagagactataggagcctcaccgagctctctaaaaatttctactatacatatatgaaaaagaggttcgagttttgtttagtttattcaacctctactattttttttcctggatccaccctagttagcatcacacctaatctttctttttttgttatcattcacaaactagagctcctatgcaaccacaaatataagcgcaattgcacaaaccacctcgcttagtttgaggaaggtaaaatgaacggttttaatcaaatgccacatggtttatgtattttacaggttttcttttttcttttttgtttcatggcttccaaaatccaaatgtttggtgcagtaaaccgatgttacccttttatggaaaaatgttgcaaggatgaatcatatgaaggcacaaacagtacatcctatgttcatcaatctgactgtcattgcattgcacagacaaaagattgcagcagtactcgatcgatcgatagctgcagaggaagtagaaccgtacgcagagaagagctgatcggttattattagttgggttcatttccggccagattattattgctcctgcactgttactgctccctggcaccgacagtgcacacacgtacagtacagccgcaatgcaaacctttacgttttcacaaccaaaccaatcgatgaatcgacgcatgtttcagctcagtttcagaaatccgccgaccgaccgagcgttgcttccgtataaatgggaatattttcgattttaggcataaacaaaattatcttttcttttagtttgtttttcagtatcatactgctgccagcactaaacagttacattagtaaacgtaatcaatttaagaattgtttccgaagaaatgcctaccattttcaaccgaatttatcatgcaaacgtcactactgcacagttcaattgcacactgctgcggttacggctggtcgtaacagtttgaattttgaatgccataagctgtactagtgctgtttaccgcttgctattgctagtctcgcagctacaagacgtgtattaatttggtgtgtttatgtactaatgtggtgtgcactagagtttgtactggccaattaaattggtcggagctatagctagccgcaaagccgttgctgttgctgtctgcctgcccctttgcccgttacggggatccgatgttaccgactgctcggctcagtaacctacagtgcacatgtgtttcttaccgccgactatccaagggcatgcttcatttgtcctagtatataagggattttaaataaatatatatgacatgtatattccagtattacgaatctggacatactttctgtccagattaatcaccggtcgttattgttgtttactgagcgatggtcgaaatcaatcattggcaaagtaaaagatttctagaggtgactttttcctgttctttttctttgtgggaggtcaagcgagacttcggtgctctctaattgctgtacgatttaattaattaattaattaacagtgtggcatctgatccttgtttcccataacaacgaaacgaggcagcagaaaagaaagaaaaaatttaaaaaaagaagaaataaagctgccacacgccgtctacacgagcgagtgagtgagaacagcagtgctgatcgacatgatgcaaacgaaatttgttcaaagcgggagaagatgtgttcggaatatctcatgtcagcaagcacccacagcgacagaaacgattgccatacaaagcaaactcaaaaaacaaccaaaaggttaggcaaagatgccacatccggatccccttgggattattgttaggggggagcaaagccactatctaggttagatcgcgtcaatctgtaccgtggatcgagatcggatggttgaattacaccgatggtcgaattcctattttatatctataactagattgccaattgatcactgttcgattgctagattacaccctttaacacataccagatatgtatataatctctatcgacggtcaattcatgtaacaactcatattgcaccttttacacctttaagataccaacagtaagtcagagaattaatgagttaccaatggggtaagaattaatcttgtgtttgttgtgtgcctaatagttaataatcaatatgtttgacttgggaacatcagtgctgaggtatatgcccacatttgcacatcggtttaacttttgattaaattagttgatgcatgaatccccactactgatgcaatggctcgcacggttttatagagagtaaatggcatccttattattgatgtcaagtcaagggtttatttatcaatttttgcagttctgtggcgtggtcccaaaaattctatcaccacagctaccgcataatatattttttatatattatctctacaatatcattttcttatccatcagtacgagccttgtgtagttgtgttactaaagattaactgcaaaagatataaaatcatttttatacttaaaacatgtataaaagcaaataaacataagggatacttaatgagtagtagtttattaatatctattcaagtgaaggaaataaaaggcatacccaggtttgaaaatttctctagttcactaatagggtctcttacattcatagaaaaaacatagaaattttaaagtattttaattttataggatattttcctatgaaggccatgaaacaaaggaatgaatcatattctatcctttgaaattttgaaattcttatagaatggacaattcaatagagattttgaagcaaacttagcaagagctctaatctttttgaaaattttctttggttcatctttatcatccgattccaatttttatcccgcggttcagtcaaatggttattgttgtgttttttttattttgcaatgccttattttgtacttacatttctgttagaataatgtgttttttctaattctccgttttttctatgattcaaaagtgccctaagttctttttaaggaagtgaagatctggctagctaattcgaagcttccggagcttttaaacggtaatacaattttcttttaaaaaaactatttaaaatatattttttatcctcaaacggtgatcataaatcattcagccattcggaaaaataaaaaaccaccaaaccccacgcaaatcgaaattcagctatgccaaacaaaagaagagtgtttttcccaaaacaaaaacttttcatctatcatatcgaatatttgaacacatgcatggagtattaaatatggaaaaaaaaactaattacacagtttgcgtgtaaattgcgaggcgaatcttttaagcctaattgcgtcatgatttgacaatatggtactacagttcacatttgttaatgacagattaattagccttaataaattcgtctcgcagtttcctggcggaatctgtaatttgttttgttactattagattgcgtttaatacttcaaatatatgtccgtatatccgatgtggcaactaaacctaaattttttccccaactaaacaaggccttagaaaaaaaatttgaagattggattccagtaccatacgagatatcagaaggaaactggcaacggcctgtagactggatcaaacgtacgctatgaatgctggcttctagtacgataaattccggggagcagcggctttccaaggacgtctggtacattgcctgcaacgcacttaagcgtacctacgtacagcaaaaaatttaaccgagtcgatctttgcaacgtctacgacgaccttttcttcaggtactctgtgactcgaaaaggatgagatatttctcgatttctcaacggtagatgatgcgaatgatttcgagaaacagctgattgataattcagtttttttaagatttaaaaatctgggttttttaattgtggtttctagtttatttttcgaattctacaactataggtttataaaatctgagtaaaatttaagttgtttagaaagatgaagaattggtagaaacttcagctgcttagaattagctctctaaacaggtccaaaggattttgggacctcggagtctgatggtgcgagcactactacagtgtacagaaatctgtcggtggctgaaattatccggcacgtttcattgtgtatgtgcatggttaactttaattacaggtcggaaaggagatggagaagaccagccgtgtgttgattcccgtacggaatgtgaataaatccgtcctaaatttagtactgtaatcaatagcaccaacgtctaaaaacattgcatttcaggttatatatctgaatatatataatacttttaggacaaaagtaatacaagacaacacattgagcatcgcgatacatcacttcttttttctttgtgaaagatgaacaattagcaacttgcatagatcgaaacaaatgtaactcaactggctagctttcttgtgattgaatcaatccgagttcaagctgtagatttggcacgtgtacttgtttttacagctaattattcttttagtagtaggtgatgtacctgtcgatagcgagacgttcgtgatggtttcatcaatgcaatatcaggatatgctaacccaatcttccgaagatgcttgtaacggtaggagtacgcatgtgtatttataaggatgagtgtgggtgtattgtgagcgcctacttttgtactgaatttctaaaaaaaacaacataaataggatatcaaggcatataatcagtatagtgaaactcaatacaacaatgatctctgtcctattggaagttaagcagcagacaagtcagcggcagagtttacaacacccaacacaactgttgggttcttgtaaaatttagagatattttgagcgaattcacaagccacttgataaaccctttggctgttttttattaaaaaaaacaaacttaatttcaaatatatggtaaacgtgtccgaatttcactggcttttcaactgtttttcacataaaccgaggaaaccactaaggaacgatcccataattagcaacaaacatttaaaaccatggcaagaaaaagatttactatttgttatcctttcaaaatgtcaattccaatatttactattttttgaggcaaagtgagggtcagatccaagtcagccggcacgaaagtggggctccaagctgaaccgacgctgccacgcagcgcaggagccaatgcaagtgccatattgccgtgtgacaattgttaacatcagcagcagctagccctgccggctctgtcaaatccttctcctgcttggccgaattaacactgcggccctgtttaattccaaagtttttttttccaaacttccaattttctatcacatcaaatatttcatgcacacacaacttttcagtcacatcgttccaatttcaaccaaacttccaaacttcagtgtgaactaaacacagccgctgttgttttgccatatcatgatgtgacgaagaacggatggcaaattgttagcatcggccagtttgtcttggaggaattagccaaatttagtcactgtttggtaattggtacggtagaatttttgttttccctttttagtcacggagaattcattcaggtgagaattgaaatggttttatgtgagaatcctgcaaatcaaagtgaactcttgttactacgaaaattgggccatagtgtacatcctgatttatggcccataagcgatctgaggatgttatgggtcgtgaaaggaataagtctatttcgtatccctgtcttgcttcttattgaatcgtctcccttaaccgcaacttcgggtgtaatgtctcccctatctttgaaaatcagtgcaaattgactctttcggtggtttaggaaatggtttgtgctgacagtcaacctgccacgccaatacaaactttttttttcgtttatacaaactgctttccaaaccactgaaggagtacatttgcatctttttttgaagttggagaaggtgttatacccggttttgcagctaagaggatgcgatttggtcaagggtaagagactagggataaaaaaatggtcagaacagacttattccgtcctgaaatgaactgttactgaagcacataaatttgacaggaaactaggcctttcagttatctgcatcttcttcacttcctctctatctctcttcgtgctttgcttagcaagcaatttgtttcattttcctctgattttttagtaatttttgccttcctcttgaaattgagattgcaattgctgcatacctcagaaagcactagcaaagcagaatttatttttaataaaaatcattatcactacatggttctatggacgatgtgtttcaactttctacagccggtttcattctaccatgacagcttgacagtgacagtcgagtggtttcttaattcttctaataattgttcgtttattttaacgtagctgtttgtttgtttgatataaaagtcaggatcaaacaaatcatggactgataatatatttgtcccacgtttggtcggtcttgggttgatggagattggagaaagggggccgatgtctcgatgataacttaatttttgttgttatttagaaaaaaaaattgagtgaatcttagtgccgtgaggcatctgataatccctcttagattattggtaatatactaatatgccgagaggatttgggtttcgtctcgaactgaaatatggtcctccaattctccttgtgattttgttatgcagtatcagatgtatgttccaagatttttctttttttttcaaataaaccatcatccaatgccttgaaagaaaaaacaagaaaaaaggactgaaatttggcgaattattgtcgctgcgaagaactcagagagaacatgtgatggcaggcggttttcaggcagccgtgacttgtcgccgagcaaagttcagacaaaaatacgggagattcccatgtcgacgtgcagccatccagccaaagtttccttcttccgtaggcatcatatctgcactccaaatgccatttcacttctctgcctcattttctgctctttgtctgcatttatgcctgtccatttctgaagatgtccatttcagcctgaagatctatcagcttttggcattggatagtgtccactgggacagatgaacaaatgacaaagcaggggggtgtgctgagttttgtttcttgcagaagatttgtttgtttcctcttcttcctttctcctgatgatgcaattagaggtgagacaagcctgtgcaggggcataggaaaatgcttggttagatttgggaacaaaattaggtcaaatggatgagctgtttgtgatcttccatggcatggacccttgaggtgtgaaatggcttgcttgtaggtggcatgatcaggctcctgcaaatcaggcagaatggtttaatttttttttgatttgttggcatcaagtcaacatgcaatatctactccatatttatttggtgttagatggattaaaaaacagtgtaagtacagaggctattagttatatattccaccgctcatgtggatgatcaagtagtttaatctgttccatctactgaccaacgtgctattttgagctgcacttgtaaatttttcaatgcaactagacaattatccgtgccttgctaactgaccagtgtgccatgatatgaaattagcagtgtatcataaattctgtacttgaaaaattgcatatagcactaccacaaaatcgatttttcttgacatcaccttattattttctctggcgaccatacgcgaaaactgtcagcgaaaatacaacatgaggttccgagttagtaaccgccattgaaaatctatttcagccaatatagttttgctaattgacatgagctgaaaaaaaaggttattcaaataataaatatatgtatatgtacaaaagattccatggtacgttggtaaaatgcatggtactgggatcgcaacctcactaggctagattcatttataatagtagagacacaaatagattgattttaatctaccttaaagacccctcccattaatttggctccaagcctccaccactgttaccaaatgggagttacaactataactataatatattgaagtagggggtcttttttttttttttgaggggagtagggggtctttatttgtagctataactataatatgggagtttacaaatggatgtatgagtacagttatggttggaaataaatgtgtcttgggtaatatctccttaccttttcgtaaacgagataccatgtgttaactgatattttttcgtgctatttttctgaaccttcgtggtccttagtcaatgccgagcaatacaaaacttctttagtgattctcaacatacctattttattcctatatagttaactatcccctatgacttccttgctcatgggataatcaaggatgagaaggaagtggagaggtggccattgatgatgtttctatgcaatttttaggctaggaaactagtctcaatgatgtttctatccattttttttacgagcacccatccacattaatggacttgtgcctcttggattcattgggcctatcattcccctatgacttcattgcttataggagaactagagatgagaagaaagtcgagaggtggccgttggtcttaggctaggaagctagtgttgatgatgtttctatgcaattcttcacgagcacacatccgcattaatgggcttatgccgcttggattcattgggctaggggtggatatcgagccagctcgactcggctcggctcggctcgctaccttaacgagccagctcggcttggctcgttagtgctaacgagctgaaatgctaactcggctcgactcggcgagctggctcgttgagcttgtttagcttgttaactgaccagccggcgctccctatccgtgaagcagaccagcagggtgcgggaggagcggcatggtcggtgtcgtcggcatggcgctgcggctgcgggaggagcggcgtcgtcggcgtggccctgcgggcctgcggctgcgacctgcgggagaagcggccggcatcgtcggcgtggccctgcggcggcagaaggagcggccggcgtggtcggcgtggccctgcggctgcgtggccctgtgtcgtcggcgtcgttggtgttgatggtggctgcgacttgccgcctgcgagcttgcgacctgccacggtgccgcctgggattcagtgaagcggctgaaaagatagggtttagccgtaattagggaagacaggagttggccagttggggagagagtttttactgggttggtcttgggccggctgtggcctgtgggcctgtggatgtgggattcttgggctatgcgagtttaacgagcctaccaagtgactcgcgagctagctcaggatcagctcgttagcttaacgagcaaaactgctggcttggctcagctcgttaagactccgagctcgagtcgatcggagccgagcctgaaacgagccgatctgagtcgcgagcttcgagcttttttttccaaccctacattggacccatcataaggtggacgcagcttggaaacaaagatggagcggagatgctcactcgataagaacaaccaagcaacacataccatatttatgttgtaatttataaaaaatatagttcaatcaataaattaatgcaaacaagaaagtatacctttaattttaaataaagtaatattctttgcaccataattcatcatacaccatatcaagtcatcgatcaattcatcgaacctcctattatgcaaattggttctgattatattaatagccgagaaggctctttcaacatatgttgttataacaagtagaagcaatgctaagttaatagggtgatagaccaatggaaatcaatgtccttttgcatttcaaccatcttcaaggacaaactaccaagatcatgtgcacatggcagtgtcgatgtccacgtgggaatcgggatggctttggccctagcggtgccgacgccttggtggcatgaataaaagacgaaccgttcaatccaagacttaatgatcgatgggactgatcgaggagagacgagacgtcagcatttctattttctttcgtcgcttgtggccttccacctacagcgtgaatacttgatgggctggtcacttgtaggatgcttatggatagaatctggtatcaagaagcccaagggaggatataggagtttggggggaggggggggacgcaggccatagctgggcctatcgacctaccctacccatgggtggttccgtccctccatcatgtaatgttaacggatgggcttgaccatcaaacaccttgataccatttcttgtgatcccctttgttgtggttgggagacacttgttgtcgcctcttcaattgatcttatcatgctcggaggctatacctacccatagctattttttccatcctctacgtcaccactagcttctacctagatatttgttgcatccttatcctacatatctcttgatatcgtcgccaacattgactgaagacttatttgttatcagccttgtcttttgctatatgatgacataacgtttgtcgtcgaagatcaaggccgagtggagggaagtagcattaccatagacacaagtgggctagagaacctatttcaagcaagaattagttagcatcaatgactaatttctcttcaaacttaggtattttgtgtgtatgatttctaacagttttctagtttgatgttgttttattttattgaaacctttgaaagttcaatggttttgttgttgtctccctttggtagcattacatttgtgttacataagtttatttgggatagaaagatgaatttgcgggatataatgaatcgccatcaaagtcaactaaccaagaaaatcactactccctccatggataaactaatgtttgatgctcctacaaaccattttatcctacctagataccctagtagaaaacattgtttgcatgtccattttcctttttggaccacaggaaaaaaatgccacatgaatagaacaaacttaggaatatgaacaaaatataggtgcaaataatatattgcaaaagcacatgagagtgtagggtgcgggcagggaaatttcgaatggcatcacatatgttttctatacgcacaaagattgatgatttttcatatgaaaaatattcatcaatcctacatcccaaatgttgatatagtgaaagaatagtatgtcgaagaatcctttacgttttctccattccaaacgggccgactagtttgttgtttctaagcatagagctataaaagatacaactagtatccttactatgtctctctttttatgtcaccatttatggttgatgatttgttgtttccttgtcctacttcttggtatccccccacatgttgaccttaagcttttttttttgtcgacatccttataccttctatcatctttgtctcgtgtgaccgtcacactagtcatcaaatatttaagcaaagtttggagggtgtatgtaaaaaatatcatgtatttgccacatatctaacccacaataatttgctaatataatgcttgtgtcaattgtatcgtgtcttgtaaaaatatagtttgacgacttttatggttatccgccttgataacattattacttttgtgttacattaatcaaatcatgcaaataagatggggaaaaggggaggaatatttttcaccatcacatatagctaactaagaaataaatattttcctgcaaaaaaaaaggaatagccagtgatggagggatgcaatatgcatgcaaatagtaaaacaaacaaaaaccaatgcatgaacctagccatggaggatcccaagcaccaataatggaagaaaagaacgtaggaaaagaagaaaaaggagagggccaatgtagacttaaaaactccctaaccactttttgtgcaaagctgacattttcaattctgctgtccctctctccacctctgcctgcatgctaccagccccacactccaccacaacctctcttcccctttcctttgcctgcattctgcattttgacttctcctcctcctcaaactcactcatcacttctgttccttgaatttatttgtatttccatacacaccctcatcttctactactatcttctagataccattctaaaaaaaatatatgaatttctagagttttgcaggtaattaagaaaatatattgaattaaatggagaacggccatgattcgtttgacaaaaattaaacaaggaaagactatgattaaatgagatgaaggagtaggtgtttaaatactactcctatatttcagggtaaatttagataacgagaaactactatattttgaaacagcaagaaatagtaataatattaattactatgtttccattcatgttcatgcacatgttcactgttcacatttgtttatcaccttctcacataggggctgcgtttagttcacatcaaaattggaaagtttggttgaaattgaaacgatgtgacggaaaagttggaagtttatgtgtgtaggaaaattttaatatgatgaaaaagttgaaagtttgaagaattattttagaactaaacacggcgaggattacacgcatggtagtaccagatttgtagccctgagaagtgaatgaaaatccacagtttcccccaaaaaagcctcctctttttacttacctgaacttt

SEQ ID NO: 64539 - DNA, 1263 bp, Oryza sativa
cgtctttgttggcccttggagagtcatgctccattgctccgtttcaaggtcgaaggaaggcatgcagcctgtccgtatgagggaggaggcggcaacgcggttgaagtaggacaggaggaagtaagccgcgcctctgtacacgactccattggtgaagctccaatcaggtagtccggtgggttgtccgccttcctccactgaggtttcgtgtcgctggtggtgatgatctccgacacgtgggagtagtccctggactccacgatgcggagtagcttgtgctcgcctgtgtgagatgtgcggccaaacgcgagccaaacacggtctccgcctctggtgcgacggcgaggtaagtgcagccgcaggggatgtgcttgacgacgttgccggaaaggtcgacgaggttgatacgtggggtaggagaggtctccacgccaacggcgaggaggagggcggtgtgagggtggcgggcggcgtgcgcggcggcgaagagcgggtcggaggtgaaggaccgccacgagtggcagacggcgcggaggcggcagatgggcttggcggggaggcgaagcaggacctcgtgcagcatctccggtggcaacacgccgtccactgctcctccgtacccactgcaggcgccgccgacgaggacttgttaccgacgcgagcacgagtagtaggaccgccacgacggcgagaggcagcgcgcttgggcatcacggcggcgacggtcctcttccggcggggtctagaggacggcaaggaccggacgggcttccccatgtgttcctgcggttccgaattccgacggtggactgagggcggcagcgatcgaggctagggctcaagataatagccgatcgaagaggaggaggaattcgaacccggaacgacgctcacccggtgaccggcggcgtcgggttttacgagggaaactgttttaacagctcgagtggacgtccacccgtttattgcatgtcatctaaatggttatgaaaaaaattgaaaaaatatgaacaatatatatatatatatatatatatatatatatatatatgtatatgtaatatatcactccacaaacatgcaagttaaaattcaacttgtacaaattgtagcaaaaataacaaacaagactcaaattaatatgtatatttacagttaaatttgttatttttgttacaacttatagaagttgaatttgaacttgcatgtttgtggaatgatatattacatattgatctatcttgttaatttttttgaaaattt

SEQ ID NO: 64540 - DNA, 1605 bp, Oryza sativa
tagaacttacattatgaatacactaaaattacatatgtaatttagatacttacaatgtaaatacatattgatttttttttaaaaaatatggcaccataaatatagctactcccatgagttttcttcccaaaattcaaaactatgaacacatttagtatttagagtatattttactgtgtcacctttttattatcaatgtttcgctttggatcacactttaaccattgttttcacttcaggtaatcttacctttgtttcattttggatcacctcgatactcttctaatgcatataaacgatttcgagtatgccagcttttattcgtcaatgaacttacgtagctatatttacactattgtttgatatacgataggttgatgtagatagttaaaggtagttaaagtgccacaaaaggtagatttacaatgtttaaagtgaaaaaaaaattgtgaaaaggtggtacaaaacgaaacaacagtaataaaagtaaattttactgtagtatttattaaaaattagatcaaaatataaacactcgtagagtactactcaaataattcgaagtacttcgtattagtagcagatcatttaattttcttttcatattagctccaactaccttctcacccaccatacctcatttaacctcattcttttgctaaaatttctaaaggagatttatagatgatgtacatagatacatctatattgaattattgagacgaaaggagtatattggaatggatgtagttatgtatgtattcatctttgttgcgaatataaaccacttgtatgatttttctttttttttttggaaatgacacatttggcagagatagccatgcttgataacaagtttgttgaggtgttaatgctagtgacatcgtagtatcataagtagagtgagtaatgaattacacctatcatatcatatcatgcatgacgtgtcaactgtctagagataacaatttatagcacataagttgatgtacgctttgtttagtttccacataaaaaatttacaccctatcacatcgaacgtttgaacacatgcaagaagtactaaatatatgctaaaaataactaattgcacaaattgcgactaatttgcgagacgaatcttttaagcctaattgctccatgatttgataatgcggtgctacagtaaacatttgctaataacggattaattaggcttaataaattcgtctgactgaataactgaataatttaaggtacaaacaaattaattaactattatagaattgaaaataaatttaaaacaatgttttaagaaatttatatatataaggtttcttttaaagtgaaccatttagaagtctaggaagcttgtatattattattctatttatttttcccatagttgcttattggtttgctatcacaaactctgcttaagtgcttagtatttgctctccctcccggtttctcacttaatcacaaatcaaatgacatcgagtttcgttttgctttatactctttctttttactataacactaatatgtcaataatatacataaattagtggttgaaggattcttaattgtagaattatctttttattagggaaggttagtttcaaa

SEQ ID NO: 64541 - DNA, 5889 bp, Oryza sativa
aaaataactatattgcacaaattgcgactaatttgcgagacgaatcttttaagcctaattgctccatgatttgataatgcggtgctacagtaaacatttgctaataacggattaattaggcttaataaattcgtctgactgaataactgaataatttaaggtacaaacaaattaattaactattatagaattgaaaataaatttaaaacaatgttttaagaaatttatatatataaggtttcttttaaagtgaaccatttagaagtctaggaagcttgtatattattattctatttatttttcccatagttgcttattggtttgctatcacaaactctgcttaagtgcttagtatttgctctccctcccggtttctcacttaatcacaaatcaaatgacatcgagtttcgttttgctttatactctttctttttactataacactaatatgtcaataatatacataaattagtggttgaaggattcttaattgtagaattatctttttattagggaaggttagtttcaaaactgcaattatgtagaaacttcaggtggtgaaaatgatatggtgtcctatttggtgatggatggatgagttagccaagtcctcatgtatatacgttaatatttttgtcctctttggtataactctggatccaatattctttggagctaggtatttttagctctacaaatccatagatctagattaatgattacagtggtactattttgataaattattttgttcccagtttatatgaattttaaaattttagatcacaattttacatataaactacaaatctatggtggatctgagatctgtagttatgccaaagaatacctcatattgctgatcctttctcgtatgctttctaatggagctagtatctgcagctgtattatcagaaatacatttaaatgagatatgttttgtatgacccagttgacggcctcacaaaccctaaacaggagggaaccaagcctgagctctaggcttggctcctaaatcccattcaaatattcttaaaaaaatcacatatttcttttttttaaaaaaaatagtaggatgattaggccgaatatgtcagttgagccttaggcgtggagaattttaatttggctctgtcaccaccatcaggaattgaagcagggaaatgagagctataaccgttgaataacctctcaaaaaatccctgaattttagctgcatgagcagcttaaatgtgggatcaatattcattaagctcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccgccatggccacccaaacccgccccctcgtctccgtcaaggccctggagggcgacatggccaccgacaacagcagcagcctcgccctcgccgaggtgttccgcgcgccgctccgccccgacgtggtccgcttcgtccacaggctgctctcctgcaacaagcgccagccctacgccgtgtcccgccgcgccggccaccagacctcggcggagtcgtggggcacggggcgcgccgtgtcgcgtatcccccgcgtccccggcggcgggacgcaccgcgccgggcagggagccttcggcaacatgtgccgcggcgggcgcatgttcgcgccgaccaagacatggcgcaagtggcaccgccgcgtcaacgtccacctccgccgcgtcgccgtcgcctccgccctcgccgccacctccgtcccgtccctcgtcctcgcccgcggccaccgcatcgagaccgtccccgagctccccctcgtcatttccgactccgccgagtccatcgagaagacctcccaggccatcaagatcctgaagcaggtcggcgcctacgccgacgccgagaaggccaaggactccgtcggcatccgccccggcaagggtaagatgcgcaaccgccgctacatcaaccgcaagggccccctcatcgtctacggcaccgagggatccaagatcgtcaaggccttccgcaacctccccggcgtggatgtcgccaacgtcgagcgcctcaacctgctcgacctcgcacccggtggtcacctcgggcgcttcgtgatctggaccgagagcgccttcaagaagcttgaggaggtgtatggcaccttcgaggcgccgtcgctgaagaagaaggggttcatcctgccgaggcccaagatggccaatgctgatcttggcaggatcatcaactctgatgaggtgcagtctgtggtgaagccgctcaacaaggaggtcaagcgcagggagaagaggaagaacccgctcaagaatgtcgccgctgtgctcaagctcaacccctacttcggcactgcacgcaagatggccacccttgctgaggctgcccgcatcaaggccaggaaggagaagcttgactccaagaggaccaagcttagcccggtataacttactctcctctcaattttgttgattcagttattataaaatgatgactaggttgtagaataatccgattagctatgtagatctatagttgactctcatggtaacaagaacaaccatttggatgcttgtctaatgtgttagctggtactgctttggatgatctatttgtttagatgacattctagtttacttagttagcctgcacttgctgtttgtgctgctatgttgcttcatgggctgttaatttgttagtattgctcggaattgatactacctggtgttaattcttgctgttattaggtacattcgtttctatattcatgcttctaatgtgccattttctccatgtttagttgagtagtattttgttctatgatctctctggtaagccaaggttgtattacttgttataagttattgacctcattgttgtagctcagtgtctgtcttatttctacattgtgttcctagaagcctttgaatgtgttaattgattcatgataacatacagttgtgcaaggtcatttagttatttttcttaaattatgtctctatgcattcaagtttaggtttcatgtaatgttaatattctagattggctccttgtccttggtgaaatggtggctgagttcttggcattagaaggtcatttatttggctgtgttttatatttatcatagcatgtgtggtttgttgttgacttgtcgtagctgtttatttacactgatcttaggttctactatcattttttgtctggtttattctgccattgatatttcatttgctgtattgcccttagtgtttttagtgggatacttgtttagtcctcaaccatttggagacttcaatctcttggtgccttttgttctaactgaaaattcctgttgattcattgtaggaggaggctgctaaggttaaggctgcaggaaaggcatggtacaagaccatgatctcagacagtgactatgctgagttcgacaacttctcgaagtggctcggagtgacgcagtgagcgttgtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagctatctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgtcatcaaaagcattctctccctcctactctcccctcgtctactactacttcacctcgcaatctccgcccaaatccaacgcctcgtctgaacacaaaaccccgtaaaaa

SEQ ID NO: 64542 - DNA, 16482 bp, Oryza sativa
tccctctcgacgccggtggctcgctcgcagtcgcagctcaccagccgccgcccaggtcgccgccgcgccgccgctcgctcgtagctccgcacgtgcgtcgctgcgccaccggccggccaccgtcgttgcggtgggggagagggagggaggcggagagacaggaagcggcggcggcggcggcggcggcgatgaggatcgaggaggtgcagtcgacgacgaagaagcagaggatcgcgacgcacacccacataaagggcctcggcctcgacgtgcgtccccgcgcttctcctgctcctccgctctctcccccaccttgctgctgctgctgctgctgctgcagtggggaaaggtttttctcctagggttttagagaaaattttctcatggcttggcttggtttggtggtctcgagcaggcgaatggggcggcgatagggttggcggcggggttcgtggggcagggggcggcgagggaggctgccgggctggtggtcgacatgattcgccagaagaagatggccgggcgcgcgctgcttctcgccggcccgcccgccaccggcaagacggctctcgctctcggcatctcccaggagctcggtagtaaggttggttggtgcctccactccctcattctcctctcgaacaccctttgagcactgctctagatgatttgtacactctgctgtaaataaatttggaggttagattttaggcttcataatgaacaagccatgttattagcaacatatgctcaccgtaagcttgtacaaagtgttttgccttttggggatttttgctcttccgctcgtcaagaggtcgatgcgatggccctcagcgtggtgaaatggtggccgcacaaggttgtgaataccttggttttaagcctcatttcaacaacatattatacatgtgtgtgttcaagcctcacttctacatagaggggttatgtttcctgcctttcataccatagacttagtttaagaggtcttacttctatttcatagttctctttactgaagattgaatggagttaaagcatgtggccaataaaaactgatgaatcgtgtttaagtgcaataagggcaccgtggacaattgttcataataagccatttctttgtaagtttgaatcctttttgttcattagctagtgtaaacaagtaattctacatttataagggctcatctagctccagaaaggcattcatattgagcttctggtatttgagaacctatgccttattattttttagttcaactgttgggaggatggttggattaaatttcagattcacctaactaaattgctattctaaagaaatggtcgacttagcatgtttttttctatgtttttggctttcaacatttcttttaggcttggattctgttgcttgctggttcaatatatttgtttcccttccttgaaaataattctgctaatggtggatcactggaatttgatgtcaatttattagatacctgtacatttttttactttatacctcacaatctatatgagaaattctttgtgttaactataagatttttcgttcaatgtcttacatctgcttcatttttggtaaaacttccaatgtttcattcatgttgatggagaatatcttatgtgttatcttattattttactatacaggtccctttctgtcctatggtaggatcagaagtgtattcctcagaggtcaagaaaactgaggtgctaatggagaatttccgtagagctataggtttgcgtataaaagaaaataaagaggtctacgaaggagaggtaagcacaccatatatgctaatttttaagtttgcactaagatattgttcttgaatttgtgcattatttcattttctcttgatattagcacatttataactgatatgatattctcactgtctgtttctaaaataatatatatttgtgcttcattgccttttaggttactgaactttccccagaagaggctgagagtacaacaggtggatatggaaaaagcattagccatgtaatcataggtctgaagactgtaaaagggactaagcaactgaagctagatcctacaatttatgatgctttaataaaggaaaaggtatcctgctcctcgccctcctatcttgtgctggatattttagaatacactaagtgcattttttgaaattttagtaatagttggatgattgttcatttcttattcagaagaatgtcttgttgtgaatatttaatctataaagtaaactttggagaatgttaattgtaaaaaaaaaattgcatgattggaaattcataacttgtcatcgtgaagctgattagatgccttgatactgagattcacttctgttacttccattttttgcactagttgtttcattacatcagtgatacatgggatgcaggtgtcagtgggtgatgttatatacattgaagctaatagtggtgcggtcaaaagagttggtagatgtgatgcttttgctacagaatacgatcttgaagctgaggagtatgttccaatccccaaaggggaggtccataagaagaaggaaatagtgcaggtaatttggtgaattttagcctaaaagatttttgcacaggcaagtcttttttgcattgtactatctatgaatttatgttggtgataattaaagaaatgaatggatcgtgttttacaaatttgaagtatagtgtcaaatattcatgccttgaagattgaaagtagagctgtcagctatgggacattttgttaccatcacaccttgtctgaatagatatggattaccagattagaaccaactctttcaggcctgtaggtgatattgaactaaccgccctaccaaagccaaaaggattggtcttaatcccttttctatccacatttgtaaatacacctcccttgataaatggtttatacagttcacaaatcaaacactactaaataataaattcatgaccatcagtctacattattataacccttggagttcattatgtttgattaattaggtcccactggaagatttgtcctttttatcttctattttatccctcaactgttatattcctgtctaccggcataaaaaaatgggttcccttatacagcattagtgtgttatatacaggctctctgtttatgattctcaagttatatggatgttagttaaagagctgaaacttcagttatcaattttgtacaggatgttacgcttcatgaccttgatgctgcaaatgctcaaccacaaggaggccaagatattttgtcccttatgggacagatgatgaagccacggaaaactgaaatcactgagaagctacgacaagaaatcaataaggtattcaaatttcccatgtagcagcactgctgcttttaaaagtggaccacatttaataaacatgtcaggattggcatatgatctttaacatctatactgtatgttgctaggtggttaacagatatattgatgaaggaattgctgagcttgtacctggtgttctgttcattgacgaggtatcttattatttcatccttacgaattatgattggaaattttctcagtggctcattttggagtcagaaggtataaatacaaatgagggtgtgtttgtctgttgtcaaacatacagtgggttgtccttgtggggcagtgccatactgccatgctatttctctactatatggtataaatcttgatgtggtttgatttagttacttgtgaggaactttaatcgcaggtccacatgttagacattgaatgcttctcttatcttaatcgtgctttggagagcccattatcaccaattgtgatacttgctacgaacagaggaatatgtaacgtaaggtaaacagtttgatttaccagtcgaagcactctgcgctacattataataccagactaatcatgtgtttgtcagtttgtttattaccatatgctccttaaagtttacaaagtcttgttatgcttgtgtccagaggaactgatatgacaagtccacatggtataccagttgatcttctagacagattggtgattattcgaacagaaacatatggtcccactgagatgatccaggtttgattttggatcttatatcacttaggctttcctgtttagaaatgtgtttgatctttgctcattgtcctctacagatacttgctattagagcgcaggtggaagagattgacattgatgaagaaagtctcgcatttttaggagagattggacaacagacatctttgaggtacgattcttggttgttacaccgacaggtttgagaaagagagttaagatggaaattatgcagtagggagttatgttaagtggactgatcttatttcccactttcggtgttctataagcattttaaattttgtagttttagttttataaccaccaagctcatcttactgaggcagctagcgaagatgaacgattgtaacacatgttgaatctcatgtaggcatgctattcagttgctatcacccgccagtgtagttgcaaaggctaatgggagagagaagatcagcaaggtatgtgttgaaattccagcaggatattgtaacgtcctcttgttgtcttttttgccgtatgggctatggctggctgctacattcacttgttagcctgatattgttcttgcaagttttatgtatgctgaacccatgaccttgtttttaatcaggccgatcttgaggaagtcagtgctctgtatttggacgctaaatcatcggctcgtctccttcaggagcagcaaggaagatacattacttaaatttctcttgcagtatgacgataaactcgagaatttgtccctattcatgctgtacacaggtgcgaagactctttcaggagcacacttgattgatttttgcagaaatgtagaaactgaacaatgtacccctgcactgtaggcagcctctagagaatagcagcattttcgaagtattgcttgttcaaactactgtttgctgagtagatctcctatggaattatcgtgtttcttaattgtccatgctaaccagtagtttgatactgttttatctaatgagcattttcatgtcggttcttgatcattcagttcatatagagggaaatgctctcaaacttgaattgtgaggagacgctgcatatttatcaaatatcaatacccagaatagcgtcatgccctctggtactacctatcttgatcacggctagctacacagtggtttcacttattcatgacattttctaagtaatatgattatgtagcatcagagttgtatcacaagatttataatagagtggagtctactaatgttttgtatttaagccaataatggtcgttgtttctaaacagaaataacgatcgaaattcaaattattgttttgtgcaaattattggtcgtggtggtaatacgattttaccgagctatcgttgatagaacaaatgaacaatcaactatcgtacgtggtgtccagcgacgtggagtgaggctgggtcagtcacgccgcatcgggctattttattttttttgccagttcttgtacttcatagactagtcatttcgattggaatgactatgaagttgggggcaaatctacctaaaagtttgcttaagatttgacacaactattcttttttaaaaaaaaattgttcaaactgaccatataaacgtacacactataattaacatctatcactaaatacaagtatatgtgctaagtttagaacttaaactaaattagagtggatagatttaaaaaaaaagaacatagcccattgagctacgctcgcttcgcgacacaaccaaaattatgacgtgctttaaaccaaaatgagtttgaagatctcatttctatccatcatctttaaagaaacaaaattatgacaagcttcaaaccaaaactgcccatagagcctagcttgggtgattggggtcattgctcattggatactcaacgtggacatcgaggccaccgtgaagaggtcaggcagccccccggcgtggctagttagcagcctccatctccatggccaacaaagtggcagcattttcagcatgcaagaacgacaattcgagatgagacgggaaaacagcaatgttagtgaccgtttggcgttttgttccatcatttttttctttagctgccctgttcgtttcttctagaagcataggataaaattttagatactcgtggcacgtttttcaaactactaaacggtgtatttcgtctgaaaactttctatataaaagtttctctgaaatatcagattattccatttttcaagtttataataattaaaactcaattaatcacacgttattaccacctcattttacgtgaaacatttaatatttatctttatattcatcttcaggagattcaaataccagccgtgcatgctactaacttgattatgataacctaagctactagggtgtaaaactggggtctctttataacgatggaatgttatatatgagatcttttactgtttttcaatttaagtgtctaaaactcttgtaaaagtttttttgttgctcctttcacccaaaagtcttaaagcttatttattttctgaaaagaaaatgagatatgcatatttgtagtctccatatgcatataagatttgaatgaagtgctaaattagcatcttaacactggttgcatgaatgcatattttttttctttgttatatatagaatgagttaattttttatttggtcttggtgaaacaagaaatatgctataaacttttggttggagggagtataaacaagtcatcttatttatacttctataaagttacaacccactaactgtaaagcttaacatacaaccatgctatatcatcacccactagcaataattatatattcaacctcgtgaaaacatgcaacatcatttataatctatttaattctacaaatcaacatgcaaacatatccaataatcacacatcacatcattttcacaatatttttacaaatctatctaccattttataatatttaacataaacttatcaatatgttacacattaaagtgtgggtttcatttgtctgtttcatgataaatactgataagccctgatatttcatttgttttctttttgcccctagcttgattgtaacgaaaaaatatatattaaaaattacttagtaattcccacagcaaagcgtggggaatcaccttgtatataattagactaattaatcacagggctttgctgcattacacatagttatatatatacaaccagccggatatatatatatatatatatatatatatatatatatatatatatatatatatatatatatatatatatatatatatgttacacattaaagtgtgggtttcatttgtctgtttcatgataaatattgataagccctgatatttcatttgttttctttttgcccctagcttgattgtaacgaaaaaatatatattaaaaattacttagtaattcccacagcaaagcgtggggaatcaccttgtatataattagactaattaatcgcagggctttgctgctttacacatagtgtaaaccaaccggatatatatatgcagcctttttaaatcaggaacttagcctattaagcaggaaacttagccttcaaataacccaatctataacccaatctgaaattcgctcctatggagctttgaactcaggatcttatggtgctactcaggtcactgcaaccactagactatatgccctttcatgagcgtaacatcttataactgactaactacagtctaccttctttatttccattttttcatgaaacttatagcgtttagataaaaattaatttcttggagccatagaaggtttgaatttttttttaaagaaaaaggtccatggaagtattgtgctctagaagaaaacgaaggcaaagatgcaagcctaagtagtgtcatttgaaatttgtttatcttagctgttagtttgcagaaaaaaaatttgaaaatatactgttcatcgttttctttttcaaaaatataccggatggcgaatcatttgcacaaatataccatcggtattgcaggatggaagagcgataccgaggttcgcaacgggaaagtgcgatagcgccacgatatcgctctatcaatcagcgagggtgcatttgagttggcggtatcgtgtgtgggaaaagcgagatcgttgcggtatcgctctttcgtagagcgagagcgccacgtggaaaaactgacccgttctggcgatttgggagggtagtatggcgggtgggcccaacggtctcatagtttcgcagcgcgagaccgagagagttttgggatccacgttgtcgcattaccgggacacagagggaggtgggtgggcctgcggtatcacacgcgtagagcgcgataccgtatcagtgttgcactcccgatgcgcgagaccgaggagcacggagattggagagtgggcccgcggtatcgcacactcaaagtgcgaaaacatcgttggtatcactctttcaaagcacgttaccggctttagttgtgggtcttgcgaattttttttgttggtgctaaggatggctacggtatcgctatttggaagtgcgagaccgacgccaccaacacctccactcatgctcttatatctcgaggacaacaccggcctcacctgaaccatgcaatcacacctttttttttgagtaacatgaccactctttccctctactatttccatctctttctttttgcacagggtgaaatacctctgtgcactcttttatcattttcgttagtgccgtcatttcatgtcggccaccattactcagctcgtaataaccactctcttcatacaaatccaatgttgccgttttataaaaggaaaggagaggagatggtcctcactaacaatactgagtagtagagaaagagaaagaacggagtgcattgaggaggagaggaagccgcataagagaggaggcagtggagagaagaaaataattgcacgtaagcagtcagacgcgccgaaagtgtcctcgtctctttctaaatatgcatattttctctgaacaacccattaataattgagatggtgcgcacttctctctctctatatatatatatccactagagttcaaatcatagtgtccatagatatggttaccactgcatgtggttccccctatgtgatatggatctgtgctgaacatccaaatttctcaccaatttttgtaagagttctaaaattttaatcccttctcaaattccaaggtagtacaccaagcactataagcttgctacttgctacaatgtatacacacacaaacacaaccctagctagctacccagtatatacatactgtacttgtacacagcttaattaatttaattgaattgattaattagacgttgacgaagggcgagccggtgaggaactcggtgaaggcgagggcgacgaggccgagcatggcgaagcggccgttccagagctcggcgtcggcgctcatcacgccgccgctcctcgcctccgcgctctcgccgcggagcagcggcaccagcgacgccgcggagagcacggtggcggtggcggcgaaccacgcgagcccgtccccgctgccggcctgctccaggagcccgccgccccgcgacgcctccacggcgagcgccgacacgaaccccaccatcgccagccgcccgttgatccgctccggcgccggcccgctgaacgccagcacgtcccacagccccgtgctcgccgccggcttcgccctgggcgccgccgccgcggggctcggagtcggtgacgacgacgtagccgtctcctccttcgtcggctccacctccggctgcagatcgaacgacgacgtcgccccaagttagcacgcgaagcaaatcaccagagaacacgcacagtgaaaccaatcaagaacgctcagctcacctcggcctgggccctgacgacgagcgcaacacgccggcgaggcgggaagcgtaccgcggcgcgccatggcgcgccaccagcggcggctgcgacggcggcgaaggagctgctcagcgccatggtagcggccgccattgctaacaactcaaactgtcaaacaccgctagtgaggacaagcaaagaactcaggcgagcaaagctagaatgctagatcactctttctgctgctgatgatgatgcgggtgacgagacgagtataaataggcgggggatcatcgaggaggacggcgaggtggggagtggcggcggcggcggccacgtcggcgggggagggggaggcggcgacgtggagggcgagggggtcagaggttgcgcgtggctgtcgacgtggacgtccagggcaccgtgcgtcgtcggggtggggttcccgccaaaaaagggctcaggaagaatccagatggcgtgcgccagtagtcgcgggaatcagtatttttttttctgatttgctaaccgcctgtcgatagaaattgtatcctcaaatcttgcagattttggacaaccagatgagctttgagattcgtgctccaggtcttctccaactccggcgaccttctcttcttctccggcactagtgacaccctacgggttagggtcccggagtggggtgggggtgggagggggagggaaggggaggagttcgccggcttagagggatggccaggggaggcggtagcctggcggtgggtggcgggtcgggcgggcggcgaggcgtcggagccacggggagaggaagccacagaagataggaggcagtggataaaagaaataaattacacgtaagttgattagtaaaaatttgtagggtgaaggatttagaaaatattagttcatgtggtttatattagtgatagtaaatatttgttattaattatgtcggagaaaattagaggtatatattagtttttacattatatttttatacgtcgcatgcaaaaatagtaacataggaagttaataaatataaaatatttataatgtagtatattattattaagtaggataatggtaatggaggtagtttgtgtgctatgacttagagtcgatttaggtttaaaaaatagatagacataattaatttatatggtaaaaaatttaattaatgttataattaatttgtagtgattttaagttgcaatttattagttgttcatgcgatgttttatttttatatagatggccaatattatatctaacaaatgaaaaaaaaggctgaaataatggtagttttatttgtagtacacatacataagatttcatatagtaacggtgaaatatggtgtggttaaacatatgcttaccaacatatgtagttacgaacatatgtagttacgaaggaacaagcatgaatggagtgtactgaggaggaggacagagactagcaagagtggaggctacagaagagaggaggcagtggagagaagaaaacaattgcatgtaagcagtcagaactgtcgaaagtgtacttatctctttctaattatgcatattttctctgtacaaacctattaataattgagacgatgtacacttctttttatatatccaccggagtttaaattatagtgtccataaatatggttgtggttccctctatgtgatatggatctgcgtcgaacatccaaatttctcaagaatttttgcaagagttccaaattttgaatcccttctcaaattccaaggtagtacaccaagcactatcaagcttgctacttgctacagtgtatacacacacacaacccggcctagctagctacccagtacatacgcaagtacatgaatgtattgtacgtacacgtgtacagtgcagcttaattaatttaatttaatttaattgattaattagacgttgacgagcggcgagccggtgaggaactcggtgaaggcgagcgcgacgaggccgagcatggcgaagcggccgttccagagctcagcgtcggcgctcatcacgccgccgctcctcgcctccgcgctctcgccgcggagcagcggcaccagcgacgccgcggagagcacggcggcggtggcggcgaaccacgcgagcccgcccccgctgccggcctgctccaggagcccgccgccgcgcgacgcctccacggcgagcgccgacacgaaccccaccatcgccagccgcccgttgatccgctccggcgccggcccgctgaacgccagcacgtcccacagccccgtgctcgccgccggcttcgccctgggcgccgccgccgcggggctcggagtcggagtcggtgacgacgacgtcgccgcctcctccttcgtcggctccacctccggctgcagatcgccccaagttagcacacgaagcaaatcaccagaacacacacagtgaaaccaatcaagaacgctcagctcacctcggcctgggccctgacgacgagcgcggcagcacgacggcgaggcgggaagccaaccgcggcgcggccggcggcgacgacaccacgccatggcgcgctaccagcggcggcggcggcgaaggaggagctcagcgccatggtagcaaccgccattgttgctaataataactcaaattacacagcagatgaacgcggagacgcgcgcgaaacgatcgatctggagaagcaaagaactcaggcgagctagctagatcactctttctgctgctgctgttgctgctgctgctgatgatgatggtgcgggtggcgagacgagtataataggcggggggatcatcgaggaggaggtcacgggggcgcgcggcgaggcggggagtggtggtggcggcggcagcggccacgtcggcggggggagtgggaggcggcgacgtggagggcgagggggtcagaggttgcgggtggcggtcgacgtggacgtccagggcaccgtgcatcgtcggggtgtggggtgggcttcccgccaaaaagggctgaggaagaatccagaaggcgcgcgccagtagtcgcgggaaagggtggcggtttgtgggcccacgtgtcagtgattggtgatatgtggttgtgaacttgtgatcaaatttgtgctgattgtaaaatttatatttctttcgtctcagaggataatgagacttctagggcttttttatggaggttaaggttctattaattggcacaactccaaatcccatatacatattacatttaaattttttatgttgaattatattgttataaaattttatatttcatctaaaataggaacaaaacaatccatttaaatgttatcaacaaattcgcatatccaaattcatggattttgtagctaggaatactcagctttacaaaatctagcatccggagtcgtggcaaacatggcctaggaagagatatataattgaactactgaagtttgtgattgtttgacatgagggagtagatgccaaagttattgtgtttgggaacaaatattgaactgttatattttggagcggaagcaatacaatttctttaaaaatatgaatattttatagtgacaattttgaactgttatggattcactttgaaatatgaatgtattggtatagtctttaagttcgaaatctctttttagtttgactaattgccgatcaaaatctgaaaagtttaaacctatttaaatcaaagttcagtaccatatatatgcacctcatggaaactatactctcttttctcatgcaattcaaagcacttctgcaatcagattaagatcagatgtcattacgagaagtacagattaatattagatatcattacaacattgcacacactaagcacgactacaaatacaggcagaccatctgacaacacggaacagaacatttgtggatcatcaacacctttactcattttacatgactggcaggctatatggcctaacaacgaacaaatcactacggtcagtaacacagggagggaggcatgccagtagcaagcagaaattcaactaaaattcagttaaattcacatggcgaaagctgacagcaatgtggtataatttgaatgaaattagctattccccagccgttgggccatttgagttgaggtaacccatcttctccgacaacacattcatgtcgtcctcgacgaccgggttgtcgttctcctcaccaacaagcccttcgttcagcagctcctcccagaaattgtcgttcaactccccctggggcccgatctgctgctgttcggaggcgccgacatcgaaatcctgtggctccaccagacctccagcatccatagctgagttttcaagatcggagggaatcccatcgatgaggaattccaccgactcctggggatcaaacaaggccggtgactcttgctctatgctactgctagtgccgacgtcgtcaacttcaggtccctgatctatgcgacgccttcttttctttgaaatggcatcttggagctcctttctcatctcattctgggacataagttgttttaagaactcaggatttttcatgacacgcgccaagaatgccatcatctgctgttgcctctgctcggttccttgcagcctatcctccatggctttcagatttgcctttgtattctgctgctcctgccttagcttcaccacctcagccatcaataattgcttgtctctcttcagccggtctatctcagcatcatatccaaagtggcccacctcaaggtatggcccaagggattgctggtttgaagcagtatgggaaggtggttttctacgcttgatgttcttgagaagatgtctctgtccccgcagaaaattctcatttgcaaattcccaccgatcaggatccacctttctgaaaccctgaaaacaaacaaacaattcttcagggaaatgttagttgcaagagacatcttagacaagtatgcaacaggatgctacttctttcttggtagggggagaattacacactaatacttctctctcacttttttttttttgcttttttgttaagatcacaagttgcagcagtaccaacaaagatgaagctacaagaagtatcttttgtgtacctttctggaatgcgtttcagttcaatttgcaaggtttcagtttgtgcagttttcagttctttctgcactaaattcatcaagtttctccttcaatcttcatcgatttcataagttggggcaaattacaaattcagtcatctgttgccccattccagagggcacaagttaactatcaactctagcataagaattgaggatatttattaaaaaacataaacatattgatcttatttacactatttaaaaatagcccaacgtgatgcttatatgaagttcaagtagttgacggtgacgcatagcataaaagatgttggtacacaaccgtaacatgcccaaaaaaaaggttcaaaggatggggacaccaggcacagcatgaaaatggatctccattactttgggaaatggagtccagatatgaagacctgaaatacagtactacagcacatgcaggtagggcaatgctgcatccatccaaacaaacatcgaatcatttcccctgagcgacttttgtttctgttaacagcctttttcttacaattatgacagtggcccaacaaaaatgagaaaagtccaaattttcagatctaggacaactgccattcaactatcatttgtccatacgttgcttgttattccacagaagtatgtcaaatctaggatttctttgtgcttttaaaaacaaaaactctaaatagatgtttatatgcgcttgtgtaagttagttcgcttctctgatgaaatatcatgagacatagtaagtgtttcccagagattaaatatccttatcaccaaaaaagatctgagatccctactattcaaccataacaactgaaaagaacccggcaaccttaaatgcctaactaatttcctctgttaaactttgaatgaccacaaatgacaattcaatttggatggttacaccaacttattactccacaacatatagtttatactgcaattgtgggggttgttccaacaaccaagaacaagaacaatttcagctacattcatcggcgctagcggcgaaacatcaagaactgaaccaggttgcaaacaagtgcattgcaggacaaaatatagagggagggggagggagctgtggctatgggcttacataggtgttgagctgcctgacgaagctggagaagttgttgtgcttgaagaacctggggagcaagacggtggcgaaggcgtggggatcccacaccacgaagctgttgctcgtcgcgctccacgacacggcggcgtcggtgccggcgtcgtccaccatgtcgtacgtcttggtcaggaacggcggcggcccggcgtcgtgcagcccctccatcggcctcggcgccacccccgccgccaccgccgccgccccatcctctcccgccaccacctccaaccctcctccgtcccgtggctctcctcctccttcaccgcattcagcattggatcatccatagctcagaaggcccaaaaccccggtacagtacactgaacctccttgtccggctccgacgccggcaatggcgacggcgaggcaccctggggctgcagg

SEQ ID NO: 64543 - DNA, 809 bp, Oryza sativa
  unsure (1)..(809): unsure at all n locations
catggattttgtgtgacagccntttgcanannncnnnnnnnnnntnggnnaaaananncccctcttacacggnccancctttctatatcaattngtcacctgccttttttatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctccttcgcgcgccttcatagccgccccgcaccctcccatcgcctctcctccgcgctgcccctccaccagcaggcggggcggtccatcgacgccccgcgccctcccctcgcctattctacgagccgcccctccaccagcagccatattcacaccgcgccggcgcccctttccttttcacccgcgccgccgccgcccctagcctacccaccgtgcctttacccctagccggagaggcgccgccccttcaccttcaccagaagccgtgcccacaccgcgccggagacccttggcttcccaccgtgccttcacccctagccggagaggccgccgcccttcaccttcacagaagccgtcccacaccgtgccggtaccctcggttttcacccgg

SEQ ID NO: 64544 - DNA, 830 bp, Oryza sativa
tccaggttcttatctgggtccatgctcctgaattggtttaggcatctttttctctctctctgcgattatgaaattttaggagttggatgttgatttttcaatatatgaacaggagattttttttgtttggtcgtgttaagagaagtcgtaatctaggtaggtctctagtgctaattatagcaaaaggaagagatgtctttctctccagagtttaggtttcgttcaaaaattttgcgccgtattttgattgacaaggagagatgagatctgtgcagtatgtcaatcagtcaagactaatccagatgctgttcatgtcttgttcttgatctggtcataaccttgcactttcagtttctgtgatgcttcaattgtcaaaaccagcgtgttttagcactgttccaccatggcagttgttctccaacgcagctaaaaaaaagtcaattctttagtattatattgcagatatgtttgtctaccatttcagtctaataataataaatactactcgatttgtctctgtccattgaaccaaaacatattctatgaccaataattgacaatacaatactgcctgttgctaacccagttcagtttatctttcaggaatcttgagaagcctatgcaattgctggttcttcatcaaccttcgcaagttttttggttccgtttgtagatattagctaaccatagatcaattatagtttagccatcttataaacaagctgttgtgagaatttgacttcagatgggccaaggagttgcggctattcctggccttgggtctctcggaggcgtctcctgcgacaaattccttttctcctttgcgaaat

SEQ ID NO: 64545 - DNA, 8032 bp, Oryza sativa
acaactgtctgatatgagccaaagccctgatttgtgttcaaccccagtgtcctctgataagcacaagtctctaaaggatagctcatggactaggagatattttgataatggtggaaggaggagggttagtgcagtggacgctactgaagttcggaggaaccgcggggttagtatggctcaggcagttcaaactacagttgattggacacttgatccatctaagctgctcgtggggcataagtttgcatctggggcatatagccggctctacaaaggactctatgatgataaaccagttgccattaaatttattcggcaacctgatgatgacgacaatgggaagatggctgcaaaacttgaaaaacagtataacagtgaggtcaatgctctatctcacctctatcacaagaatgtgatcaaggtaacaaataaccgcttttcatcttgcatcttgcattattctgccataatcaccatataaatctatggaagtgtgttcttagattttacttgagttacttctaatgaccatgaagtctggtattgtgatcagattaaattaatactgtagcctttatttcataaaaaagaacacttaggataatccacaaactctgtcagacatttcagcttatgttctcttctcttaaggtatttgatcttatttgattaacactgttctataaaattcccaggatattcattcactttatatggttggcttgattgattgacattagctgatcactgaataatctctgaaatactcaatttttatgattttgctaatggcaaaccttctctgatcttatttatgtaatgcagctagtagcagcctataaatgcccaccagttttttacataattactgagttcctccctggaggttccctgaggtcatatctaaatagcacagagcatcaccccatccctctggagaagatcatatccattgctctcgatgttgcctgtgggttggagtacattcactctcaaggggtcgtgcaccgtgacattaagccagagaacattctctttgatgagaacttctgtgtaaagattgctgattttgggattgcctgtgaggagtcaatgtgtgatgtgctggtggaagacgaaggcacttaccggtggatggcccccgagatgatcaagcgtaaggcatacaaccggaaggtcgacgtctatagctttggactactcctatgggaaatgatctctggaagaattcctttcgatgacttaacccctctccaggcggcttatgctgttgcaactagggtaatggtttctttctcaatttgagtatacctcctaagagtaattttgttgctccgcagatgtccaaaaacttatgcctcctttttctctccgtgtttaatttttcagcatgcgcgaccagtaattcctccagaatgtccaatggctctgagaccgttgatcgaacagtgttgctcattgcagcccgaaaagaggcctgatttctggcagattgttaaaatcctggaggaatttcattctgttctctcccaaggtggctgcctcgactcactgaagagcagcaacagccaggatcagaaaaagcgacttctgcattggattcaaaagctgaaaccctcacatagcacctgagttcctgtagtctctagcatcctttctgccagatgtttttatccggttctgtatgctcagtagcttagcataagattttcatttttgttcagaaaaggtgaacctgtgttctaggatgcttggacatgtttatcaggtgaattgcaagtaggtttacagtacctgtatattgtgctacccttctgctctcttctctgtttttgtgaaatttagtagcagatcattcacatgcaggtgtctctaattataaaaaaggtagcattattggcctagatatatcgtaatcactcatttatattaagattttaaggcaaacctatgcagggttgactccaggccgtcagaacaggaaaatggcattcgttaatacaattattgtatcttatattatggagtcatcgtaattatgatgcgactttgagaaagcaacatctctgcttgcttgaagtctgctttatccttgtgctgtttttttcttgaaagatggatgtcagtttctgggagtttttttgttccgtagcagcatctttagctgaaaacttggttaaagtatgggctctccaaaattcgccatatgtgggagaagttggttttttttttcttttgaaaagttgggttgaattttgagtgtatatgaagccttttctcttcagatctccatcagtagtttgctgaatgtatgcgtatcttgtaagctctaccctgaaagtctgaagttctgaaacattcagatcactgtaaagctttactccgaatttttcttcttgacgaatctttctattgttcttggcaaagcagcacgactgcaatgaaatgagtgaacaaaatgccgcgtagtttagcacactaattacaggttcaaaaactctgaaattgagtatagagcattttcggcggagcaaaaactgcgcactgtcaccatcgaaaaactgtagcagttcagcactaatttcagcagttcttcaggcagcagcatcaccatcagaaaaagagcagacaactgagatagcagcacataggggggccacattgaaccgtttcgatctcgcgtagctgtaagcatgtaactgatgcaacaacatgtttaattagcagacaaagcaacatttttcccccatcttgtcgacgtcagaatgacagaatggacggtgcttagtactacgaaatgcaacatttttccagcttgcgaacgtcaagagtttgtgtgttggtgtgaactgtaagcaagaaccacagaaaacaccttgtcctttcgagatgggataatgaaaatggattacagttaattagtactagcaagtactatatacttatctctctctttctctctctatctctatacatatatatgcttttaagttttaacttgatgaatttgtacaaacctgcaagtaaatcagtagggtaaaaaaaaagaagaaaaaagaagcgaattacacgatgcagattaagattaaccagtgagtgatttatctcactcgatcactctcgcagctaagctaagctagcttagctacttgcactggctgttgacgaaggcctccgacctgacgatcctgtccatgagcttgtccagccgcgcggcgccggggcccggccggagcacccagtcgtcgccgacctcgtcgcacccgccgccggcgccgacgcaccacccgccccggacgaacatgtcgccttcggcgcccgccgtgccattgccattggcgcggccgcggccgccgagcaggtcggcgtcgatggcgtcgagcacggggtcgtcgcgggggaacttgcgggcgaagggggcgccgctgcgctccatggcggggcggtcggcgagggcgagcgggtgcgggtgctggcgcggcggcgtgtcccactggatgtggtggaggtcgtggttcgccgccgtgggcacgaaccgcggcgcgttgcagagcacggtctggaagtagccctccggcgaggagacgaagttggcgtagtacatgagcagcgtccgcggcaggttgtcccacccccacaccacgtattcggcgaaatccctgctcagcgccacccacgccgaccccgtgaacagcttgaacgccgtcggcagctcccgccgctgctccacgtagaagatgtcctgcttccgcgccatgtacagccccgggtccacgatcaccggcctcgccctctgccccctacattgccatccagcctcgttcgtcagaacgaagctgtaatataataaactaactagtttaccaaacctcaaaaggtgtagtaagtacttactccttccatcctagatagccggtgtgctcgatgaagttggtgttcctcgggatcgaggacaacacgtggaggatatctgatggatgaatggttttagcacacgaagtcgtgaagctcacatgtcagtgactcaaagttagggggacggtcgtcgtaccgtcttgggtcatgagagggtagtcggaggcggagaggttgatgaaccagtcccagtcgcggctgcgtcggaggaggacggcgcaggcgtggagggtgttggcgaccatggtggggccgcggtaggtcaccatgttggagcggcggatcacctccacgttgccgactcgccggaacatggagctgttcgccacgcgcgccgccagctcgagccgctccgacacggcggcctcccggtcgaggtggacgacgtagaggtttcgcgggtggtagagcgcgtggagcgtccgccatagccggtcgaggtcgcccttggagccggacaccaggtaggccagcctcgccacgccggcgcctggcggcggcgacggcggcggcagcggcagcggctgcttggcggcggggaagaaggcggggagcgacgccgcgacggagagcgacgaggtggcgaccgccagcgtgacggcgaggaagaggaacacgccgaacgccgccggcagcgcccaccggctctccagcagcgccgccgcgccgctcggcaggacggacgacgccgccgccgacggcgacggccagcgcggcgactgcttcgtcggcgtcgacgtcgccagcgcggagtagtccccccgcggcgtcttccccgacgtcggcgagtgatgatcacctcctcctcgacctcctccgccgccgccgcccatggtgctcgccggcatgacacccaccgccgccgcaccacgctacagaattttcatggttcgctctcaccaaaactcttgtaatttatatggaattataagcagccaagaaccaatctctctcaaagaacttgcgaggaatagggagacccgatgtgaccgatttcaaagacgaaaaatcaaaaatcaaaaacaaaataaaaatcagaatatgatcaaaatatcgatcacgaccttaaccaagaaaccgagtggaattaaacgcgatgctgatgcaacggcgaagaccttatcgccaaagagatctgaacacgcactgctcctccttgacccagtagcccgggagatcaatcaatcaaaacaaaaaacaagaagaaaaaaaaaatcaaaaagaacacgacgacctcttcaaaacacgaaatcgaccaaccaaacaaccggaatctgacagggacagatgataatcagatcagatatagaggcagctgcaactccatgcatgtgtcgcaattaataatgctcgatcgatcgagaagaagagagccgagatcgatgagaagaatataagtggggtgtgtaattaatcgatcgatcaagagagagaggtgaggagatcgatcgagcagataacgcgggaaacggttgcgagtttgtggagggatatatatagaacacggcatgtacatcaccaacacgacaggtggcaagatttgcgagacacttcccccggctaacacgggccataacctatccctaataatgtgtatacttaattaattagtatagtaagcagatgagtgcttcttcttcttcttctctcgtcgccgtacgcaaatggcgatgtgcgtgtgtgcatgcaagcgtcgtcacggattggtacactcgagaaagttaattatcatgtgacagcgacggagattgaggagaagtttagagtccatggcccagatgatctgcttgatttctgcagtttccggtattttaatcatcatctctgtgtattatcttagtttatttttacgatatggaagtataaattcgtatttgcaccaacttaaaatatgtactggagttgtataatggaaaacggaacaatgaattaatgtgtgattaattattattagcttaaaaaattaaaaaaaaaataaattaatatgattttttaaagcaacttttttatagaaatttttacaaaacacataccgattagcagtttaaaaaatgtgcgcagtaaacgaccgagtaaagttgggaagttgggaacatggacttgtgaagttgtgagttgtgaacacagcctaacaatcacagcaactgtgttttatccaagctaattaattaattaaatctgatttttgatccggtttgacttgattaagaattgatagagagagataattaagctggcagggggacatctctggtaagcatgtcccttgtcaccaaaccctggcacaaatatgtcattttttaagcgataaattaagttgactagggttaatttaaggctttaagcacctgtactgaagggcaaacaacaagaaaacactgaacaaaagcaatcacactactacgtgtttaagaaacggaaattaaagctactcctatcaaacattgatagagcattaatatattaaaggaaaaacgagagtaagaaatcgtcttagagcatgatcaataattcaatatgtagtatgaccaccaccgaagctaggaaattaatgtcacattagactgacacaagaagtctacattttttttgtctagagatttagctaaagaaaaagataggatccggcttcacatacaaaagttgatttattattttataatgaaagaagtactccattcggtcacgaaattagtgatttagtgacgtgttggacagtggcatggtaaccaaaaaattgattattaattactaccaccaataaataaagcacagtcataatattttgaaaccttttttttgaaaaatttaaccatattattttcaaattttgaatcaaaatatttgaagaaaaattgatagtcaaagtttaaacgtgctgactacacgtcctctaaaatatcacttattttttatcgaagggagtaacaaaatcccagaccatgcaatgtgccaatgttcatctcccttctcaagatgacaaatggccggggtctgatcttagattttttcactcacaacggtactcattgagtcattggagggagtaattctagtgtttaggtacaggtacaaaggttaactctctgcgatcccctcttagtagtactgatgaaatgagcacactcgagttgttaacaccaacatttgccaatgaagtcgcataggtataccacctgaagatatatgataatcaagcaaatctaaacgaggacatatctgatatgatacacattggtttaagaaaaagtgcatgacacaaccttcttcatatatactccagtttttaatagataacatcgttaactttcgactatttatcttatcaaaaaattatataaatatattttattttgctatgacttattttatcattaaagaaactttaagaatggtttatatttttttatatttatactaattcttttaataagatagatagtcaaatattatgttaaaaagttaacaacatcatctattaagaaacaaagtttcaaaattttcttttgatgggggctgtttaaaagaatttccctactcgaatttcctcccctgcgcatgtgtttaggcagactttttcatgccccaactagcatatcttgacacttgtgggacccaattttgaattttgttcggtcacacagtactacaactaaacacatgggttcagattcacctaggcattattgtttattgtagctgatgatttgatttcaagttacatgcatatacgtatcctttccatcatgtcttcatcaatcttgtatcatattctaacagtgtttcgatgtaataatcgttaaaaaacaattgttgattctctactccgtagaggctctgtgtggtctgtacgggtcttggctcctaattaacgttgttgcaaatatttcctacatgtaattaagatggctagctgcgttgataacacgatatgtatcgtttaaaacctaatttggtcctaaccctgtgtgggcccatcctgaatccaatgtgtagcggtgcacgtatatgcatatgtttacaatgagtttggcgagtactttctttctattgattataaatatatttttttgatgtttatagaacaatagtttcttaagtccttaatttaaaaaca

SEQ ID NO: 64546 - DNA, 602 bp, Oryza sativa
agcacccgcatgggtcggcacttcatagccacggttttgccatcgcggcccaccctagcaccaagccaacgtcgtcgccgcctaacgcgccaatgtcgtcgcagccatcgtgcacgctataagagcaaggttaatagtatagccaactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggttctatcggtttgatttatcaaatttgaattttcaaacttaattttgatgttaaatttaaaatatttttaacatagttttttttatattggcttaagttgccagaaatatatataca

SEQ ID NO: 64547 - DNA, 4897 bp, Oryza sativa
tatatatatatatatatatatatatatataaaaataagatttttggactataaattatttgtttcgttaaccagtattacggagtacacagcttatacttagataaaatgcttgcatcacttcttgcattttaaaatatactccctccattccataatataagacataactaattattttaaaaaaaatgtttcataatataatatataggcatgtatgaatgcatgcaattaactaccacttctttctcactaaattattattttttgagtcctatatccttaatatttttaattctattaagtgaatgcattatatatatatatatacacgaattatgaggtgataataattactttttggtctttagattaagggtggttgagccttatattttggaatggagagagtagcagcttcttgcattcataatttgttgtaaaatataatttttttcacctatgtataggtttttaacccaccacgttactagctccgtcccagaacgtagcaacctaggatatgctaatgggtctaatctgaaatatgctcgtgtctagattcgtagtcttaagatagatctaatctcatcctaactggctacgttatgggacggagggagtacgttcttccatcgttcaatttccacacctacaggctccatcgccgtcgcaggcccggccacctcatgtaggtcgtgagatcatccagtacgtacgtgccaacgtactctagcttcgtcagcatctggtatgtacaaattttagatggggatgtttttattccgaaaatggaaagtctacggatcgttgggggttgagttaggccgcgtgaggaccgtccgatctgggatctgcggatcaggttacgctgctgcagtcaaacgttgccgtgtgatcatccgtgtcgaatttgtacgagcaaagcactgttgcagctacggtgaatcgtgttgtggtacttttcgaccaatgtttaatcattcattttatttaaaatgtttgtgcaaatataaaaatatttatgtcatgcttaaaggacatttgataatgaatcaagtcacattaaaataaatgataattacatagatttttttgaatacgacgaatggtcaaacgttggacaaaaagtcaacggcgtcatacattaaaatatggaagtagtccgttttaatttctttcaagctccaactgctcctccacttgcatttactctatggagtttgagatgagagcagtaggaagattcatagatattgtttccgtgaaatcttttccaaaattcaaatcctctccaaagatattattatgccttcgtttcgttccaactttgacagagtattaacaatcgactcattacgagtttgacatggtctctaagtagcttgccattagacctggatcatctgcctactataccaagtaactagtgtgttctctctctctctccaacctctgattcgcaaatcatcggtttataatttggaagatgctataacatttttcttatttttttcaatataggcaaccattgttactacaccgtttttatagtatcaagttattgttatgtatgtattgaaactttctagcttctctgccacgcgtattactgtagaagaccaagtccctcatggcatggttgtattcgatatgaggttgggaacccatctcctccgtaaaaaaaacggagcagtctattagcgcatgattaattaaatattagcttttttaaaaaaaaggattaatttgattatttggtttttaagtaacttttgtatagatttttttaaaaaaaacacaccgtttagcagtttgaaaagcatgagcgaaaaaagaagagagagagagagaggggggttggaaaaaggctcaaacgaacagagcataagctatagacacatcggttttccatagcttttctgtacgacctcttgtaggaagaatcgatgcaagctcacccaaaatagggatttcataagtcaatcctatcacaaatgtacaatccctgatgatgtctagcagagaagctagaattaatgaaatggaggaagggctacccgcttaatttattcttctttaaatcaaatttaggttgatgtggttgtcaagattaagctgagaggattcaaatatggtgaaaataaacaaactacagttagaaaaatttagatcaggtttctaggcacccgacctcttctcttgtagctccacccctaatgtctgtgtgattttgttccgggcgcacgtacttttgatgggggagtatgtgcgtcatcaaccttcgatgatgtcttgaaagaaaataaaaactgaagattattaaaagttgtatatataacagttatctacttatcttcgttgaatcacttgctatccaagaaaaatggtggatgaatttgtttaattatatgtcctgcttatcttcaatgtcttaactcttaagagaacgatttcagtcatctttgaccacgtgagctatgatttagtattctcgcctgaattttgtcatttatcaaggcaattatccatatgcaagcttgacacataagccgccttctgaaaggaatcagactctacttttaactttagtctagtacaagttaaacggctgcttaaaaccaagacttggtaaatgttgactttagtcaatcgaagaaaaaccttgcgcaaacagcaactactgaatttagcaatttcgattggtaatatcagaccaaattccattcactctattataatttgaagtatggtgaagcttatacttcttagaagaagactaccaaaaatggtagattttagcacatattttatatatataacattggtaatttcataccaaatttcattcactctattataatttgaagtatggtgaagcttatacctcagaaaaaaaggctaccaaaaatggtaaattttaacagatatttaatatacataatatacatttatgaagtacacataagactacgatttagtctgactcaacatttacattactcgggcacacaatttcagaatcataggactcacaataaccactgaattttgcaaatttgaccgaaaatgaataccctgagtgcaattggaacttgacaagttctgatcatgtttggttccattccacagcctttcctagcaagtactaggcaagatttctcatcaacttggccacatgcaggacgtacattcactgcaaccactgaagttttgcaaatttcactaaaatgaaaccccacgtgcaactcggaacctagttaacaggttttggtcatgtttggtcccattgtacagcatgtcttagcatggagtaagcaagatttctcaataacttggccacatgtagggcgtacgacccactagcgtggggtacactatacaaaaacaaggaaccaagcatgcccaaaacttcgtagatctaattcacacagcatacctagcaatctgaaatatacaattgagctagcatttcagcaaactgaaaccagaacatggagaattgccagcctcatgataatgacatctgtagaacacccaaattgccgctaaattaacaaatggccttcttccctctccttcaaagttttttttcccaattaaaaggcatttcacagctagactttcctgtacataacgtgatatatatcccccggaaatatgggggaaaggaagccaataaaacttctcttgcaaaatcacgtcgatacgaaattacttgctaagcattggccttactgctgcatagctcgatagctggagcggcttgaagggaagaccggggcagcgccaaagtcactgggtcttaggccaaactgatgatgcccatccccggagtgcccatggcctctccttgctcttgacttctcaacccgggttcggcggaagacttcttgaatttggcggtcattttccttcagcatctgatcgacattgcctgaagggcaaattagaggcccagaatggtggatcttgttaccctttgatccatagccctgttcagacaagaaatagtcaattagaaatctagacaggggaacaaagtaaagttatctgacatcaaagctagtgctataatatttttcggtttttccaaatgtgttaatcgtgaactacaaataatgctaggtaaacctcataataacctgctggaactgaatacataatatatgaggaccttggatttgctgaaagaaacttttcaatttgacaactgagatttgcaaaaaaactgccaactatgaattaaatggcataacaaactgttttcatacttttgctacttaggtctggagatacttacaatagctccatccaccctgctactcctgtcatctttctgctgaaatacttgatcatactttccactactactgaaacgctcatttatagattcagacagcctccgttcatgcggaaaggcttcggcttgagtaaccactgttccattgccattatctgaacgaatatttgatcttgttgatacaaccacacggaagtccgatgcgtttgcaacaccagaaagatgaatatcgccattttcactccgtccagcctttgaaggtttattttgattaactagaggcccagaatggaatgttcttgtgtagacacgttgagagtcttgagacgattcagcaggatgagttggcctgggtggctcaatcggaaagccagatgcagagtcttccttgctgggattgaacatctcactcctgctcttggcattgacttggttttgtcttttctgaaattgtacacaaaaataaatatattcatctaaaaaaatagaacaacttggatagcaagattgtagaggaaaaatacacttggaatgtgtgctggctattaaaggcttcatgtacttgtggaaaaaaaggagacaaagcgcacagctt

SEQ ID NO: 64548 - DNA, 9630 bp, Oryza sativa
ttttctcattatgttttgaaggagttgagaagatagtggagaagcgatagatcgtgcatgcacggatagcaagaagcaacagatcgatcgagatgactttgtggatcagaatgcaagactttcagagccgtccctagcttagaaatcttgcagcatttaatttcgttctttgcttaagagagatgacaaaaatgcatgctcgaatgtaaaggatatgtgtttgtttgtttgtttttgttaaatcttatacttggagaattgaggtagtgtttgatctagctatagtgggtaaaggcttgtcaaaaaagttggtcgtgtctgtacaatggggtgtggcatcaagatcatgcctaaaggaaggttatgtgccttttcgcaccttaccaaatgtcacttttggatgtggttatgtgagtggatgggattagacacaatctcttcagattggtaaggggactacgtaactacgttaaatatgtagtttctctttcgatttgaagaatgcggtgaaaatggatgattgagatttatttaggcaatgtaaatgatggcgtatttggttgggggcaatggttaagggtaatagtagtttgagggggtggagactgttaagtctattgtgttggttgaagaatgtgggagttttatttaagagcgtactcccacatttttaatacctggttagggagaggtaattgggagggaatttctttctaagtatgacgagataaatctgagccggacatcatcacttaaaattcaattccccttcatactccccatgattctcatctctattaccaaacaagggattggcagtaaaaatgtaagtcgatcccatgaccaatccctccaactccctcctttaaactcccaatccattcccatctcttgccaaatagccgtgaggaatcgtcaactcctacggtcctacccctactcacaggtattaaaattcaggaagttcatccctcaattctcattcttcaactctgatgtctcttaaccaaatgaagcaattagtattctcttccctctaaactcctaatccctcctaaagactcccccaaccaaacacatgaggggcaaaagtaattcaatccctagggtaaatcttaaaactttgtgcttaaacatcctcctataaggacatacatgaagtttaggatggctgatgttcaggtgtgtacttcatgtgttaggagcggtcgaatttcacgttcgcgattatgttagtacaattattgtatagggggagggggtgatttgaatatagccttttttacaacataccccaaatattcccgaaagacgttgttcaatttctttttcaaacctagctatataagaggtagatccaaaaaggaaactgtgaatcatccaacaaaccttgctatctgaagctagaccaattgacgatctcacaaatcatgggcatgtacgggttgagagtgtgtactactcgttcacggttggcagatgcctatcgcaaacacaatgcaaagagagaattcaaatgcagtgcaaacctttgactatttgagtttgcttccacgctagatcaagctaggatcaaaaacttgctcagctaggattcagccttgcgggggtcagcttaattggaagataaatcaaggctgcctcataatcataagatggaaataccattcaaaaagaaccaaaagcaaacaagttcagaggaaagacacacaccaatagaccaaacattcgtttctgagcacatatttcacaaccttacctgcattagttacactccctcttatcgacatctaccaaaactccgaaccagttttctaacgaaaaagccaacacaatggtcaacttttcttgccaattttccatcacaaaatataaacaatcatatgatggattcaccctgcattaaaaattttgataaactttatccttttttaaaaaaaaaaccatggatatgaaggaagagcttggtatcaataatattaaaaacaaatataagtgcagtctcgagtcgagtgaggatggaaggggcgcttggtagctgccccaccaactgcgtatatttgcgattcatcctacattaagagcatatattatagtaaaacttgatcctaaaggggaaatgatcatggattctagggaggagcttggtatcaataatattaataatttgggatgtcaaaaggaaacatgagtgcactctaaagtcgagcaccagagcacggatggacgagacgcttggccgctgccctgccaactatgcatgtttataattcaccctacgctaagagaacaaattaataaattttgatttgtatgggaaaaaaaaagatatgtgagcgcaatctagagtagagcgcgggcggacgagacgctcaatggttgtccacaccaattgcgcttgtgcaattctcgttgaaatgaaaataaaatgctacatgtatttatgcgctctcgcggagagcatgttatatatagccacttttgattacatttttatgagggaggttgcacaagagtacacgatatatagattaacatgtaaatgggaacagattaaaatgaaacacaaacaaaatgattactcctaattaactaacatatatatattgcccttaattacatcccaacaaacattctagaaaattggcataattcatagcatctgcataagaaaaacctgatgtgtaccgcaactaattagtacatttcccgcaagccggttaattagtacatttattcctttcccaaattaataattaaatacccgtatattgtaaactgactcgtaaaaaacaaatgttctatttttcttttaatccattgaaccagttttagcttttttttgatgggcctattgaatcagtttgttaaaactacggtttttctagcaagaagacttggaactcagacgtgcactcgtttttacccccctcacacggtggtgtgaaggagagtaagaaaaatttagtacgtatacgtcccactcttttgggaaagggagatgcggtgagtggccagttcaccaaataattataactcatacttactagtacaaagaaaaatgtcatcacgtatatatatacctgtcggcgagatgcgtgcacgctaagatagtagaaacggtcgtgacagagagatgatgcatttgacacacgagtattttctgatgagatgagatggctcgtaccagctcatacatatgcctgcttgcagtcgctgcggtcatttgctgttgttgctccttgaggcaggcagggtggacgtcaccgccggatctcttcagattttgctgttccccccttgctgcgattccggatcaagaatccaaccaccatccatgctccatctcactagtagtactccctccgtcctaaaatataatagaactttctttttctttaagaaataattaagaaagggtttcataggtaatataatatgaaatagaatcagaccaaaggctaatagctgagaggaaccataattatttatagttcttttgcgaggttatttatggaagttaacatgtgaaattgatatttcctcgtttcatattgtaagaccttttgttgttttctaagtcatacttttttttagctttgatctaatttatagaaaaacataacaacatcttgaaatccaaaataaatatcgtgttaaaatataattaatgttagatttaataaaactaattaatttagtgttgtagagatgttgctactcttttctaagcatgatcaaacctaagaaaatttgacttaaaaaaatacaaaaacatcatataacattaaaacattataaaaccaaaggaggatcttagttatgatatcggcttttacgtacggtcaatgaattaggggtgaaaacggatcggattcggacggatagtagtcataccatatcctataccatattttttaatcggattcggaggtgatgcggataatgtgcggatgcggagcggattatttcggatgtcggaaatggtgcggagtcggtgcggactcggctcggaaacggataaaaataatcggatgtggcatgtatatacaatcgatacaacatctgatcatctgtacaatgagcaacaatgaggtaccaatatcacaattcacatgactcatgaaagcaccgatcacatcataatataatgtcgagttgttaacgattgacttgtcttctgtccaaaagcatgtaatcgacacatatagtattgacatcacgatatatcgcattcacataacacgtaagacatagaagttccacaaatattagaaaaaacaatatcacatgacataggtgatagaacattggaggtccacaaatgatgtccaattctcatacaatactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagagggtaggccgcggcgccggggtggagaaggcaggtggcggcggcggcgctgggtggagaagtcaggcggcggcgtgggaggactggaagaagagaagtctcgatgaaaaaattggttgacgcgacgccgacagagtcacggactgaactcctggatagattgatggataaggtggacgtggatgggctgaatctttacacgatgaaaatgctcgtgtcaaataggccaaattgagtggttatatgggctgtgaaattcagattatccgccaaaacgtttattggataatccgcttaaaatagcggataatccgtatctgtcggatataaccgataccatatccgcatccgcatccgcatgtaactatccgtatccgcatccggccggatatctaaaaacccttaccatatcctcacttcggacggattcggagcggatcggatcggataatatccgctccgttttcacccctacaatgaatgcttgtgctacatacagcatactagcactactgtacatgtctgcacctgaagaacagcacatactgttgcaatgcaacaggatatatgcaaattaaactgcaaaggcaaacctgaaccctgcgcgttgtgctttgctgctgaaatcagaccactggtttaactttaaagtgatctatccatgcatggtgtgcataatcaacagtagtgcaagtgtggatggagaagtggatgccaatgctgccatgcagatgcagaggcttcagttcagttcagctggcctgttcatcaactcaagctagcttagctagctgaaagggaaaggaaacaaacattgcaatggaccacatgaatgcgttgcatccatctctcacctcaatatctttgtgtccctttcacaaatatcatcatccatgcaccaccattgcccctctctcgctcgcctttggccaccgtgtctgtcgtcctcgtcctcgtccccgtcgccgtcgacggcgacggcgatggcggtgggtgaggtcctaacagaaaggcgacgtggtatgcatggtttccacggtgactgattatattggtcgagacatgagacatccgtggttaaacgatgctccctctctgatcatggatatttgttgtttaagattaaagtttggttgattaggtcaaacatttaaaattttgatcattagttttctattaattattattactctctgaatcatactgattattgtgttgtaacctgattaagccgtgcaggaactaattaatcgattttccaaatgtgacagctactgcagatgattctttaattccaaatgcgcccatggttatatattagttagtggacggcctgctgatcgtcttgcttaagcttttctcaacttgaccagacatttgttgcccttctggacaagtttcagggtctcttgccattccttccaatcagttataagatctttatgtagcttttgtgagcactcttctctcagctatacatctgaaaatttctcctagatggtacaaattcttttgcctgaaacactgaactgttgtcaaaattgggggcaatttattactactgtcatctatacagtttagtactttctgcaggtttgtgtagccatagctagctatacatttttttggtgaaaatcaaatcaagcatttggtcacagaatcaacatgacaacgtgtgagaggcagttatgtgtttaggaaagtgtcacatgtcaactggagtagtagtgtgtgtcattatgccagtctctttcaacaagaacaactattgcttaagggatgaaacctcttgcagaccagctaaagatctttttcttcatgtgggagcatccttatttcaggcaaacaatcaatgttgtcaccatagcatcttctccatggcttctccatttgatcatctcctttccatttagtgtgttcttgatgcatgtatatgcaatattgctctctttctttccacccataaagctttgtttaaagttgatggttatgtttaatgttctctgaatttgtggcctcagaactataccagaagtgaagtttgtcctctgatatgtggaagatagcattcatctcttcctcttcaccaaattattgatccacattaattattttctctgaccgtgctaattctgacaggaagactggaacaccgacttgctactttttcactgaagaaagaacaatgaaatgcttgaaagaaaacctgttgccatcaattgttcttgtgactctgcagtctgtggatcccaacacgtacctgaataatccaaagcctcaaagtaaaacagcagaatcctaatttcattttcatgtcttactctttgttagaaaacgataagcgaacaaacgataaataacaatagatcaatcacaaaagacacgagatttaacgtggaaaaccctcccaaaacaggagagaaaaaaccacgggcgccagccagcaaaatatattcactatatctggagtgaggttacatcgccacacgacggcttacaagaggtatatatacggtggaaccctatgctctggcccaagcctcccggcgacgggcctccgctccgctacggcagaagctggcctttattaagtgcaaatgaatttggatcacaactcaacactcttctcctagatgacaatatttctgcctgattataaactgtgatttttttccctgattttatagaatctggtacttataactgcaaatttatgaaactaataccagaatattaattcccagttaacaagcaagttcagtgtcattcatgtggccacttacctgacaagctagctagcaatcatttctgaagctgcagcaaaccccatgccttgccaatcaggaactagccctgcgttaccatccgaagaacactacgttgtgcctggatcaccacaggatagcacagtgctctaataattggctcaaagctgctgtggtgagccccagctggggctcaaagacctggagcctgcccttcttctcaaccatgaatgacggtttatttcatcagaatgtagtagtaaattcgccctcccgaaattaatgtgctgtcataaactgatagaaaacacatactgatctaattactgtgtgttaaattcagagcatgcattgcaacttttttttgctaaatcaattcagagcacactgcaacctttttgttaactttcggttggattagcatcccagttaaagcttcaacaacttcagtgacagcaggtggaaaacgagcaagtgtacaaaatacaggtacttcaaaagaaatctacttatgccacatggaattcaaactcaataggcctattatttcgaaaagagagaaattcaatatgcctatgaaaaactatatatgtatcatcttaatttggaatacagatcacacaaaacccatatttaattaaggtactagagatattaaccaaattaaataatctaatatctcaatcgcgtaatgcttatcattcatggatatgatgtgttctgaaaggaagctatatgactaggttctatttggtgcaatattagaaatgtagccaaaaagttcagcaatatgcggtctgaaagttcacagattctgatatatttgttcatgtttcagaaacactgacaactgatctggtgttgattccagtatgtaaaatctatccatactgtatggtttcctcagctaagttaaaaatcatagcatgagctttcattttactcctaatagttcaatttacatcataactaggcaaattaaactctaattcgtgtctaatgggcttcagatttgtagacaagaacccaaaatatcttccattgttccagaggtacctgcaattaatatagcaagtttgcccaagtcaaccacctcaatctccactgtttgattggacgtttaggtttcatatcaccaaggttcaatcagtgtggagtacttttcagtccttctggcctgtgccaaatgtagaaggagagccttttctctgatttgatccattcttgcaagctacaggtaagttgatttgattccacatagaattatttttcttctttgtttttccatgccttttcttctctgtcataaactcctaatttagctactataattttttcagtgaatcctagctaagagttagtttattgttctttttaggtactgaattttggtacatactagcaaattgtcatatacagcaacaaggatctagtggcatgagactttggcaagtgttcttgcagaaaccaaaatcagagctgcctccatttggctgaataattctggccatttctaaccgttcctcattgcttttctccttatgcatatactggaaaggtagctctgcaaaagtcaggtagacaataacactagaagcagttatatatgcttgcaaaaattcacaacctttccaaacaaaatttatttcttacaccattccaccaggaatggaatttcaatactaccttgccaagtgcagttacaaaatgttcaccaaaacgtccaaaccttcgctgcaactttaatttggacataattcatatatacttgctagtatagcaacaggaatgctgcatagtgacaacacatctaggatcatgtcccaactctgatagatccattacaccaacctatcttgagacagtgccaatgcaggaactaacctctcatggaaatgcatggtagctagctccacaatgtgacacatgtaagtctcaagttcaccgtgcgaaaaatcacgatgcgcgaatcgcccccccaatttcgacaggtaagggtagatcttcatcgatcggccagttgaaaacaacaacggcggtacaacgatcggccatcatcgtgcaccgcaccgcggcggtggcccagagccggtgatggggatgtatggacggtggagtgagtggagagagggttggcagcaagcatgatgcatcacattatgtgaggaagagataggggccccatgagagcaactgaaaggactgtgctgaattaataggaggctgctgctggtgagtacttagccattatctctgcatcctatgtgacaaacagaaactggacagtgtatgtggagtgtcacatggttgtatatacatcatacattaaatcat

SEQ ID NO: 64549 - DNA, 700 bp, Oryza sativa
aggttcctgaactgtgaaaagtgaaacaaaaaggaggaaagcaataaccggtcttgctgttcccacaactgtttttttgtgtctaacatgcagtttaccagtccaaacaaagcaagtttcagacttacagcaacaagaagcaaagctttgcaagcagagttacatcagagttacttgcattacatattctgaggtaaaatggatatggagacatatgtatctgacagcacagcactgcctgccaggacaagagatcaaagagtaaagactgatggaaagagagctagctagtagtaaatcagaaaggttgtggattgcagtcagaagaaacaacaagctagagatagatagctatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatggtaaattctggctttcttgcttttggataaattttgcttcctttcttaacttgagcacaagcttgtgttatatgtggtgtggaatcttggttgccatgttgtgagga

SEQ ID NO: 64550 - DNA, 8215 bp, Oryza sativa
  unsure (1)..(8215): unsure at all n locations
caaaagtcaagtgaatgcaaccgcaagggtaaatggcattatactttctcatatggtagcgtcatgccaatcacaagcagcccgcttttggaatgcgttggcatctgatgaggttcagttcattcatctcattagatatgtgatcattcagccagatagagttagctcaaatattcttctgtatccagtacatgggcttacccttggctgcataacaccccccccccccccccccgccggccgtcctcctccccttctcgccgcccacccccgcgcgctcgctgcccgccggcgacgagtcgcggccgccatcgctcctttctcccttcctctcttcacattagagggtattttggtctcaaaactgctcaaagtggcaaagtatactaatgataacgtattgagtggcattttatcctttgcaatcttgtggagtggcatattatccgttttctcaatcaaacataccaaatgcccagccccggttttaggtgggcaatccttttttttatgaattgtttttcaatttaattttaggggctttcctagttgctttagggcctgtttgagggagcttctagctactgcagcttctcaaagaatcagaagctcccccaaacaatccagcttttgatccagattctgataagttgtagttgtagaatccagaaaatgaattagaagccataagctggaaaacccaatttttctagattctaagaagctggctatcaaccagctgcttctcagaatcttaagctccgcaagcaggccctaagggttttcctagttgctttttcacggctctccttttttcagtggttgctacttagacgttttaagtttgagtaaatttattgaaaaatttagcgatatctaaaacaccaaattaattttattaaatctaatattgaatatatttagataatatgttttggaaatactattatattttatataaattttgtcaaactataaaaaaaatcaaaacggcttataaaacggagggagtaagaagataactaaagcaaatatatgaatagacctattccaaaagaaaatcaagctacaaaattcatttgttttggactgtaatctaaaactagggccaacagggctctgaccattctaaaactaaggtatggcaaatttctgccataggcactcggttttttttcttttcaacttgtatcttcactaagaaatcaacagggatatttaagattatttttgcacatgtggacccaaaatatgtgtataataagctttcataaaagctcagcaattgccaatcaacttatgttcgtactaactttttttaaaaaaaactatcaagtaaaatttggcaaattcgattctaacagttttaaaagctattttcgcaacatgcgttccagccaacaagttaaacattcaaaatggagacaaacacaataccccatattccaaccatttttcgctatattaagggagaccaccatgtcccattgtccctcattttctcaatttgaaacaacaacagccgcagatgttcctcagcaagtccaaaatccatagaaactacagtttcagacaaaaacagcgacaacaactactactacaaaacagcatttgcaggttgcaaatttgcacctccaaatgctctcatcatgttgttaggatatgctcctactactgaagctccatgttgacaagctcatttgcatccatcagagacgatccccatgctgtatattcattcgaacttgcgccgccaccacaagctctattctgaagatgctgcaagctcgccatctgttgctgctgcagctgcactggatctgttgggtcaatcttctcgacagaatccacaatctggaacgctggagaaacctggtgcatgaagctgttaacaccggcattgttagcgttggagaagtagttcattgggttgttgttctggatcggcacagaagcatcagagttgacattgaggggagattgcatgtcaggaatggcctggtgaagttgtctagcccctgtaaccatcttcacactctcctctgccatcctcacctgcaatcatgtcaagatgttagctaacccacatcgcatggttcatgaattttcagttgtggtctagaagcatatggctataagatacgacaccgcagtagtgtagtgtagctcaggttctttgttaaaattgattgtgatccattgtgtgaattggttatcaccattcggcaagcgattatttacacctggtacgttgcaggaaaaagaaaagtagttacacccggttgtttcaagacaaaacaagtgagtctaattgttgcaggttataatagatggcaaacaacttaatccttcgaatggagcaagaggacaacatttgcaatatctcctgtaccaaattttaagaacaaatgctagaagttcgtttcattccaagaaaatttggtatatgtttgatatgtagaatattccggttttctacaccatgaaagatgcacaatactgaccagaatcaatgcacatggataattggatacctatttgaaagagaggttcagttcatacagaggactaaaaggcacttaaacagttgcatacctttgctcttagggcttcaatgtctgccattagtaccctattgtcaatagcagcagcactgtacttctgatttgcatcagcaagacgcctcaacagagaagagttttcaacccttaatagtgatacctgcaatgatttagcaacaattacacttgttacttacatattccaaaactttgttgtgcagtcaaatggaatagtgtaaaacacaaaacctgctcctccaggtcttttaggcgagctgcctttctgcttcttgagcgtctagctgactcccggttggattccttcctgaaattggacaagaacacaagctcaaatctcaaatatccggctgtatttattacacaaaaaaaggcgacatgaatgtctgactgctgcgaaaaaaaagaccacagtagataaactcaatttttcatatgtagaaaaagcaactagacacaacaggacatgatattcccagcatgttatgaaaagcaagaagcaaatgcctcctaaattgttctaatcatacacgttgcatttttccttttttgcatgaatagctgcttgcacggaaacaataattatccttaatgcaccagcttgtaacaagcattaccaaaattcagtcaggtatataaagcattgaaacacctagcaagcattagctcaagcatttctaagaaaaaagtgagaatgttgtatataatcaaatacatccagtacaaacatgaaacacctagaaagaaactaaggatccattatcttgataatctaaagcatattacttaaaagctatttctaagaaaaaaggaaatcaatagatgtaaaagtcccctaatttctaatgctaatgctcagtgtttactctttgtatgtgttgaattgaaaaataaaaatacacaagcaaaagaatacatattaccttttcttcactttatcttcttcatcaaggatcatatttcccattgcctctgcatctccttccatatcatcatcctctgatggtgatggctcccttgaggaaccactcgtagcttgcttggcatgagcatctgtattttgatttacatatgggcctgatcctccatttgggccaggacttaacttggtctgcactagtatcccgttacctgaatgtgtcgaaatagggggaaaatccaatcagatatatataatatgaaaactacattacgcaaaaattagatttgcttacaacattagagattactcataagtcataactcataggtactgagaagatttaactaagcacatatgcataatagaataccttcaatgcacttctgtgaactcaggatggaaccaactatactcagtgatgttttattgcctagaggactctcagaatgtattgcaccagaggcctgtggatggatggacatgccaaaaattgaagtcagaatgcaaagggacttaataactatcggagctaaacacacactctcatagttaattagttctaatggcattataatcttatatagggaaccgtttcacattgtaaactgaaatcaactagcaaaagctcagatcaacatgttctgtagtcatttgtaaactgaacccacataatgagttcaaagtatgatatccaattgcaaaaattatataccccacttagaaaactaacataaaaagaagatattttctccggtccaacaaaaagtacctcgaggtaccggtacctcacggtaccaaatcattttcgatcgttggatctaattaggcaggatgtgcattgttagatccaacgatcggaaacgatttggtaccatgaggtaccagtacctcgaggtactttttgttggagcggagcaaatctctaaaaagaaagctctgcttccccatctacaatcgactggtgagaatttctaggtccaaatttaccagattccaatataacagtttctttttttctactaaaataatttcatcttccaagggtatgtgacctaataattccttcaaacaacaataataagaaaagtaatgcaaatatggtaaaatacagaatttccaaaaaatattccatgaatcataccgcctaggaccacccaaaataagtgcaatgacctatgatctatacatcatttttgcaacatgtaaccaaattgttaactttgcactcaagcaatgcacggctccaagaagtcacataaagtctctacacctccatgcaatcctaatccatattactcctaaatctatacacggaaataatataaatattataccacaccccgacaatattaaagtttgtctcatcccactctgacaatattaaagtatggataagaaagcacacacgtgagtagtgcctgggcttacgatgcggatatcgacatcaacgcgtgctcttataaaattaatttatactccctccttataatataagagatttagagggatgtgacacatctagtactatgaatctggacagagagccggtccagattcatagtaacagctaggatatgtcacatctatgctaaattgcgaccatctagccacagtaatcacaggaaatgccctaaaaattgcacttaattacgccacagccatcccatcaccaccaccccaaatggtgaacccaccagtacaactgtacaagccatgaagcaagcaaagcaagcagcgatcgagatgagagagagtaccctccacatggcgacggtggcgaggtcctcgtccagcttccgcttcagcatcgcgttgtactccacggggtccatcgccgcgctcgccggcgccgccggaagcgcggccgcgggcatgggcatcacccccaccgcctcacgatcgccgtagcccctactccagcgcgccgccgcctccgccgccgccgccggcatcgggctagggtaaatcgccgcgccgtccgggctcgccgccggtgcagggacgccgtcgagctcctccagaaacctctcgaggttccaccccgacgggcaccgctccagcaacccgccgccgctcaccgcgccgacgtcatctactccggcggccgccgccggctgcaccggcggcggcggagcccacagcgggtcggggatctcgtcgacggcgaacacgtgctccattgcgctctcggacgagtttgaaatgaattcgcgaggggttttcgaaccgaaatcggggcgaaattgaaaacgctggaaaagtttgggagaaattcgatcaaatgctttggaatttggtttcgcgggaggaagcggagaggaggaggcttcggagagaaggaaatggtgggaaagctacggctacgcaacccatgggtttttttttcttctctttttttttcttttttttttcaattttgaactgagttgagagggtgctctcctctcctatttatataggtttgtcccctctttagaagcttcaagaaacgtaaaaagcaaaacaacccgcacgatcttgagtgataataccgatataaataatttggacgtgttaacagaggtttcaacggatataaagtgaaacccacacgatcaaagcgataacaacgatacggacgaatacgtttttattaggaaaaagggttaacagaaagcgtgcaagtaagctacgatggtatggtgttcctagcacaggtgtagcataattttgacaaggttctataaaggcatggatttatttgtttttatcttatcaaagtttttgagtgagggtgtagattacgcatccttaatttgacaatgataatataaggacaaatggctttctacagaaaaagaggaaaagtataacagaaagggtagcaaagacattcgtgaataagagtagtgatgctacttaagaaatgatccatctctatttactatgacaagtgtctatagtaatccaaactgattatatcaaactgacctaacaatgatatttcagtttgtaactttataccattgtcctaagaaacgtgccctacacttatggttatgctagcagcttattgacatgtatcatccatgttttctgctaactttttctccccctcctctttacttggttgctttcgagtttaatttcagaaatcacaagaatgcataggtataatgtggttgattccatgtgataatcaaaatggggacatgaaatttaaaagggggaataagatcagctgaaagtgcaatatgtgtcgcttaagcgcccattttgccacgtcaagtttttaagtttcttatgttctctagcatatttaatacatactacttagtcttttagatattattagtaacacaagcacatatgtattttatctttaaacgttaggaccatatatagaacatttagctccatgccatttccacattagccaattaaattttattcccgtactttatattttgttttagatattaattaatatttacaatgtataaaaagtaaagaaaattgttaaaatgtgtaccatgacaatacaatttttttgcactaaattctttaatatgtgtttattgtcatgtattattgtgtattccattcatcaacctcacatgcacatttgcagctttgaatctttctagtatatgaaaaagaatttggttatgcactacaagtatgtacactgactcactgaggcatgatgactacttgcaataatttcataagctttgcatgtactttaacgcatttcctatcaatgtagattaattcacccacaaccatacatcttaatttgtttcaaacttgaaaaattttagagaattgacaaaatttgtatcatagtgttgggttacatatccaggcaaagctaacaagtatttgtaaactgagagggtaaaatgtaaaaaagaaaaaagaaaaaaaaagaagacgaacatgttctaaagtccccatatggtgtagcacaatgtaatgaatttatcatgttctcagaaagatgtgagctgagggaaatatgtggtgaatttataaacttgttttgatctgatgtaaggtttagttacacataaaaccaactagataggtaaaaaaactagagtaaatttcagaaaactgcagttttattgactaaactatcactttgctgcaacctttgcgacacttttcagaaaactgcaacattagcgttgaaaattatcacatagctgcatttttttcaggattccctgttactgacattccgggcccacatgtcatacatatatgctcgagagagggagaaacggagcggcacgtcagcatgccacctcatggcttttttttttactgtagcgatgccatgtcagtgcgtgttcgggcggaaaaaattgtggtccggctgcaccatttggctcggtcaagggcacaggccgacagggtcaaaggcaggtccaagacctgataacgacacattactactcccccaattcccaccgtcgccacagaacgctagaatatgtgcacactcacatctataaatgcacacacacatnctactcctatgagcaccttgagaagattgagtccaacatgatgaagtcaccacggatgtctcgctggtgatggatacggcacttaccactgacagaataattagccggaaatgtgagcaccccatgtaaatttagaacttggaccccgatagggtggtttcaagaaaataaactaacccagtaaattatacccacct

SEQ ID NO: 64551 - DNA, 16948 bp, Oryza sativa
ccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgcatcctaaagactaacatgcaagaatgccacgtcaactcaataggtacctaaagctcaacatgcaactatagctattacatatacaattttattacatcctaaacctcaacatactaggatgctaaattatcattcctcacataatttttgtaatattaatttcaatccaaaccaaatctatccatgtcattgtcatgtggggcacggcctatacacggcgtcgccgggcgcgagatgtgcggagagctgcggagcgagccgcagcgcgtgtcgcggcgcagagcgcgatcaccatgaccgtggatggcaaggacgggctcagtggctaggatcggagtagccttgattctaggagggtttgtttccaagttgttagcgtttatttccaagttagttagccggagggctatatactcttgtaccgaaacatttgagaggaaagcatgaaagttatcgtctaatctccctcttattctgttaagccactagctgaggggtataacctcgcaggtgaggactggagcgcgactacgagttacgtagtcgcggcccgccgtcgttgagcgcccaggcgcttgacaacctggtatcgggatctcgtcgatcctcggcgtccgccgccgccgcgcctttccctaccaccgccgcacccgcgtctcccgaccccgcacccatcaaccctagtccaccacccatcactgccaacaccagtccaccttccccgtcatcctcgtcatccgtcgcctccaactccggtgacatgggtgacaacggcgacctcaaggccgcgatcgacgccctcaccaagaacgtcgccgccatgcagtcgtctatccaggccaacgccaaggcgatcgagaacatcaccgcatcatcctcaggctccggcccacggcaccactccggcgagcaacccccagatcgcccccccaagcattggcgcccggagatgccgcgctacgatggcaagactgatcctctcaccttcatcaacaagtgcgaatcctttttcttgcagcagcggattatgccggaggagcgcgtctggatggcttcgtacaacctccacgacgacgcccagctgtggttcatgcaaattcaggaggatgagggcactccgacatggccatgcttcaaggacctcatcaatctgcggttcgggccaccgctccgctcgactccgctcttcgagctctcggcctgccgccggaccgggacggtcgcggagtactcgtcgcagtggcaggcgctgctgccccgcgcgggcaaactggaggaggcccagaagatccagctctacaccggcgggctcctgccaccgcttagcctccaagtccagatgcagaacccccagtccgtggcgtccgccatgagtctggcacggcagttcaagctcatggccgaatacacgaccgcgccggccaaggctccgggccgcggcgtcctgggcgccccacaagcgcgtccggctctgccggcacccccgccgcaccctgacaagacaccggcggtcaccaaccagggcgagggccgccaggcgaagcgcctcaccaaggaggaacaggcggaacgccgccgccttggcctctgctacaactgcaacgagagctacacccgggggcacaaccgtgtttgccggcgcatcttccacattgccggggtggagctcgacgacgacgccgccgccgacgctcatgaggagccgaccacggaatcgccggtcttctccctgcacgcggtggccggcgtaccgcgcggcgggacgctgcagatcgcagtcaccatcggcggtgcgccactcgtcgccctcctcgacagtgggtcgacccacaacttcatctctgccagcgccgcgccacgcacgaggcttccggtggagtccagaccgcggctcacggcggtcgtcgccaacggcgagcgcgtcgcgtgtccgggcgtcatccgcgccgcgccagtcgtcatcgacggcaccaacttcgacatcgacttgtttgtaatgcctcttgcagggtacgatttggtgctgggcacccagtggatggccacccttggcgagatagtctgggacttcgccacgccgtctatggcgttccacctccacgggcacgccttccgctggaccggggtgacgtctgctgctgcaccatcgctcctctctacggtggccagcgcgtccctcctcgacgagctgctggcgtcgttcgcggacgtcttcgccgaacccgtgggcctaccacccccccgcggccgcgatcacggcatagtcctcaagccggacgcggcgccggtggccgtccgaccataccggtacccggcggcccacaaggacgagctggagcggcaatgtgccgccatgatccaccagggcatcgttcgccgcagcgactccgcgttctcatcgccggtcctcctcgtcaagaaagccgacggcacctggcgcttctgcgttgactaccgcgccctgaacgccctcaccgtcaaggacgcgttccccatccccgtcgtcgacgagctcctggacgagcttcatggggcgcgcttcttcaccaagctcgaccttcggtcggggtaccaccaggtgcggatgcgaccggaggacatccacaagacggcgttccgcacccatgacggcctctatgagttcctggtcatgccgtttgggttgtgcaacgccccggcaaccttccaggcgctcatgaacgacgtcctccgcgatcacctccgccggtttgtacttgtcttcttcgatgacatattgatttacagcaatacttgggccgatcaccttcgccacctccgcgtcgtcctcaccatcctgcgccagcatcgcctgttcgtgaagaagaccaagtgctcgttcggagtcaactccgtcgggtacctgggccacaccatctcggcgtcgggtgtggcattggaccccgctaaggtccaggccatccacgagtggccacagccccgctccgcgcgtgccgtgcgcggcttcctcggcctggcgggctattaccggaagttcgtccacaacttcggctccatcgccgctcccctcaccgcgctcctgaagaaggacgggttcacatggactgccgacgccgcggcagccttcctcgccctcaaggaggccgtgacgaccgcgcctgtgctggcgctcccggacttcgccaagcccttcatcgtggaatgtgacgcgtccacgtatggcttcggggcggtcctcatccaggacggccacccgatcgcgttcttcagtcggccggtggcgccccgccatcgctccttggcagcctatgagcgcgagctcattggtctcgttctcgccgtccgccactggcggccatacttgtgggggcgccgcttctacgtcaagacggaccactacagcctaaaatacctcctcgaccagcgcctcgccacgattccccagcaccactgggtgggcaagctgctgggatttgatttcaccgtggagtacaagtccggcgcgacgaacacggtggctgacgccctgtcccgccgggacaccgaggaggcttccctgagcacgatcatggcggtctcgggaccccgcttcgacttcatcgaccgcctccgccaagctcaagccagggacccggctctggtggcgatccacgacgaaatcgtcgctggcacacgggcggcgccgtgggcgatcacggacggcctcatcacctacgacggccgcctctacataccgccaacatctccgctgttgccagagatcgtggcagcggtccacgacgatgggcatgaaggggtccagcgcacactacatcgcctccaccgcgatttccattttccaaacatgcgtcgatgtgtgcaggacttcgttcgggagtgcatcacgtgccagagatataagacggagcacctccaccccgccggactactgctgccgctgcccgttcccaccgtcgtctgggctgacatcgggctcgacttcgtggaggcgctgcccagggtaaacgggaagtcggtgatcctctccgtcgtcgaccgcttcagcaaatattgccacttcatcccgctggcgcacccgtacactgccgagaccgtggcgtaggcgttcttcaacgacatcgtgcgcctccatggtatgccgcagtccatggtctcggaccgtgacccggtgttcacctcgctgttttggcgcgagttgatgaggctgatgggcgccaagttgcacatgacgtccgccttccaccctcaagcagacggccagacggaatcggcaaaccgcgtcatcgtcatgtacttacggtgtttcaccggcgaccgcccccggcagtggctccggtggcttccctgggccgagtacgtctacaacacggcgtaccagacttcactccgggagactccgttccgcgtcgtctacggccgcgacccacccaccctccgttcatacgagccgggcgaaacccgggtggctgccgtggcacgtgacatggaggaacgagaagccttcctcgccgacgtccgatatcgcctggagcaggcgcagttggtgcacaagcgccactatgaccgtcagcatcgccacgtttcgtaccaggtgggtgattgggcgttgctgcgtcttcgccagcgcaccatgtcttcactgccacaagctacctccggcaagctcaagccgcgcttcatcgggccgtacctcgtcacggagttgatcaatgacgtcgccgtccggttggctcttcctccccaggcgcgcatccacgacgttttccatatcagcgttctcaagaagttcgtcggcgtccctccagcagcgctgccagagctgccccccatccaccacggcgtggtcacgccggagccggctcgcgtggaacgggcccatctagcgcgcggcgttcgtcaacttctcgtgcactggcgtggcgaaccggccgaatcagctacttgggaagacctcgacgccttccgcgagcagtatcctcagttccagctcgaggacgagctgattcgcgaggaggggagagatgtcatgtggggcacggcctatacacggcgtcgccgggcgcgagatgtgcggagagctgcggagcgagccgcagcgcgtgtcgcggcgcagagcgcgatcaccgtgaccgtggatggcaaggacgggctcagtggctaggatcggagtagccttgattctaggagggtttgtttccaagttgttagcgtttatttccaagttagttagccggagggctatatactcttgtaccgaaatatttgagaggaaagcatgaaagttatcgtctaatctccctcttattctgttaagccactagctgaggggtataacctcgcaggtgaggactggagcgcgactacgagttacgtagtcacggcccgccgtcgttgagcgcccaggcgcttgacagtcatcatttctattgcatttaacatgtatccatacatcccacagcaaagcatgggacgtcatctagtttacaatatggtttgaccattcgttagtgattaatgataataatcgtatttgtgacattatattttggtaaattgtcttgaaattaattaagtcgatatatttttcttgaacacattgaagtcaatataataaactatagtgcagttactcttcttttataaaccattgacaattttgctaagtattgtaaaattttgtcctcaatagataagagatttgcatgttgccaaaacaatagaagacattggattttacggaggctttgtaggtaagaacccctccaaacaatttcaatatggttatatccaatgattagatgtgtcaagctccagttgttatataagtaataatcattcttttgtactcagtcatccagcatcgatgtcatgttcttaatatttgtaggtgcttcatatatgcttggtagagctttaacttcaactatttgggggatggtagcagatcgtatcggcaggaagccggttattgtgtttggaattttcttcacgttagaaatttttttctctatttgtattgcacctattctttgttaccttcatttgattcattgtattgcactaaatatcttaggctggtatttaatactttgtttgggctaagcacgcagtactggatggcaataactacacgttttcttgttggatcattgaatggtttacttggcccaataagagtatgattactgactgaatcagaactctattagatatttaaggatgttaagtttagtaacttgggtctttgatctttataggcttacactactgaagtttgtcggcctgagcatcaagctattggattgtcacttgtaagcatacaatattttatagaaatatgttttcactactcgctaatgcaacaactcaatttatgatgtttgttcctctccattattaggatagcacatcatgggcaatgggtcttattattggatcagttattggtggatatcttgcacaggtataaaaaatattagtgatataggaatttaatatgcacttatccactaatattattatgacactgttattttgtctgatagccaacggaaaaatatccaaagttatttcctggcaactcactattcggaaggtatttagtatcacatatgaatacggttataatacatttattaaaaaaaacagttacaatagacaagtggcttcaacttactgtttttaaaaattcttttcataggtacccgtacttattaccttccttatgtatatcggtcttctgctttattatctttataagctgcatgtggctcccggtatgtgcaacctttctatgttattttgctaaatattcgatgtgatgcacacttatgtatgtttttgcaaatatataaaatagtattactttttctacttgaaaatccataagaagatatatagaattacaatggaaaacaaatgtttgaatatttaagcacgaattttgcaattaacaggagctgttgggtgattaagcaatgaaatgtcacatgtggagtggttgtttgagtatggcatatttttaacttgtatgctttcatcgaagattggaagcataaacaatatatggattagttattaaaagaaattgcatgacataatatttcaggagacactgcatgatctcaaagtccacaaaaaggacgatggaccaattgaatctccggttgcacattttgccaaatctgaagaacttcttgagcaacatattactccaactataaataagaatttgtttaagaattggccattgatgtcatctatcattctctactgtatcatctgctttgatgatatggcatatacagaggtgtgtatttaactactttttagcaataatatctatggtggtgcttttaaaatatatggatttttaatagaaacaatgtaatatagtgtttatcatctaccagcaaacacaagcattgacaaaaggcataactaaacatccatacttctttgattatggtaatacaaaagctgagaccaactaaaaatatatattggttgcctaaatcaatacatatagtaggagcttcccctatggtttctaggtcgaaaaaagaacttccatatagttatatattccaatgcctttactgcaattaataatacttatagttcttgttacctgatccaaatagctacattttttctcagtatttatttttctagtcattattgcatttaatcatttcatttaaattcaactttatatgggtacaataaaatgaaatagagagatatgtatagcctttaggctgtctccactaagttgatgagttgattatagatatttctttatgcaaagaatgttttgtttctatggaatttctctaacgtttcaagtcacattttagatattttctctatggtctgaaagtgataaaaagtatggtgggctaagtttctcccctgaggatgttggtcaagtacttgcaatttcaggtaaattctattcataattgcactttccatgtcaactttttaattacatatcaccaataccaattgtcttaaacgatttcatcttatattttctctttctataggtgtgagtgttatgttgtatcaaacatttatttatcctaatattgagaaaattcttggaccaatcaatacttctcgtgttgcagcggtgagttcaatattgcaagttagcatgattttttttacatatgtttaaaaaaattgtacatatcatgattaaattttgcaggttctatctatggttttgctttttacttactcacctatgacgcacctcccaagaccttgggttcaaatagtactaaatattgtttcggtacttaaaagtaatcttgttgtgagtatcaacatgcttgaaatatttattgatattgcaacatatatttgttttgtttctctatgtattagagcaagaaaaaatttaaatatcaacaacaatataggtatatatttcttgcttttgttgaacatatttcataacaacatttcatgttttttgattctctagaaaaagaaaatgtttgtttataaagaatgtttctataataattagaaaaatacatgaaattatcaatgtcacatagccaaattttaatttatgagttcacctaaagagtttttcataggattattgcaattggatgttatatctgatttcttttcaatatctgaaagaagcacaaaaatatagcatgggtcaatatcttaattactaacatatttttcctattgttatggttattaggtcaccattgttacttgcacgtacatacttcaaaatgattctgtggtatgtgccactatatcatagtttaattccttcagttttattataatatcttctttttaagacattgtccctcaatggaaccataagacccaagatcaaagaggaacggcaaatggtttagccaccactctaatgtcctttttcaaggcatttgctccagcaggagctggtattgtgtaagtattattttatttctagtgtttatgtttgtaggaaaataagcatcaattctaacttacgaatttcaaatggcatgaagctttcattccaaaaatgtgcactagatatgttcccttttggaggctgttaagtaatttacatttttttttattcaacttggtatacatttggaatgtacaagtgccaatctggtataaaatagtcatctgttaatgcaggttttcatgggcgcaaaagcgtcaacatgctttcttctttccaggtattgtgaactagtactatttgtggaaataactttaaaacttcacattcttaaataaataatattatgaatcttgtaatatgactaaaatttagggggtatttgacacagcttcagatctaagactttttagagctgggtattcctagctccataaatccatggatttgtatctacaatatatttataacatttggacgaatcattttatttaaattttagatgaaatataaaattttaaaccaatataatttaacatacaaacttcaaatcaagtgtggatctgagatctggagttgtgcccaataggaccttagacactggtacacactgtctggtttgttctcaaattctttccttcgccatatgataatttcatatcatgtagtctatttgatcttctctacccattttattgttaactttcttttttgggtatgtaggtgatcaaatggtgttcttccttttgttcattgtcgagtttgttgggctggtttggacattcaagccttttcttgttatgccagaaaaactttctttaaactattcctccaactgagatagagtttcttgagaagttctgtgacatggactacaaagagtttgtatctcctaggtaattaaggcagcctttgtccaccttcttctgcaatttggggagctaccgatagttgacaacaaagggtggacccaaaccttgggccacccaagcagtggcctggggcctggaagtgaagacccatataagctcatctgatttcaccatgtaaaaggatctgagctaaagttggagcggcccagggcctgtctaaagtatgggtccgctcccaaccatataaattcttgttgaagaattcgaaatattcagcaagaaagaaaaatggaagtacaagacgatgaacataaaaattgcgtagttctaagcacgcatccaaaaactgtttctgaaagtggaaaccatgtgtttttttaaaaaaaaataatttaaattgatagtgttgacactaggaaactggtggaaagcctgccgccggctagtaacctaatggactttggacgatcacttatgattgtttttcttcttggtcattgatctcataaagtttgtttcaatcaatgagatcagaatagtttgtttcaatcaatgagatcagaatattaatttccaatcagatatttcctttaccaaatttgtccatagaatagtttgtcatgttcgcgtaattgtaaacacgcatcaatttcggtcagcaattttaaataggtcggttcaccaaagaggcttgtgcaattaggattgtatatatcataccattacatatagatgcttgaagatctgactttaaaggtatatactagaaaatagatgctttaaacccatacactcaatcaagcggctactctcggggcattgattccaggggtgccaaggtgcaagatcgacggatccggagatggctaccaaactccagcatctgccatggtaaaggtggaagcatggaggtctcggcatagccgtcacgtctgaccagcgagatggttgcggtggtgtgagcttggcaagcagggcgttcaccgccattgaggagtccaattgatcaacaagtcttcgatagcactccaatattcacggaagagccatttagtgcgagtgccatcgcttatacaatcaagtattgcagtcactgccaccaccattgctcctatttaatctcattgcgtagctcaattcttctttcgattgtcaactccttatttgatttaatcaggtaaatgattcccctataaatgttgtttgaaactttttttccttcattagtttgactacaatattgtcttgtttagtgctaaatcatttgaaatgagaccagaattgaagatactggagttctagaattgtgtggaaatagttctttctaaatacttactcttggtctcttggggaaagaaagagagacacgtgtcaacatataattgtgcatcatcttaaccaatcagcgagcagcaaccttgccggcttgagatatataaagatattgctgaaactgcccgttatatagtataactacctagaatatataaaaaatgtgacttttatcccaacacttcccaattctcatgctacctctatcatctactaacccttaaaccgcaccacaccatccattaatgagggcattgcagatcttttaccctaatcgttaatttctccaaaacatagaaagctatattttaggacagaccaagtatctaaagcatattgtgattttctctaggtcaggagtgatgtacgtgtgcccttgaaggtactgctaggatcgttcaacagttcttcacaattcaggaataccaagaaaacatcacaacaggcagatatacgaggataattttcagaagcactttccagtttcctttgtacaatggccatatatcagtttaagacaaacgcaacacctcctgctacataagaaggcctattttggaacacgggaattccatggatccctacagggaaatatacagctaaagcaaaactccaactgaaattcccatgttccaaactaagactatcatccccaaagagcattcactaaactgtataatgtaccaatagtgatgccattagctttaagttttcagtcttctgccatggtttaactacggacttctcacgcagcgaatccacaaaaaccatcatctgtgttggaaaatattcgtcattatcatgtggtcaacctgctgtagtacatgaatcaacacaaagataagatgttgagatttaagtgtgctcaataccaatttgatatatggaagttacccttacattttttgccatgcctgcttcgataggactgcgctggttggcgagaacttgattgcctcacctgaacagagtgaaatacaaatggtcaagttatatgttggattgtaacaacaaaattaaatatcagaaatcaggaaacatttaacaagttagaggtgtatccacaggttccacccaggtttaagggtgggaggaagatctagagaatttgccataggaaatcatacctgactactgattggtgttcctgttagtccataataaaaagctgaaaatgcgtgatacattacatatattatagtccatatggaggagtcctttattaattgttagcaccagacacactgtataacatacctaggtgtggaggatatctattgctgtcatgataatgtggcagagaagattcagcagtagcagggggcagcgcaccatagctgacataagaggatgcaaaatgattaagtgagaaagaatccgctactctattctgataaataatatgacatatggggatagtttagaatttcagatcaccttgatgctgctgtagtataggtgctaccctcatgacgacgacaagaatgacctctcaatggataataaggatcaccctggattaaaatcaaaactacgagattaaaagatcagtatgcagtttttcaagacgatatggtttaacctaccagtgttgaaaagggacgcttctctccagaataaatgtgggtataatcttgaacagggtatcttactgtttagaggacgaaaacatcagctgatagggattttaaagagaaaacaatatggcaaaacttcaaaaatatattgtattggacgacatgttaattgtaggaggggagcaaacacaatataataggagcgcacatagccagagtggcagcatgaaacagctagcagattttgcagcctagtgaaaactaagacaacaccatccaactatggcttgattttatcaaacagctggtaggggcttcacatgcattcagatggtttatttgttcaggggaaacggtttacgaaagacatctatctaatttacacaggtgaagtagatattagagaatatgctataaaccagtcattacacagataaaaaatgtcaggcatcagacatcatgaaaccagcttcttttccacataagagcaattgtttctgaaaataaatctgagaactgttatacaacctgtccattttgagaacaaatgcaacatgcatacaattcacccaatcaattaatcagttaataaataatcatccaccttatattcatttgcattttgcactagttttatttttcgatctaaggaaaaggtcaagaacatgcaaatggaggcaattgcttggtttcttggtcaagggtctgtcggcctattaaatatggaggattatgaattcatgatttgaccactctcagttgggccttcggtatgtattgactttggttgcagaaaaatgagcctcatgaccatggaacggtttgcaaattcagattcactcaaatgctaaagataagtttgatatggcacttgttatgacaattggggtatatcttgctctttcattaaaatctgaagatttatgtgtcttgagctatcaatcttcagattataatgaagttggttgattaatgtagttaatatttacataggagaaagctggcagccacagatgggtcaaacaattggaaatagacgacaagatggatggaattgggaatgactaacttttagaagtcttcattttgccttccccagtaatactagatttatggtcttccttggtctgcttgctctgttgggcaggtttagccaatgaaactttaatattcacctgggacacgccaaaagatgtaaaaatcctatcaattgtaaactaatactctgaattaatccaagtcgagaaaagacctttgagccgttcttactgaactcttccttgtcaaaagattcaagacacgagattgcagcctcacgagtaatgtaattaataaaggcaaagtccctccttttagctgacggcatatcgcgtgacagaaccacactttcaatcttcccatgtttcttgaagatttcttttagctgagcatgatcccaggacgttggtatcccatccacaaaaatcgatttaacctagatggaacaaacagtgcatcagagtacttagacttcccagggaagcgaaatcaaatatgttgttaagtgttcagaacttcagatatgattaaaggacttgaacggggatatgaataaagccaggtatgttaacaagtggaaacaaatggtcgttaacttatttatgtaataaggaggacgacgatgcacttcgaaccaagggccaaacatatgaaggtccaagaaacattgttcataaaggacatggacatactagtcaaactgatttttccatccaacagagttatgaaacaattaagacagaacagaaggaaagaaatctctcccaaggtttggataaagcaacatcatgaataatatgtccaggtcgaaatagaacagttgacatctgtaagaaccaatggtataaggaccataggataaaaggttgatagcgaaaaaactgaactctacgatcatcaatgaggccaaatcatcagcaatacagagatacagggatgcccttaaaagaacagaaaattcatttcgtgtcagaacttaagcataaacagttacagctagtataccgatgtatatccaggatataattgtgatagcaacagaaccagtaagacacaacctgtgccttatgccaaatgataggataagtgacaagaatgccaaacgtatgactagactgaaagaaagtggaggttgtcttcaaaagaaaaggttaaaacaaataagatcatctgatttgacattcatttgcagtttcagtcttattagagtcacaaaaccaccatatgcatatgatatgatctctataaaagctaagtggatgacacacataggcagtatgttggagagagagggagagagagacctgcatatctttctcatctggatcattcaatggttcagcccatgcaactcttatattcaggcctttgccaaaagcatttttctgtgaaagctttttgtatgccatccgtgcatctctactagtttccagttcaagaaatgcaaaaccacgattacagactggattatttgaatcagacttaagtgttacagaatcaatgttctcaattccaattttctttagctgcttgatgacctgctttgaagagcaacatatgagaatataaaaatgaaattcaggctaacacccaatcaagtcaatcagaacacaaaaatgaaaatgttactcacatcttcttttttccatttcttgttgatgtttccaagaaaaattctgtcattcccaactggaactgcagctcgacagagcttcccacaaatctgtagcagagtttccataaacaaaattggagaaagaggtgtaataagtactattcattacagcaatatgtgggactagaagacctggtctatccaaaattttcacaagaaaccatttttatcacagaaaattggcactgcataataataaagcaaccaaatatatacgaaatacatgtagaagtttatggatttgtgctatgatgagtcaaccataacaaatggtaaacaggataggaattaagatcaatgtggcatatcccattaggggatgctggatcaactagtacgacctgactcaataaaatcaatcatggcatcgtagagagaagtcactggtccatttgacagtggaaaatttttaagctcttgcagtaagcttacatggtcattccatccgatacttaactgaaaaaagtatctgtgtaccggttgcgatattatgaaacaaatatgcagcattgtcccgcatttgatgattgcactaatgcacaggtcatacagcaatcagcactggtgcgggattacaatgatgataaaatcaaaccaaaagtgtgatggcactaccttcacattgccgaattccgcgatggccttcttcgcctgcgcggcgtggcggtagcgcacgaagcagtaccccttgttcttccctgcaagaggattcattatcatccggacctcggtgatttccccggccttggcgaacaccgccctcacatcatcctccttggcgtcccggtgaagcccaccaacaaacacctccatggtcatcctcttccgccgctccgacatccccgcctcctcctcctccactcccttacccaccactaaggccacctcctcctcctccttacacaccgattcttccaccaccgcaacggcattgcaatccgtggcaggtttggattcatccaatttttgctcattcccaactccgccgtcctgatcacttgctggctcgtcggttggggcttctccccctgcctccgatgatgctgctgctccggagaccgccgcagcagcagcaaccgccgccgccgcggccttccgagcggcgaacgtgcccttggggacgaccttcttgacgatgaccttcttaaccactttccgaaccttccgcgccgccgccgccgacgccggcgacgacgacgacgacgacctcgccgccgcgtcgtcgacagcgggaggcggcgccgtcgagggcttcgtggaggccgagggctgaggccggcgtcgcggtgtccaggcgggggggattggtagggtgggctccaccgccggggtggggggagg

SEQ ID NO: 64552 - DNA, 38593 bp, Oryza sativa
atagtaatgtgtcgttatcaggtcttggacctgcctttgaccctgtcggcctgtgcacctgaccgagccaaatggtgcaaccggaccacgattttttcctcccgaacacgcactgacgtggcatcgctacagtaaaaaaagccatgaggtggcatgctgacgtggcgctccgttccttcctctctcaagcatatatgtatgacatgtgggcccggaatgtcagtaacagggaatcccgaaaaaattgcagctatgtgataatttctaacactaatgttgcagttttctgaaaagtggcgcaaaggttgcagcaaagtaatagtttagtcaataaaagtgcagttttctgaatttactcaaaaaactaatatttatgtttttactctgtaaggaaacaagaaatgttgtatctaaataaccgatatatctgatatctatccctaattaataattattaatatgtctcttgcaatcatggtgattactcaatttaataaacccacgcaacgagcatacggcatatttggaatctttcgaggacagaatacgacacttatccgataagggttttgtgaccaaagccaagacatagatctctaaattctccctcttttgcacttcatgttttttgaaaaggggaatatcattgcttactcctggccttctgtggtggagtgtgaggagaacctcctcctttcccctgtgatgtccccctatccaagaactaaaaggcaggataaagccaatggttcctttctcttgacaaagatttgtgcaaatcaaatctttctaccacctgtcctaactcctcagccttcctcaggtttgtggtgggttgtgagtaggaactagcatggaaaaaaatattcttatatttgtacttcaataccatcttggttttgtcatgttcatgtatgtgtttgggatcatgtgtaacctttggcataaaccttatgatattctctcgagggctttcttgtcattccacgcgttaataacagtaggaagaacagagatgcaaaatagaagtttgctttgcaacacatagatttactaatatatgtcaaagcatggacttttgctttgctttgttggaagttcagggatcgccacaaatccaaggttttacttgacaagttattgacttttcaattgactacagagctggttggtataatctgcttagattgtctagatttttattaaattcagcaagtaatgtaattggcatccaattacagtaagcacataaaacagaggtaggagatatcatctgatacgtgggctgcagctgaacaatccaaagtgcctgtagactgtagtgcagggcctcagaaaatgtacatttcagtttcagccaagtcatgttgacttggtaattcagataaaatgataaacgcaatctcgaaaagaaaatggcaaacacgatggagtatttgtgaaaataaattgatacttggacttggtattagacaaactacagccaagagcaacgtcattttcagaaccaatgtcgtgccgcctcatccattgacagaatgggctcatatcgttatatagctgggtttcagaatgacatgaatcagtcaggtaaaccataggtgaattacgacattattttctccgtttatatccgctcttcgatatttgcaccaacgacaaagcgaaaacagtgttaggcccttttcgcaacatttagtatcattcttaccttgatttattcgttcaagcaactaacacaatgacttaattattttcaacagacaacagtaaccccgaaaaccccaatagcaaaagtcatgctcccaatactatgcttcaaacctgactacaaaaaaatggactgtattttctttcctcatggaactgattgtttcagggcaatgcagccttcaggctcttggctagctcttctagcttcttcaatccttcttcgggtgaagcagcttcgcccaattgcctcaccatagcgctcccaatgatcacaccatctgcgccccatcccgcaatctgttacaaggaatgaagcgacaaaggtcatgcaatgaattggggggaattaaacgtatactgttttgaacataagttcttgagtatgatttacctgcttcacatgctctggagtcgatataccgaacccaacagccacagctttgtccgtgacctagaaaagaacaagagattctatgagcatccttgaatgttatataaatgttttggagatgccaacaccaattcactgacgatgaatgatgcatacctgcttgatatcctggagaagagattgcaccttgccactgacatttgcacgtgcacctgtaactccaacagtgcttacctgaataacataggagttagcaacaagccccatcataaatctagttcgctatcatcaaacagattcttgagatttgataataacaaatttccagcagtgcactgtgattacaagcattcagtttaattttagaacgttgaggtctatgaggtgcaaaattactgactggccatcaggaatatatgctatatgagaacagggtcattagatttcgtaaataagttaaaaaaagatatagaagctcacaagataaataaatccttcagaagcttttgtaattttctccattctttctgttggtgtagttggtgttgtcagtagcacctgtaggcatccatgcaaaataaatcatattcattaactgaaatggcataaccaaaatgatgtgggctcaaattacatatacatagacagaacgacacaatgttctttggtaatcagcagcaacataagcttgctagtaccacatggaaacaaacatcttgtatatatgaagggaaaagaacagaattatggaagttcaggactcaggacccatgtacccaaaattaaattactcagttatgcacggttgcagcaaagcaatactgacagaacaatattagagcttttttaaaaggttcatagcatgagagtggacctaccagctcaaggttgttcttagcagcttcactcctcaaaatatttgtctcttccagaggaacatcaggtaccacaagacctgcaacacagtaatacataagaaacttgataggtacctttataaacagttcaacactaccatattgttctaggtttactccatagttcagctagaaaagggtttactttatagtctataactctatacattgaaatgcaagaatgtacacataacaactgacaagtgggagtctgatgacactctctacaaatatcagtggtgtaaatttgtctatgttgttatacaagttctaattttctgaatgcctaaattaatgttagtccaaattgaaatacaagatatgaaatggaataccccttctagttgattaggtgtgtattgagtagaatgccattttatataaaatagcatttgtaaattcataacagaaaatatctaggacataccatggacaccggcttcttttacaacagtcatgaagtttgcgatgccacgcttcagaatcgggttataatatgtgaaaagcgctacagggcaggacagctcaggtatcacctcctttaccatagagataacatcctcaaatgtggtgccttttgatagtgcacgtgtagcagaagcctgaaatgatgcaatgaaatggttaaaaacttaaaactactcataaccaagactcacaaccaccatcaaacatcatagaacaatagcagaggtttttcatggtatacctgaatgacggggccatcagccaatgggtcagagtaaggcacgcccaattcgatcagatccgaaccacaagcatcaagaatcttcaacgctttcgctgtagtcgccaagtcagggtcaccagcagtgatgaatggaatgaatgcggtctgaaagttttcaaacatataagagagtaaacaaacataaagtggattgcagaaggggggaaaggcaaggtatgaactcaatgctgatctggatgcctatcacaacttaggagacatataactatgtcatctcatatcaattggtattctacatagtaatatatcacaaataataaaggaaaggtgattgggctcatccaacactaatcacaatgattcaattatcctcgagatgattccaacgcatcatcaatcctgaccgcgacggcacgattttttttttcgaaacgaatttaaacccacgacgcatgggaaaactggataaggattatccatcaaccgcggcctgtatcaccggatgcaaatccatccaatcgtaccgcactgaaatgcaagtatgcaaccgcagaacgattcaacgattacccccgcacgaatcgcgacgaatcaaatccatcgcgagcaaacggggagaggagatccacaccacgacatccccaaccccacccaacacgcgcggagatgacgaatcggccgcatccccacgcaccgaatcgacgaggagggggggtggtggcataaaatcaaaatcaaatcgaaacgcgcgcgaagaacggcccccccgcgctcaccttcccctgctccttgagcttggcgaaggtgccggagatgacgcgctcgtcctccccgacggcagccgcctccgccctgatcgccaccatgggagcagggaccccgcggaacgagaccctccccgccgcgccgccgcgcctcccgggcgcggccgcagccacggacagggacgaggccgaggccgaggccgtggacgccgccgcggcggaggcagttgaggccttgagcgcgaacgccatgggtggtggtggtcgacggcgatggcgcgcggcggcggtggtggtcgagtcggggatagagggaggaggcgagcgtgtgagccggtgtttgtgtttgggtcggtattaatacgaggaggaggagttggtgtgggtgggatggccgagccggaccggcgcctcctggtgggcccacagtgtcagtgacagcggagtcgacctcatgggggatattgttcttttgttcttgtggcacgtgcaatgcaataagcaaacatgagtttgctattcgtgttggtacttggtatactttgtagtaggtatatattactgtagtaccacagtatcgtttgaattttttttgtctagttaaaatgaagttgaagagcggtcaaactttgtaaattttagtattaaaatgtacatgatgttctaatctcagcctataaaatatggtaatatcttttacaacatcagcgcatcgtaacttatatagttttagctccaatatagtaaacgtcaatcttgagaaaaaaacacgtttaatagttaaattatggctatttgttgttgccacgtccataagaaaaattgtatgaaaagtaagtaatacccatggccccatatgccaattttctcgtctctcttctttatttcttccaatcttttcggcaagccatgacgggtatattcctttgtctccttaagaagctccatggcattcggtccttttctgtattttgccaaactctgcagcaacaatgagtacagtagcactaggttaaacctcaatacgacaccgcggatagtattggcttctaggacgacacataacctagcatcttgcatacgagagtcttcttgtccaaatgattccagtagactctagcttagacacctcccttagcagggatcttgtcaatggcgcatcattgatcatgatgcctctagctcaggatattcgagcttagggataaccatatccatcacccctaagttaaaaaagaaccacctcgacagtgagcatcagggatcacatcgctcgtagtcgagctcgagctccaccttctttatcgctgcagcattgagattcgcttcctccgcaactacaccgccttgctatcgagatcggcttcctccatcttctactcgagctgtgtcccgttgcaaacgacaaagctcgaggaggcaaagttttgcggaggcaatagtagagtttgaattcaaggttggtggacgaggcagcaacatattttctcccttgcgatgctatatgcgtcgtaatggcttgccgaagagacaaggagaaagggagatgggaaaactggcacgtgggactaaggatatttatgatctttcacactatttatctcttattcaattggaaatgaatattttcatagctatagtgaccaacacaaaataaccatattttaatagtgtattacgtgtttgggagataaaaccatgaattcaggtgttctacagtaaaatttatcatctactactacttaaaaaataagaggtgcttccatcgtccgtcaaaaaaaccgggtggaaaaaaaccgggcagaaaaaaccaagtttgtccgatcaaaaaaaccggacgaaaaaaaaagtccgatccaaaaaaaaagtgaaaaaaaaaaccgggcgaaaaaaacacccgtccctggcaaaaaaacacccgatcccttaaaaagagaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaggaaaaaaaaggaaaaaataccgaaacgaatccgactacatcgacgcggtaaaaagagtttaaaaagataaaaagaaaactgtcctattccaaagaaaaatgaattatatgtatcgtggagaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactatcatattccaaagaaaaaggaattatatatatcgtggtaaaaaaatcgaccgggcgaaaaaagaaaaaaatagtccgatccgaaaaaaacaggagaaaaaaaatgggcgaaaaaaaaatttgtctgataaaagaaaaggaaaaagctgaaaagaatctgactccatcgacgctctaattttctgattgttatcgacatggttatgcatgaaaaacgtatattatcattacgttttttcaccagttgcaacgcacgggcatatttgctagtaaaataaaatatactgtagcttacgcaatattaattacagagtatcttgcctgtacggctgtacgataggctactagcagtagatacttcactctagtctaaaagcaaaacgagtattattgaaaaaataaaaagaaaactaatagacgtgccggttctctcccggtgttgaggaaagagcagagaaagcgagatggacgacgccgtgtgctagcagccgtgcaggtgtccatttcaccctgatcctgcctcatgcatcatgctacaaacgttccccattcctttcctactgctggctagagtagagagtacttgtcaaacttgtagaaatcttcttcttcttttcttgtttgtgtccgtgttaggagtactatcgatcgccgagacgagacgccgatggatggatggagctgtgttgttgttgatggtaactcgtagcctttgaccgatgcgaaaaaagaacaaaaaaaaaacgaaagggaaaacaaaacgcaagaagctttgcttggccttgtattgccaggttcaaccgagactcgagaatcgagatcgatcggctgcctcgaccggtcagcactgcgtcgtcttccggcagctggtttgactgatctgaggcgggcggttggtgaaacaatggccgggccggcgacgggggaagaggccggcccagtgggtcgcgtcgcacgaagccggcctatctcgccggacgaataaggccggcccattaacctggagcctaaaataccctaatcacagagaagtaggacagcgtggcatgcatgcagataggggtgtatgtatacttctactcctacaagtgaaccggagagagaacagaaggcatgctgacatggcacgtcctcagcaaccgtcactgggacccacctctgtcggctttggctgttgatttattatgtgggtctagagataactggaacgaaaacttttgacttccctctccactttagttaacagatgtgccttttatatccggaggccggctaggagggacattgatcagactaaacatatcaagttcagaggagtattctccacttttgcttacatgcaatggcaatgtgaacgagctccttcacgtataaaagaaagttccatgtcaccaaaaaaaggttcacactctcattgaagctaggttaaccaaacattcagtgaacaaggaatttctccaacacacttagtttttcttcccacatcaacttataattcatccattgatcaataatctatcacatatgagtaggtattacgtatctgtgcaatctaaacctatatatgtgtgctcgtgttcatttttactatgcgattaaacactcgagcttggatcttgcaccctagccgtattcacaaaggggagtatttagcttcccctgttgagttccatactccaacagtactaaattagacttaatgcaattaatttggtgtggtagatgttgttaatatttttaataaacttggttaagtttttaaaagttagattagaaaaaaaaacataggtatttattaggtcttttcaagaaaatgcttaatgatttaatcaataggtcatcgggggaaaagaaagcgagggcttttcaaaaacaaatgtagttgtgtttcacagcattgatgattccaaaacctcgcacttgcaaaagccattcctcctttttatttgagagttgagactgagggaggaaaaaccatccccaaaagacagcagcagtagtaagggcctgtttttatctgagtttggtatgggatatttgttcgcacgtgaagaaaaaaactcattaacgtatgattaattaaatattaataatcataaacatgaaaaattgtcttatttatttttaaagatacttttatatagaatttttttagacaaaacacatgtttagcaatttacaaagcaacataaaacgatggagtttacagtttgtagctgaaggaaagaacctggctaagaatcatactgccaataattagagcaggtacaatagtaggctataagctagttataaacatattttaaagagagaaaggaagagagagaagagcagcgggctatagatctgtagccagctacagcacggacttcaagacgtaatgaatgtatgacatgtgggaccagttattaatagtatagtaagcaactattgtatgaattgactattacattggctatagatgatttagagttagtagtggcctatactattaaacttgctcttaatgacaatataaaggccattgttgaaaggaataattgcatatcccccaggggtatttgtctcatcttctatatggccctcctcctccacggcccacaacccatctctgtttctctctcctccgacctctactaaagaagagaagacaacgcctctctcctcactcctcccccactctctctctctctcctctctctctctctcgcccctcgcgccaccgcgccaggagctcgcgccgcgcctcgcctcgccgacgaagacgacgaggaggtcggtggtcgtggtggtctggtttggtgtccatccatggcggggcagcagccgccgacgggaggagccgaggacgacttcttcgaccacttcttcagcatcccctccgccgccgcggccggcgccggcggcgtcggcggattcggctcgggtgaccaccaccccttcccgctcgcgctcagcctcgacgccgagggcgccggtgccgccaggcgcctcctcgacggcggccacgacggcggcaggacggtgagctctccccacctcgccccgtcccccctcggaattcgccgtcgttctgcgcctaggagtgactgaatttgggttctcgcaggaccgggaccccgtgcagctcgccggcctcttcgccccggtgttcggcgccgccgccggagtccagccgccgcacctccgcgccccgccgcctccccaggtcggagccctgaattgagtggaacaagcccgtgtacagtactttgcttggaaggaatactaactctctgaccatgatttggtgtctgatggatgtgcaggtgttccacgcgcagccgaagcccggggagggggccatggcggcgccgcagcctcagcagccaccggcgccccggccaaaggtgcgggcgcggcgcgggcaggccaccgatccccacagtatcgctgagagggtaatgattaatgaaactcaccaccctggctaacgagaaccgtatcgctacagcaaattcgaccatgctgcacatatatgttcatgaacgaatgcttgtgattgtggtagcaaccgagttattttcggtgcctttttcagttgtaacgaagatagcttgccaccgaatttttgcgattacaagttagattatggtgcaagtaattggatgttttaagggacaaggtttgtcttcttagccaagtgttgggcagatattgcggtgaaactgcatggtgtgtggtttaagcatcatcataggctgctcgctgctacaaccatgatgttgtagtgtattggaagtcaccaacttttggccattgttatatcaaattggaaccttgttttgtagcgaatgtgctatgattgtctttagggtatctaataattgtggtttgagggtgtatactccttgtagcttcattactatattactaatagtcattaaagatggaaaggctaacctcttgctggtcccttctataagtttacaggaccatgttatttttaactgcattatttttttccctagaagttattttccatattcttctaggtattttctttaacttccatctgttcaatgcagctaaggagagagagaatagccgaaaggatgagggccctgcaggacttggtccccaacacaaacaaggtaatgatgcatcacattttttattgacattataagccaaagacttgcaagtttcaatgcctgccatcgatggaatttttagaaagtggtccagggctatcatgtcctgataactgaggttttttcattgcttttctaattctttcagctaatgaacagggatatcttcagaacagatgatatatatccatttgcaacattaatgtgctgcttgaaataacaaaaatacttgccctttgggtcactgctatgtgccctgtgattttcaattatttgaaaactgcaattgatctagatagagtgtcactcttctgatgcaaaagaagttaagttaaaaattgatgtattatttttaaattatgcagacagacagggcagctatgctagacgaaatccttgattatgtgaagtttcttcggcttcaagtaaaggtatatatgttttatctgtactatgtcactatttcttataacagcacatccataactaacagctaatgtttatatatgtttgacatggataattgtgctataatgttaggttctgagtatgagcaggctgggtggtgctggtgcagttgcgcagctggttgctgatattccaatctcagttaaggtaatcttctttttttcagatgtaagaccttctgattatggacttttgcaccagtagattattatgttgaactcatttcaattaagatgggtgggctagtcacgataaattttatgtatttgtcgcttatataaaacatgacacatgatcagtatgtttagatttcttttactaatgtcaatgtgctgctatgtgtagtttatttgctcttcttaccttctttctgccctcttatatttatctagatgtcaatcttctgaagttgtgtagtttctttgctcttctcatctttctgccttcttattttcttttttgttgtgctttcttttgttacattatttgtttatatgtgtcagcatacattgctagggttttctgactgtcggcaataaacacaattttcgcttgcactaacaagtaccttatattttactaatgagttgagtagttcaaatccttagctatattttgtaggtctaccaaggaaatacctatctcatttatattgttagatgcgactcttgtcatcaacaaaacttgaaagcatggattacttaacactggagactactaaatgatactacaatacaacatgacagtaattctttcttgaataatcatgttttgtcttgtgccacatttgtttgcatgcccttgtccgtcagtcacacaatatcgttgatctttaaactaaatcttgcttgaatggcattagggggaggcaagtgacagtgggagcaaacaacagatttgggaaaagtggtcaaccgatggcacagaaaagcaggtagcgaagctgatggaagaagacatcggagcagcaatgcaattcctccaatccaaagcactatgcatgatgccaatctctcttgcgatggcgatctatgacacacagcattcgcaggacggacactcagtgaagcctgaacccaacactccttcatagtatagtaacaataacactagcatgcacacctactactactaggcgtcgacctatccaaagtgtaggatatactggacattttgatttgctaactggaaaaggcctaaggatcctctcctcaaagtagtacccatggtatatgatgtcgtctcctcttttcttcttttcttcaaaggtgctttgattgcaaagatatggtaagcgatgttctcatgctcctacatctttcaatgcccctatcgagtgtgagtgatgggtagagctaccaaagagtctggcatgcgctcatatcatttccttttgggtctgtagtgcactagccatacactttgtggtggggtcggtcagtcttttggtagtggacgtttggactaatgaaaagaagctgatgtatgtgtgttaagtctgcacaaatggttgacacaatttaaaagaatgttcagatggaagatgatgttgacggtgaatggtggtgctatttcttgtctatttttccaaagcggcaacggatgttttagtcaatggaggcgaagcgtgtattaatctggttgctagtgggagcgtgctccttatgtgctttacttttctgtctgcaagtcatagtcttgataagaacctgccctcttaaagtttttagcctcttgtattattggttcactcatgaaactatatatatcatctgtgctgacttaacatgtgttaaggatttgtactgccatctttgttgtggattacagctgttcttgcactgtacattgccggtgatcacacggaatgtccaggttttctcttttgagtttacttgccactgtggttgtcaccaatcatggatatttgaacgtcgatggatgtttctgggttattgacttactgttgagtaccatgtcaggattccactgctggatagatcatatagatcataggcaggtcataaagggttgtttaaatatgttgcccctcttttttcctaataccttgagccttactttacaaaaggcctgaattgtttggcacaattatttgtactacttgtattaccattgaaaaaagaattgtatccagtgtatattctacttgtctgaaacaagtgaaaatactggcaccttttttgtacctttccagattgccattgcatattttgccgccatttgcgcatgcaagcttctttcgaattatgttggagaaagataacactataacctggttctagtgctgctggtggtccaggactccagatgtgaaattccattgtttgatccagtgtgctggtgctgtattaatctttttgacatatgcactttgtgttttaacaagacaacaatatcatgtattaaatactttggtaatcatgctcggctttttgcccccctttggtgtagaaaagctcaaattgggtgctttaatttggtgagcaatggttgttgttagtggtggtgctatgttatactacaacactaatgagatgtgcctggaaaggtggttgattgatttggcattgctttgaacttgaacctcctatcagtcagcttaaagcttcttttttttttctctacattctgaatccttcaagaattgtatggacaatgtgatgtgcagatatttttttctttttcattatgttctgtataaacaatgtgaaggaaattatagctggcatgacacattgacaattacaggaccaaggttgaccggtttgtcagtgaaactacgaatgtcaattataatattcatgaaaaaggtttgaattcagtaatcagatatgaaactcaaaagaatttgtaggatttttttttttgcagaaattggttaaagttcagcagggaaccgaaaaggatatcccctgtttgccctaaaggtaactcctggcgagctctcatgatgttcaattgttcatcatatcataccacgcttggtatctgagctttggttgctaccgcttgttgcttgcgtcatcttgcagcttgtgcttctcgcaccctgacgtcatcttttggattaatacagccatgcaaacgagcggtgcgaaagaacagcttcaagcccttcagctttgcctgaaagttgatatttcgcaatctgtcaaaattgccagggattgcattttgtttacaaaatcctaccagagaaactgtcagatgtgtttgaaaaattgtatactgatgtatgtatgcctcctttttcactattagccaaatgctcgcgcttttcaattgagtattgaaaacagcaaaattaagtccttgttgaaaaaaatatattttacattggttgaaacacaacctttcatcttaaaaaaacaaaaaaaactgtcatgcttagaaaattaaagatttgcaagttatatagtttgaatgactccccaaaattctaatatcatgacccacatgttagttgtggtggtgatggccaccaccatcaccactatcttttaatagtagtatggatgtcagagacttttaatagtagtatggatgtcagagactagctgtgcgtagatagaaggctgaactagtaaaatctatataaggttttcatgctatcctctatttcttaaaatattgaagtgccttcgaggctgccctacttctgtatccagccctgaagacaagtttgcaggattcaagcatgatgcttccccccacccaaaaaattgcatgtgttgttccgaagcagattaggcatgtattatatgacgaagttaccatggtctccactcaaatcttcagatcagaagtatgttaagaaaataaacttgagatcacatcacacttcacatgtattgatctgcagtttgcagtttgtgctccgcatagctccgtgagatttcctccagttttaacacccaccaccaccgtcactttagatggtaattagcaccacaagatggatacatttaagtgcaaatctcgatcgatcgcgcaaacaaggaacatcgccgaatttgcaccctcgatttgcaggcgattccgagattaatttcgatggatgcttatataataaagcagggtgtgccatgttgataggtaacacggtatatctctcctcctcgcttgtccagccagctactagctaccgacatcgccggacgacgacggcgccgccggcgtcggagctcgatctcgccggcgatcgccatggacgccggtgacgacggccgctgcggtgactgtgagtcggtgtgcgacccgtgtcccgtgacggcgccatggatgcatttctttagggtacattgttttctttgtttgtttgtttttggtttttttgctgcctctacagcttatcaaattacttccctccgtttggcatttcactcaaagaggttcttttgactggcattgttctagtttgaccgtgttatcttttaaaacgtggtgtgatgatgaacgggatttatacgtctacaactttacagtgtaatatactttattaatatggtttttttcttagtacttataatgtatttgtataaaacggggatgatcaaactaaaaacaatatactaccaataaaagtgtcaattatgaaacggaaaaaattactacctcctccgtctttatattataacgcttattttgttttttattacaaggtgtgttttctttcgttaagataacaattgtttcattaatatattgtttatgtgataaaaaatacaatcataaaaaatataatcctaagtagtttcgaatacgaaataataacattaatttttatgtcataaaaagtataccatgacaaagtaattgtcggtcaaagtcttaccctaacgaagcaaaacacatcaacatagtgagtagtatcttgtacatgaacatgctctggcacactggccactgacaagttaactattaccttcgtttttttatataacaatgttaaacttttcacataattttccatcactcatattatttaaaagttatgtaaatatgtaaaaatataagttaagcttaaagtttatttcataataaaacaagtcacaacaaaataaatatcatttatataaacttttgaataggaagaagaatcaaaggttaaaaaccgcggcggacgagatgcgcgctacctgccttattacagcgtcccaatggcgcaggcgcctttcacaatcccaatatttgtgttttgttgctgcaagcttgaaaacgcagtcaggagcagcagcagtacggtataattagcttagttagcatcgtcgcttttcaagtgatttcaggaagataatatctagacgtttctgcttagtgcacgtatggtcaactagttgtttccccataatcagttaattcctgagaaggtttgtcctcggttgaaattctgtttaagaaattctactccctccattccaaaatataaggcacaaccacccttaacctaaagatcaagaaataattattatcatcttgtagtttggatcatcctcataaatataatgtatgcatccaatagaattagataatataagagtggaggatttaaaaaagttataatttaatgaagaagatgctataattaattgcatgcttgcatgcatgtcttatattatggaacatctatgaaaagtggttgtgccttatattatggaatggagggagtatcaattattgagaaagttaaaagtcaattcagtcgcaaacggatgctggtattcctcattacctcaaaacattgaaacacgccagaaacgttggtttgtggttgtggcaaaccaatatttgtagggcactgtaactttcataaatataataataataaacaacgtgcaacgaaaaaaaaacaactctaaaggtgtaggttgaaacttaaccaattttttttttaaaaaaaaaactcgatcaaatggaagagacatcttctggtgctcccaatttacactgccagaagagtttgcagaaaaaaacattgctggttgagtatgttaccgaccgcagttatctgaatgatgtgcacgaccacaatataaggatttcttctataatttcaaactaattgctttcgatctgaatatttgccctcaatttgaatctgctcagagtatttaaggttagcacatttcatactgagtatgttgtgcacgaataatatttttggtcagtgagttgagggaaacaaattccatccctgcacttgatattcttcatgtccagttgcaggttgtggcacaacgaaaacctaaagcacatgtgaatgccgactgcccaggaatttggctaattctcttcttaacttcaaatgaaatggtatttttcttaggctgtgtttagttgacgccaaaattagaagtttgtttgaaattggaacgatgtgacagaaaagttggaagtttatgtatataggaaagttttgatgtgatgaaaaagttgaaagtttgaagaaatattttggaactaaacacggcgttactgtatgagttattactactcataataatcttcagtttaaagtaacggttatagtattagtcagactttatctaaactcatggttaaattttatcaattggctttgtttctctctcttttttttaagataatggattatattaaaccagccctctacatcttgtgaaggtgtacacagtctaaaagtcacaaacacacataagactctcccgttacatgggtaaagcataaaaaagcttcaatccttcttctaaagttccacctaaaaatagagaagctccatcgtacgcttctccaaaagcttgcgcttcacaattactttaatgatttcgtcttccttaaaaagaaagaccaaagccttgctaacttatgttatttttaccacaaacatgaatattatttgagagattttacagtatcatattttcactttctaccgtaaaatctggtatctctcaattagaaggtacaaaaatttgcaatatctctcaagtactgtaaaatatttcacgttatttttgttttccctgtgtgagagttcatgggacttgtgtggaggagcagtaatcagttcctttctgcggaacttcatgacatgcaaacatgatgtgattatcatgctgtttccttgatgtctgattcatacttatatttggtaaaatttaataatttgacactctctttgttgccactctggttatattaacacttctgcccatgacagtgggccatgatatcaaataatcgaaatccagttcgtagagtgtcgaaaatcgaatctctcgttgtatttgtggaattgttttagacatactaaaattttaattgaaaatttaaaaaatagaggttggttggctgaaatcagaaatttaacaccctatcgaacaatcaaaatttgacaagggaacggccattgtttgataggatctgcacggtaatttttctttttttaaagctgatgcatgtgcaattgtgcatggtctgattttgcatgtaggtaagcagggcctattgaacacccaaagttcgatagggcaccctcatgcatgcatgcactttttttatcagaccatagccctatcgaataatcgtggttcgagaatggttgttggacagattactaaacttgtggttttagccaactgacctatattttttaattttccattaaaatattaatatttctaaaaaaaactccacagcctaatgaaggctccatcaaaacatcacgtacgccctccgttctaacttctaatgatcaaaatatgtcctagcaatttcttcacctattccctcatatcaaacaatcacaatcatctcttatttaatttatccacctaatttctcatcttaaccaatcactagtcatgacatttagttacatctactttcttaatcaccatacaaaacttaaaaaaccttatattttaggaaaatgggataattagtagcagtgtgacgtaaattgcaccccctgaaaaagcagtctcatgtgtgatttctgcgtgtttgggttcttcattgttaattcctcgctgaaagagagaggctatatcccttcaaagtcagaagtacatgtgatcaaattagggtggagtggacccaggatttcgaggttgtatatgcgaaatgcgaaggggcaaaaaaacattgcagccaaaagcctaatatttggcatgtatgtcacatagtgctaatggtataatatatagcatacatattgtgtgctaaatatgacacttttttttcatacacaatatatatatatatatatatatatatatatatatatatacatacatttttttaatcaaaaatcttgggtattcatatcaatatccatgaattgagttgggcccgcccctggattaaatgtttcattcacacatatgtggaatgcgattgacacttggaattcataagtgatgtgttaaccattaagtttattttctcctactacgatgcacgcgctcatgctcacccactacgctcttgtttcgcacacatccatacagatgcctgatatcactcatctacaacttaaaaaggctagaccacattttagtatcctcttagcatgtcaggcaaagcaactaatcaaaagtaataccgagctaattgattcatgtaataacaccacttgacacacgttccttagtcacgaaacaatgcaaatccaagccaatcagcatgggtgaatcgcggttgttgatcatcaatatcaagaatcgtcgagttgcttgcctcaagccctcgatataaagctggggttaagaatgtgaagtcatgaatgcatagggccaactgtccacacatcgaacatgtcgacaccagataatacaccaatagttgttcatcgatcatcctagtagggttttcaggatcagaaagtatattttcctaggaatgtttaggcatcatatatttatttacattcataaagttttggttttttacatagccaagctaggatacctggatacggctgtcaagcgacgtatcagtatcagatacgtgaacagatacggatacgccttctccgataagcgccgatacatacgggatacgtatctagcaattttgtgatttccatataaataaaacaaacccgatacgtcactaatacgtctgatgcccaccactgaatctccttccaggcgcagggccgccgcctccagacatagcaccttccccgtcgaccgtcgtgcatcatgccccgcctggctaccagggctagagccgtcttccttgtgctcgcttgaggcacgcatccccacatgattgctgcaggtttgtagcgctgctaccgccgacgccgatgaatgctgcagtgattcatctaagcaaagcatcaccaccaccggattagcagacgaaacgccatcgccagacaacacgcagggcacgacagatgccattgaatgattgagttgttgaccccttccgtgcttgacctgcactagtttttgctgctccaatttctattttcttagtacaagtgctatatcaatgtagatccaaatcatccgatggattttatatcgaattccaagctagtgtatcccggcatccagtgctcctacactcgaagaactagggcagctgcaaaataataatgaaaagaagcctcgctggattggattgtggcagacaagagaagtataggagatagcactttttttttgtgaataatcagcagttagcagtcagtccgcaagtttattaatttttctgtgaacgcattggttttcacaatttgtcaagagagtttattagtattttattttttattaaatatataggcatatccacatatccatgattcttgaaaaatgccgtatccccgtatcgccgtatcgcgtatccgtatcctcgtattcgggtaacatagtagccaagagcatttgcttaaaccttttgtcttactatgtcatgtactcttgtaatccaaaaaaaaagaaaatataattctcacaaggtcttctattcctgaaaaaaaaatcctaattaacagatagaacatgtaatcttcaaggggatatataaggagatctcgttgcatattgatacgaattcaatagaataagtaccaatagatacattatgaaaactttgttcaccttaagatatgtataattcacaaaattttcatcatcaatactgcatgtaccttgaaccaaaatagatgcaactctcttaatgatgaactggcaccttgaacccaaaatagatgcatctctcttaatgatgaactattatgcttctcgatatatgatttttgccatggtaggcctacacatatatagaatatcaattatgacatcttattttaaaagccaaacgatttaataacgagtgatctttaataaataacaattaagaagtgaactaactaaattccatacaaaggcatgttcaggatgagcacgattcatatgatgatgagtctaatttgctaaatttccataggttagcaaagggaaggctaacggggcatatgccccctcctcgcggatagaaaattggaggggcatgtgccccaacaatggcccatcctcgcggatagaaaattagagggcattgtccacaatagaacaacctggagtatttaaaagttttttttagaaaaatgaagtagagctgcacatgacctatagtggcgacatgagaacctaagggctggggaatcgatctagtaattggggaggaggggaacttaggtatagagcttatatatatatcaatttggaatgggttagctaggctctaattattgtaatgggcatgagaaacacataccccgggaactcgcagggtcacccacgagttcccccatcctaaccccggaaatttgcgggccccgccccgcttacccgcgggtgagaaatctccctggccctagccccgtcggagaaattgccacccctaacagtccctaacttagcaattggagttagaatacaatggatctcaatatgaaaatttgtttgatgctaataaatttttggtcttccaactgcccaaaatttgctaggctttttgagttcattccgaccatgctgtgagcattgaaacgagcaacaactacgctcaaagatttttttttttttgttcttagggatagtataaaaagattgtaagatcaggtttgcttgtaccaaaggctatggatgatccatacagttggaaaggctttatataattaaattactagtagttgtattgtccacctacaccaacacactcgtaccctcaacatgctcgtacactccggcatcaaagagaaatcgagctacaatttggtggtgttttaaaatgaatatgaagtaacacacgtaaaacgagaaaaccattagcatatgattaattgatatttaattattgcaaacctgaaaaatagatttcactacactggtttaagtcatcagtaacagactcaaaccatcaccaagtcatcagtaacaggctcagatcatcacctctaatggactcagagataagtggtcagtgatgactaaactcatctctaatgggtgaaggtccgtaactagtatggatgactaaactcatctctcacgggtgaaggtgactcacccgtgatgggtagcacaatgcccctttgactggtggcattgcaacccatcacaggtgactcacctgtgatgtgtagcacaatgcggcttgtcaatggtgcagattaccaatgaagaaaaacaaaatatattccattctatttctcattgcagttgcattcatctaaaaaatttacaaaacacaaaaatcatcacaatcacacatctgggaatatccaaacactcattcacatccaaacacgcatggcatcacgaaatcaacacgaaacgcatcaagaaatcaacgagacttgttgttgacgatgaaaccctcaagccgcaatgaaaaacttgtcaaagtagtagttggtcgccattgccaagctcgacgccgttggagggagtcaacaccgatggtgctgaggcggttgtcagtgcttggtagtctgtggagtcgtgcgaacgaagcctcggcggccggcaatcggggggagggatgacggttggcgatcgaaggagtgcatggggaagacggctcccaacggtcgacgacggtggtaggcagttgaagtaagatagaagagagaacgggtgacgggaggatttttctttatttttaaatcatcactaacatgtataagaattgaagacgtttgaggtgaggtatctcacctatgacgagtgcaaactcaacacccgtcataggaaagaggtcaactgtgacaggtttgtatgtgggcttgtcagagatgttatgtgtttggtgcttatatagatctagcatatatgagttcttatccatgacaaaccattttcttagcctcatctacaacaggatttagttttacccatcagagatgatatcatccgtgacgggatattttggttcgttatagataggtcatcacaaatgggctgatctgacatagtgtttatttaatatttgaaagcaatttttatatattctttaaaaaaagataaaccaaaaccaggtaaaatctacatctacttggccgaccgaagacgagaggtgaacttgtatgggcccacatgtcggtgaaccactccgatctcacgaacaggaaactattatacattgtcgaggggtcacctcgttgtttgcatatcatctaaatggttatgtaaacatttgaaaaaaattcaataagatagattaatatgtgaaaaaccactccacaaatatgcaaggtcaatttttataagttgcaaaaaaaaacatatttgactataaatatacgttaactagttatagttcaatttctttttttttcatcttctaaaagttaaaatttaacttatatgttcatatggattgatttattatatattaatctatctagttaatttattttcataatcattcgaatgacagaggacctcgagagtcaatcgacttcctctcacgaaccgccctcgccaacctccggcgccgccgtccgccgagtctccgcagagcaggcgtacgtccacctcgagcctccctcgcaccgctctcctttgtcctcgccgccgcgcgttccgcgacgcgcaagcacggtggtcctcctcctcctcctcttcttctctccccagcgtcgtcggtgccgatggcgagtggcgacgcggcgggtcccaggccgaggaacgcggcgtgctccgcctccggcggcacagggaactgcagccctgactgatccaggcacagaacgccgggcgacatgatccccgtgaagctttgccacttttgatctgaataatatatttttgtgttcatggtattcctgaacagctccattcttggcacatccagtgcagagtttgttgtgcacgaatagaggtggtaaacaccgattccatcactgtccgtgatattcttcacagattccatcactgtccatgatatattcttcatgtccagttacaggttgtgaacttgtgattccttcagggaaaataaaatggttgcaggcacaaccaaaactgtaagcatatgtgaattgatattgcctggaacttgggtgattctcttcttcttaacttgaaattgaaattgctattgagagaatgtttttgtgcatcccttgactagttaacttttctgtagtactagtttacgggacaaaataatcttcatttttatggaaacagttgtagtcaacatgaactttattgtttcccttcaacttatgttattgttaacacaacaagcaagccattttaatttgctttgccttgtgaacccagttcatggaccttgtgattttgaggaagcatcacggaacaggaatcagttccctacaccataactccatgacctgtaaaccatacattgattatcgcgctgtcccctagatgtccgattcacacttacatttgtgggtctaatgacagatcgtctctatcaagaaaagcattgcaagtttggaacggcaccagtaacatggagagacattttcaccttcacattgccatcatctgtactgctgccctgcatgcttttttctttcagagattaacatcaccattacagtatcgttttgcttcccccagtgctgatcaggtcacatggctcctcttaacctctggatctctgatcatatgatggcaggtggtcggctgtcgttattttcagtacatttcctcactgttgcagctgcaggccatggctcgggcagcgtgatattctggctgcaggagaattcctggaaggtggggcaccagccagccatgcatacgcatcatcttgtcctctgaataatcatcatcgtcatcagctgtgatactatgtgagtatttttgacagaattttttttgtgtccttttccttgtcttgctggtgcagagtgcagactgcatatggtgtggcatgaactgctcccctgaggaagcagcaaggcagcattgcgtggctttctgtgcgtttggattcttctatggagtttttatttattttttcgaggtaattcttccacggagtttgtgctgattcatccgtgcatctgcatctgcttggttggcagtgtgggcaggcagccaggcaagggccttatcttcttcagagtttgaaccaatggcctgcaggttaagcacttgattggtcttcaaggcataaatcttgctgaaattaatttacttctttgattagatcaccaataagatcaaattgtttgtgtgtgtctgtgttcattcagatcaggtatatagccttgacatgcctttgatcttattcagatctgaataaggaattacctctgatctgacaaatactggcttggtactgtatttatgatatgaacacagagaaacaaggaatctttggtgtggagaaatgaccaagcttaagtcaaatttctcccttttttcatattttccagccttcgctcatacagtacaaaactcaaactgaaaaaagaaatgagcctaattaaaagactatatacacagttcatacatcttgtccctcttggattcagaaacactgaaacaaggcagtgcctaaactctctctgtacagcaacgaagagcacaagccatcagggctcttctagtcctctgctcccttcttgatcccattcatctcatgccatgtgattcatgatctctgattcatcatccatcttctcatgtggtgtgtcctagcctgtgatttgtctcctttgatcatccatcagaccatcacctggcttcagagcccttcatgatcctcaacttcttgcaggaagagatgaacattctgcaaaagaaacagagcaacctagagttagatacagatctgaagaaactgataacatgtcatctgaatattctgaatatctgatgatgatgatgatgatgatggcacttactcccagggcacatctccaacaagcatgaggtcaccgtccttgtcctcgtaggcaatggcgaactggccatcgctgcatccgtcagaggcggttgcagagaagcacttggtgaagaggagatccagtgcctccctcagctccctgtagcccttgcacatcttgagatcaaccttcctcaggtatggtgccccatccatgctcaccttcacatacagccctcctccctgctgctgctgcttctgtttctcatcaccacccttcttggttgcggcggcggcggcggcggcctgatggaaggtgttcctccggtatgccctcactggtggccatcctaccacctgtgccctgaaccaaggagaattttagccatggttagttttgtgttgttgttgttacaggtgtttgtgcagggtcagggggttgtgagcttacttggccggtgcggcggtgtcgtcgtcgtgctcgtcgccggcggcggaagttccggtgccggaggccatgctgtccgtgctctccagcgaccgcttcgccccgagggacctcttcgccgccgggtcggcgccgccggtggtggtggtggtggtgatgctgcttcccggcgggccgaggcggaggcagaggttgtcggcgtcggtctccgcggcggaggcgaggcagctggtgctcctgagagaagaagaagacgccatggctagctactgattttcttgagagaaagaagaggaggaggaggaaatgtggaagaggaatttggaggagaagatgagatgaggacgaagtggggagggagggggggattggttttaaatggtggcgcgcaggtgtgcatgtcgcgcggtcggggaggccggtggggcccacgggacaggcgggccggggtggggtggggcccacgggccgacaggcgggccccaccggctttggacgggatgggtggtgggattccctgccgggtcgggttagttggctcgcgccatgtgaccgacaggtgggcccgcgcgtcacgcgtgcggtcggggccccgccgcccaatgggcggagcacacgtggcgacggtgggtgcggctcgcgcgtgcgggttcgcgacgctgtcttttaaatttgtgattttttattattattactccatatgtctcaaaacataaacattttagcatggtgcaaagtcaaatatttataactttaattattaatttaaaaatgtaaaaaaatattaattatataaaattaatgttattagatttatcattaaacaaactatcacaatatgtaacttttttatttaaaacatcttaaatagcgttgattaaaatagtatcttgaaaccgtgccaaagtctaaaagtgtttatattttgggacagagagatattatttttcgtttgttttgatttaagttgcggtgctgtgttagtgcagtgctttgtgttaatttttaatcagagtttagtcaaatgatgtggacagggaatcgacacgggaaatacagttagatgcttggagtttccctgtatgcctacatgtggctcatttaatagtgggttattcgattttctgattggacgcggtgctcatcatggcagacacagtatgggcttgttattttattcttctacttgacgaaaaaaattatatatatcatgccaattttcagttagatgctgcttcggagaactgatagctacttacaagttgataattcgtaatgtatacttctgtatgtacagaggtccatttgttataaaaggaaaaggtatacctaactcactcgaattattttgctggagtaagtagcaaataaaaaaaatcagcttattttaccacctaaaatactctaaagcagattaatatgactatcaattacttttaaaatatttaatttgcacagtagaacacaattcattagtcttaaaaaatacgtcgataaaattaatttttacttactgtaatgcattataatacaaatcataatcaaagataaattttgaagactgtattattgtccaaaacgttaagaattatatataagactgaagggagtgtgtctttttttctctttataaaagcatgtccaaattttataaaaaaaaatatgtcaatagtcattttcaaaatttcccatggtagttgtgtgcttaattccatcttacatgtttccagtatattgtgtaatagttactaaaaattcaaaaacattttagagggttaaataatactccggtaaaacattttaacagtagaataggcttttttccgttacaattcctctacaacattatgcagctttggactcatgccacacacatccttcgcacgcacggaatatattggtcgtgttcatcactgccctttggcctttgcgtgtgcacatgcaacgtttccaaccattctggtacaccccatcatcaaatccatgcataataatgatcattccccccgcaatttgtgttcgtcttttcttttgtacttgtagaagttttagcaaacatcgatcatttagttagtagtttgtgtatacaaaaggctagccgaaaggaacctactgacgattagagcaaatcgctagttgattgcatttacaaactttataaagagcacgagcgaaaaatgcagctagtgattaaatttatcttatagttacacaaacatccaaagccagcatcattagtcgatctactactgtctctacatgcacattgcacggatcgacaatattttttcccccttattttaaggagagagcaccttttcccaatgaggataacaaaccaattaattaattatttcctttctactaaaatataaatactccatccatttcaggttataagactttctagcattgtctatatttatatagatattaatgaatctaaacacacatatatgtgtatattcattagtatatatatgaatgtggtcaatgctagaaaatcttataatctgaaatggaggaagtaacaaagaagttaaattaaataagaaattattacgaatggttgagataagtagtggacaaagaaaagataattgtggcctgttaagataaaggaactacgtgaaaagattattaatattttaaataagttttaaacgttaaaattatttatattttgagacgaacgagatgtaattaactgttcaattaggcttcaagctatgcatgcatacatccaaacgcgaagaataatagtttgtcccctcttgcacagagagaacaaaataagcacacgtacactagcttttaactatacgtacgtgcgagctaagcacgcatgaatgtgcgtagctgtcagtgacacatatataacgtccaaattagcattggatggatgggagaggcgaagaaaaatcaacgggagttaatggccggtagctgatgatcaggggtggctaattaggtcggggcttttggtagccgtctcgctgtcacgggcatatatggatacataaacctggctgtgctgtgacactgctgtgcctcctttttcccaaaagacaagacaccatcatgcgtacatgctggcccatcgacagaaaagccagatcggttttatacaactgtgagtgagtatacgttactagctaggtgcctctcaatgctcctaatatcaagtaggcttttatttttctattttctttctttactttttttaagaaaaaaacaaagtgtaggtgtttagataaaacctattagtaatctcagcatcgagtcatcttttttacattcaagtgtaggcttttatattaagaatttatgaaatcaaatcagtcgtcatcggatccggccaccatagattttagcttggctaggggtaaattaatagcatttaataactaactgatacaattaacaacaactctttctacatctaacggagaacgagtatagctcagcaggcagggagccgagcaagctattgcctattgggttgtgtaacttgtgttccatccctcgaataggtcttttttcacgactttcttctctatcaataatactgagttaactgtatgtacggggctacgggcccccatttctcgtcggttcgattcaacgcacgtttcgtggcgaacgtatataacgagctgcaaaatgcgggaaggacacgtgttacgttacagcggcaccatccatgagtgcgtgcattatattcctgatcgatccggccagccataaactccggtgctccacgctttgactccacccatctcgtctcgtctcgtcggcgcgtctcgcttgcccggcccactcacccgacacacggcgtacgcacgtacgacccccccgccacgcgtacgtacgctcgcgcgcgcccccacggttaatggtggcgcctcccctcccgacacataccacgtactacacactttaccacactgtacgatcgagcaccgcaacgtcacgtggccgcagccaatcggatggcgacgcgctcccgtggcgccggatgccggggccgcggcgtacgtgcgatgccgatgcgtcgcgtgtgcgtgcacgcatgcgcggatgcgccacctgccggctaggtcggccgcgctgtggcccgcgcgcccgcactgcgagaccagaccgagtctaggtgagcgatcgaacgatgcatgcgcggtgcgcgcggctgcggggaggggcagggcagcgtgggctccgccgtgtccgaaccgaacgcgatcgacgggtgagatggtggaggcatggagggtggagctatttattatgcgtaatgccatgtacaatacaccgccgtcgatagcggtctcaaactctcaatccttcacatcatctatcaaaaaaaaaatgtccttcacgtcagatccgaacatccatggcggtggggaccatggttctatgatatgtgcatatacaggttacggttgcctcgacgcgcttcagcttgggattgcgaaaccacaactcgggaccatgcgttgagcaacaccggagccctgtgatatgcatgggaaaaaattagaggtcgaggcgaggcctaggacttggtgtagtcgttgttgccactcgccgacgttgtggtagcctcgccactccccaccactgccaaggacttctctcgcagaggtcgtcgccgctccttgctactgaagtcgccgttgcaaatccagcgagttcgtgaccagattcagtgaactcgtggccagatccgccgccggcggttgtccctcggccgtcgcaagaatgggggagggaagaggccggcggccaaatctgacatcgccgttcgtagagaaggaatggcaagaggccgacgagctcgcagcttaatccaccgccaccatggggatccgctgtcgctgctcgcaaagaaaggagggggagtccaatgatgttatcccttccaccatcgccactcgcagagaagacgcggaggagaggctggaggtggaagagaagtgcacctgtggatgcgaagtaggccaggggagcagcgctgctgtggctgaagaggaggtgacaacgttgagaggaggaggtggcattgcggtcggccagttgtgggaatgaggatagtgatgggtaggaatagaaaataaagaagatgacaggagaggctgacggtgggtacatatctagattaggagtatctatatatttctttttgttgttataagatctaaaatagttatttataataacaaatatcataggggctaggggcagacacacaaaatgtatttagaagttgtcttcattgtaaacatcatggcttttgtatggtcttatcctatgtggcaggttaagaccactactccattgttgtcatgccctgaagtttcccttgccagctttaaaatttgtaaaataaatcgtccgaagaaattgttctttttaacctagagatgaatccctaattaataaatgcaaataataatcggaatctacatgtggaattttttcatggattctacatgtcaaaatatgctaacaggatttttagtggaattttcagagccttggaaataattttaaccaattaaaatgaacaaagggcaatattaaatccctggaaaaatcctttcttctttttctttttctttttcctcttttttctctcttcttgggccgtcggcccagtccattcgcctcccgcgccggccttccctcggctgggccggcccaagccgactcctccctcctccctaacccctccgggtcaccgataggtagggcccacctgtcggccccttcttccacctcccgcagtcgaaaccgccgcctaccgccgtcggtttccccgcttcccgcgcccactccgcccgtgccgcacgcccacgtcgccgctcaccttctccacacctcccgctagctcgcgcgcccgcaaacggcgggggatttgctcctttcccccactctctctctcctcctccacttcccccacgtcgccggccaaatcggccaccttcccggcctcgtccgcccctcccgagcccatataaaccatccctccactcccctccaccttttcctctttccaccgctccctcccgtgccctctatcgctcccgcgctgctacacccgccgccaccgccttttccactcctccggccgccgctcgccgccgctggagccgccgccgagccaatccgccgccgccattagcttcgccgccgccaaagctaccccggccgccgcatccccatccaatcccgccgtcggggcccgcttctccccgcgcgccggtgagtaccaccatagctgccgctgtcggccatggctctcgctcgtcatggacaccctctctccctctaacctctcacacttcctctcttagggtgtcctggagctcggccgccgttcgccgtcgccctccggtcgctcaccgtcgccgtttgccgtcgtctcctcccgcgccggccgaaccccggtgagaactccctccccttctcttcctcccgcgcgtgccgccgctccccacatgcgcgtcgccgcgatgcaccgtcgcccgcgtcgccggccgccgccgtcggtggccgcttgccgccgccgccctcgccataaccggccggccggcttgaagccgagccgagccaggctgccttcctccttcccccatgagccgccgcccggtgggccccgcctgccagtacccctccctcctccttgagccgctgaccagtggggcccgcatgtcggcgccgccccaccccttgctgacgtcagccctgggatgaattattgcgcaataaatacattaaggctttttctttattagtaaaaacacagataatcttctaaaaacataactaattcatccgaactccgattaagtccattcaagtctcagtaaattcataaaaatgtatagaatccattaaaaattgttttgtttcctgtttcagtagtcttatagcatgttttgcttgtgtgctttgtttgtcgcgtagatttcgcccgtttcgtcgattcgcggtttctcgaagacgttgctgtggttccatcagtgcgagagcaaggcaagtcatacattacaattgatcatattgtacccaatttacaaatgtcccgcatttctattaaatattgcattgttttacaatatcatgtgggatgggtcctattactcagctatatgttgtttcccttacgccattaataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacactacatggtgggctgtgggtgcatggttttgctagtcgtgtccatggcgattaaggagcggttcacgggatgccctggaagaacttatcgtacttaccacaagccagcgtgggcaacggttgggcttgtagtgtagcttttctctagccgatgtacccaggcgagggtgggcatgatggagttgggtcggccggggtgtccggttgatcggcttccggattcaccgtggcacgaaaggggggctgcccgttgcctgttggggacgggggcgaaccctaaggtgtggtgcgatcggttagagagggttatgcgaagggtcctgtcacggcctctttccggtatgtcgtggtggcatgtcggcgcacgggaacgtgtcatgggactgtgtcttgtgggtacagttgtacacctctgatcagagtaaaactattcgaatagccgtgcccgcggttatgggcggtcgaccagattcaccgtgattagtctcacccctagtttagcttaatgaactggtgtagttcaggtggttggttgggcctgttgcaacgtggtgtagcgttggacagtgattggttaatactgcttaattgctactactgttttactgctttcaacttctgcttttaaatgctagctttatgcaaaagaacctttagcccccttggatatatcctgcatcatacctcctcttccggtacgacttgctgagtacagtgggtagtactcagtcttgctcttttcccccacaccagagttgaagttcttctcagttggagccgtctcagagaggttggttccgtcgctgccgtcaaggattgcctgtggaatggagtcgccttgctgctgaagtcaagctttccggtttagctcgcttttatcttttccgctgcatttgtaatcttttatatttttgtaagacgtggatctgtatgtcaacaattgtcgtttgtgtaccctggctggtcctggacagaggtttaatatacattcagcttagaaattctggttcgtgaatttctaggcgtgacaagtacatgccctaattggctggattcatttgactcgtctcatcgtggacttgatcacgagcaaaatttaagtgatgctctttttaataaagatggagatgaagttaagacacggaaaataagaaagtgaatatatatgattaattaagttttaattattataaatttaagatggattttgttcgtttgaatcgaattctagctattaacatagatcttcttttgtgcagttcccaattcaaaatttcttatagttataagtatttttagctccacaaatctatatatttagatttctatttctattttggattaaattttaaacaactataattcaacatacaaactttaaatttactatagatctaagatatggagttgtgcctaacaagatcatagatcccctattttagatcatagatcccctatttttctttttttccccagctgccagaagaacgccgactgtttttattaaggttaagataagaaaaaaaagtcagattacatgatgacaacggggttattgtgctgcctcaagcacatgcagccaacaattaggggatataaacaaccttagctcgacccagcaagtagcttaaaactcactggcattgtgtgccgcaaagctacggggcgccatcaagctactgctccaatcagaagggggcacaataatcttgccgctcggcaatgcccaaaactcctccataatcgcatccaataccagttcctgcactgttctggaggtctgcgcggtgagaccattaaattcgttgcaattaaatctttaaaacaagaccacacatggatatattccgacggaattttttttagcttattattgaattatttttaaatgttgcacgatgttccactaggtatatcggaattgtttcataaatcgaaaatatttcactcgtttaaatcgagtgttgtttcaccttatataaaaacaatgtttcagcaattagtgaaagaatgtttcagttcactgcaacatttgatccatacatagtgaaacattttttggtggaaaaaaataaaataaattccattaaaagggggtttccaaaatatgtgggttttttgttgcaatgaatatttcagttcactgcagcattatatctatacatagtgaaacattgtgagtacactaggtgaaatatttttggtggaacaaaaaataaaccaaattcccttaatagagaggttccaaaatatgtgggtgatttgttacaatggcagataggagcagagacgcggtggggcctagagcctacatgcagtgcgtggggggaggggcgcgtgggggagcgcccgatccggctccccccgcgccggtcgcccggcttagagcattctcgactttactatattataagaggcagcaatataaggatccggctgctgaaggcagaggcccacggtaaaatgagcatgttgctacagtaaaaccaattatttgtagttaattactcactccgttccattttaagtgcagccatagtttttcccgcccaactttgactgcccatcttattttaaaattttttttaaaaaaaattaaaacataagtcacgagtagagtactattcatgttttatcatctcataacaacaaaaatattaattataaaattttttcaaataagacggacgatcaaagttgagcgctaaaacttatggttgcacttaaaatgggacggatggagtactatagcaatcaatctcatttgttcgtcgtaaatcagacgggctaagaattaccccaaaatcatggcactgtacacttcattgtgtaaagttagaggatcccgatccgtaatatattcacacctatgtggcagagcataacatctatgcaatcgtggcctcaattacaaatatagaacataaactacaagtgccccaatatacatgttactaacatatcgaactcgaacgcgatagtatatattttggcaattggacccgtgcgggcgaaaaacggccctgcgcgaccggatggtccgaacagtgtgcccccaaggtcgtcatcggacttgtttctccggcaatgctcggtttgaaaatggcgggactcggtgacgatttacgactagtcgctttggagtactagtattttggggcgtttttccttgcccatccgcggttgttgtgtcgtctgcttcagttccaccccccaacttgagtcgaggttgttgtcgatcgatcgagctagcgtgcgtacggggcccggccagggcgaacacacgaggggaggggaaagcgcacacaccgtacgctactacgtgcgggggcgcagttgacgggcgggcaatccggctcgcctgcctcggcggctgtagggggggggggggggggaaagagatgaatacgcttaaggaataggaaaaagacggaaggaatgccataaaggacataaaaggaagagaaagaatgggaggtcaggagttgctggagatcacgatatggttagatctcacttccccaggccccactccttcaaggacccaaggagtttttactttgggggccccccagggcattgggggaatttgtggatggaatcagaggagagagcttgagccttggtccttttgggagtgtcttagcctctttagtcaccattgagataggttgcctctggcctcaaagactccccagggccttggggctcttaggcacgattagccttttttcacttaagtacaagcagtgaccgggcagacccagaaaacaatatttagaattgaaagaaaagaaattcaactagctacccaggtggt

SEQ ID NO: 64553 - DNA, 602 bp, Oryza sativa
tacgcatgcatgcgtccatgccatctccttcatctgctcgatcgatcactctcagatagattgattgattttactatctcgatcgagttggtcgccaattcgccatggccagcagcctcattaaccttcttctcacggaggtggccggcatcgtcagcattgttctcctcccccttcttgtggggctaaattcttaccgccgccgttccggccacccggggctccgcttttttttttgggcggcctcacaccttttcttcccgttgtgttcttacgcgtgttccgccgccgccaattggaacgccgcgcgcgtcccgttcttcttcgcttgaaccggtttcctccaaatgctgcgcaacaccatgaacaccgcccgttcgtccccgtcacacaatcggaaacggcagcggcagcagcaagttcaggccctccgtcaaccacctggcaagaatggcctgggtggcgttcctaattgacagcagcaacggcaccgccggaagcccacagctcaccggggtgctcctggggctgtgggtgctcaccctcgccaagctcgtccaccgcctcgttgccgccgagctcgccaagaactcgttcgccgt

SEQ ID NO: 64554 - DNA, 700 bp, Oryza sativa
tcttgcacctgcacccgcagcgtatgcttcctatgtagttacacccctggtcatgttttacacccagaatacagacattttctccataattcctgtgtaattgttcctgcaaggctgagttgcagcaacaagcaatcatatgcaaattttcagtcaagattatgtcatatcagtgcatgattctgtaggcacaagtgcactgcacatattaacccagcatgctgtggcatccccttggctacctccacctccacagtgtgggagaggggtacctgaggcccaccagagaataacaccacaagggcccaccaaacatattgtaacaactcacctccctggtggcctagtggtgcggcagggacacccgccatgctgctcctttgtgtcccctcaggcgccggttccttaggatgcgcacgcagcgtgcctctgtgagatttaaaggcaaaattcaaggactatttaagggcatttctgtgtgtgaatccttgcccgttaaaggtaatcttattgcgagttcctggtgcttctgtgctatatagcttctgttattctgtgatctgatatcctgttgtgacccctgcctgtttttggacgattctgacttctctatcctgactcttgcctggtaaccgacttcgcttatcctttatcccttctgattgatctcctggtttaacccttgcctgtttgactccac

SEQ ID NO: 64555 - DNA, 1271 bp, Oryza sativa
gggccccacacggcacccgcggggcgcgccggaagccggccacgccggcacagccaccgggagtcggcgcgcccgcgtccctatggtcgccggcggcggccataggtacggcggagcggcggccgagataggggagggaaggggcaaacgaatcggcggtccacggctcaccccgggtcgacggcgacgacgggaccggcgaccggagcgtagaaaggcggcggcgcggctcgggtgaacggggtcgacggtgctccggcggtcggcgtgcgaaacggaggggtggacgaggtcgccggggatgcggtgaagccgaaggtggcgacgccgaagcgggagaaggtccgggtcgacgacggcggcagaccggagctcggctgtgacggcggagagagagaccgacggcgcgagctcgattccggcggagatagagagagcgccgagtggcgaaaacggtggaggaaggcacggggagtgtttatatagggttgggagtgagcgaggccggccggatgagggggaaacgggcgcggaagatccggccgccattgatgcgccggcgaggtttagggggaaagattccgaacgaatccgagggagagagggagggaaaaatgggggggaaagagggagggaatcacggggaatatttcccccctcttgattgcacgcggggcggacgggagcggcggtatttgcgccggcggcggcgctagggcacggacgagccggcgggaacggcgggaggaaggggatgacgggtgggccccacccgtcagcgtgggaggcgggcgggcccgcccgtcagcggcacgcgcgcggggaggaggccgaatgggccgcggggagaggagagggagggggagggagctgggccggaccggcccaagagggagagggggagggaaagggaacttttttagggtttttctttttataaaacctttttaactttgtttatttcttcttaattattatttgtgctctgaaaattcaagtaaaatttgagggctccttttagacgaaggagaatttaacaaaaattctccgggccacattcgaatttttctggtacgtattttagtgtttgccaatttctttttgaattttaatttaattctattattccttttagggaatgatttttatttcgggatgaatttatcaggacgtgacatgactccgccgatctttagccccggttcataccaccacccgggactaaagtcccacccctatatatatatgtcttcttcctcctccagcccgag

SEQ ID NO: 64556 - DNA, 622 bp, Oryza sativa
ttcctaacatgttcttctgggatcccaagccattcagtattgctgcacaagtcacttggcatcaaaaacttctcaaagaggtactccatctccaagacctccttgtcaaccgactcttcggctccaacgatggcagctgacagtggcagagaggctgccatggaggacctgctaaacttctttgtggctttgtgacacgggatgaagggggaggattagtgcgaatttgatgtccatggtgttgtgatatataggagagttggacgaacgcgttcccactaggagctatagtagaaacaaagtacaacctggcattttgctggatttatttccacttatcaaaatatatttatttcgtgcttattttggtggtactagtattgacaacctgttttagattgttatctgtaaagtctattggtggatacagggaaatcgcgtaactttgacagcactactatgggaaaatgtaatgctatacaactgtatataatgtgacgtgaacaaattaatttatgaaacaaaacaaatatggggaagcccagtgatagaaatatagagaggccacaaggccatgtgagtcaagccaatcaagccaaacaactcacaagaacttgagtta

SEQ ID NO: 64557 - DNA, 612 bp, Oryza sativa
tttttcgtttcaatttgttatcaatatatattagattgatttctaatctcagattaatttcttactattttttgttgttgttcgcatataactacgcggcactattgaggcgattgatgctggtcatggactcgaggcgtctcagtttccggtcgatcggccgcgagtccactccgccggcttgtcctcgccaccgccattgctgattgcaacaacgacttcaccaccggcctgcctccgtcgccgccgactggtgttcccgtctgcatggctggcctattatgccgccgctgttgggcgtctacgacttcaccgccggcttgcctccgtcgccgctgagtggtgcctccgcctacacggctggcctattaagccgccgctgttgggcgtccacgacttcaccaccggcttgcatccgtcgccgccgagtggtgcctccgcctacacggctggcctattatgccgccgctgttgggcgtctacgacttcaccgccggtctgcctccgtcgccgccgattggtgcctccgcctacacggctggcctattatgccgccgctgttgggcgtctacgacttcaccgccggcctgcctccgtcgccgccgactggtg

SEQ ID NO: 64558 - DNA, 1972 bp, Oryza sativa
  unsure (1)..(1972): unsure at all n locations
catgagctccttgttcttaaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgcaagaatgtcccatcaatgcagagaacaggacgacagttcacgaatgccatcttgcatgcatgtagagctaagaacgccctttacagcacactcttgccaggatgttcaattgaggggaatttcttcacttcgtaagagctcccagggtttctttcctcgataacatcaagcaggcgtggcaaattgtcatatgaggctttgtaagttccaaatctcatctctattattttctgtttggccctccaggccttggcatagctaatagtatacttgtatgtctcttcaatgtatcggattattgaccttggttcatatgtgagattatcgatgacatgcgcatacatctcagatgcaacccatgcacatgtaatgctcctgtggtatttctgaacaccaggtagaaaacatgtatgcttggtaacaactgacactgtccaataattcttccatttccccttatacgcgtgcactctccatggacaacgatctttttccttaacacaccgaacttcatattgcgaccggttcgactaggcaacccaaaactctctatgaagagacactgcaaaatgttttaccagctccttcatatcttctnctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactgtcattagttcccaataaaaaccctcagttgcccgacttactaaaacattgattgttatgtcacttgtctgtggatcaactctcaagcccctcattaaccatccttttatagaaggtacactcctctcagccggtctatcaattcccctttctgatacaatgaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttcttgattagtacaactaaaaccctaaaaatataatgcatttattcaaacaaatttttaaagaatacacactatttaactcaatagtcacatataggatataggatctatgaatattacctgaaatcggcgtctgaatccggcagggcttcgccccttcttctcttctcctcccctctcctctttttttttttcactggaat

SEQ ID NO: 64559 - DNA, 50628 bp, Oryza sativa
ctttgttcgggctttatatccctccatgttcgggtatatcataaagcttaaggccggactcattctagcagaccaggtaagggacagtgtccgaaacaactgatagagttatatcttaacttaattaagataattacccataggaatcccctctatcctaaccctaccatttggtttttgtctttggatgaatcacgatcttagatagtgcacacacgttccctgtgattagatacccctggaatactctgaggtaaagtgctacagcggtatccgtactttgcaaatttatttgtgtgcataataaataccaacacctacttgtattaggatgatagctcaagtatacttcgagctcgagcctacaccctaaagtttgattgagctccactcacttggtcaaagtttagacatgttgacaagtttgtgtgcccctcgtctaacataatttataataacatgctacaccaggacatccatcatgcatttgcgctttgtgtgccattctcttggcattttaggttgtgtcgtagggcaatggagagagagatttagaagaaatgtcaacccacagagtgacattttcatcttttcacgcgggtaaagaatattgtagtaactacgtctacaatggcatgtggtagaaaaagtggtaaatttgtttgtattgatcaatggatgctatgttgatgacaaatattcatttttggacaagctcattgcttagaattgactattttattagcaaatagtattgttgtaaatccaccgtaatttgtgcctttcttttcacaaaaatatggtgctggtgccttgcaagtgcttgcatgtagtctttgagctatatgccatcacaatcttttgcttttctataccatttccagtttggtatacaaagatgaatgcaagtatgtgacatcaagtccgatgtgtgctgcaaggtgggaagcttggacattgttgatgacatgtgggggctcttggatgtgatagctagagagaaagggacgaggaaatgaatggaaagatgaagggtgcatgagagacaagttattaccttgtgttggcatacagtcatgaaatcgattttgtttttacattcaattgaaacacctttgcataacttcgttaagcgttgttgtgttgttgctttgttttgacgtgccatgataacgccatacattctgtctcaatattagtatccaaattaggttataaccaacacaaggctacatggaggaaatttatttatgatatggatgagaataatccaaatccttctatacaacaattgtttttgacttcattggggctttaggatttgccacttcaaacaatgacaattcaagatttgctaatatatgtctatgacatgtgggactaaggttaaaatatgagctgcgcggtgtcaaatcttagaatgccacttggaggagtgtcaaatcatgaaaaaattccattacatttttctcgtgaaaaagggctaaatttgaggccgttagatcagagatcgtacgactaggatatagtcgttttgtctatatatacccatatccccctctagacctaatcgctaccactcccaaatccgcgctgcctcttcatctccttttcactctccttctcttctctcgtcatcgtgtcctttctcccctggatctcccctctttctccccacacccctctattcccaataggttgtctagtcggtaccctgtcgctcaactagtgcccctttgccatgcccccatctactccaagacagggtgatatggaggcaactccttggtagctcgaaaaactcaactcgaggtagagcccatattttggatggagaatacatcgtcggaagtggatatgaaaaactcaactcaaggtagagcccatattttggatggataatacatcgtcggaagtggatttgggatgcgctggcttcatatttggtataaggtgtacctcatctccctatatggatcgtggagaaacaaatagaaggtaagaaactcaatctttttctcctaaacgactacgtgatcgttacacatcatttttccatatatctacatataacgtcatcaattccccactcttctattcatctttcttcatctcacaaaattaccttatagatagctaatcatcttgcaaaaatctcaaggaaattctaaccgagcatgctttcttttttcatcggaaatggagttggtattcaccagccccgtttttggtatcctcctccccagtcatgaagtagaaagaaggtaagaatctcaatctttttgctaaatatgtactccctccgtcccaaaaaaaccccaacataattggggatgggacattatctagtccaatatgtccagatgcattggactaggtaatgtctgtccagatgcattagactaggtaatgtcccatccccaactatgttggagttttttggacggagggaaatatgtccagatgcattggactaggtaatgtcccatccctaactatgttggggttttttgagatggagggagtagtcgattggtatatactattatcatttatcatttttctatagaaccaacatatctcatgagtcctggttcttcccatctctccccatctcacaaaattaacttgtaatcatctctcagaatcgtgaggaagtttgaacatgtacaactttcgcaattcttcggtagcccaacccccaccaagcaacacacaaggatttgcacgaatccttacggtgtgagtcatacacggtcactaatcacctgtcacgatgccactacccggaaaaaaaaatcaggctcgcacacgcacacactgcacagaaaccgtgtgatccatccatcgcacggtcgccggagctcgccgcgccgccgggacggagcacggccggcggcgaccaaacagtcacacgggccaccggaccagccgtcaccgaatcgccgattgccggcgctgccctgcaccaaatcgagcgggatcggtcgcgttcgaaagctagtttctggctctacagaacgggagtggtctcagccgaaatggtcgatcgtgtcgacgggaatcgcctctcgaagtcgggagagaagcacaccagtaacaatagtttccaaaaacgaaccaaccatcactcatcgagccatttctccctcgactctcaaccaaaccccacaaatttggtctcgttcgaaagctaatttgagcaactaaaattcgtagaaagaccgcgtcgtgaaatatccatcgtggagagagatatttgctcgcaaagtcggggcagaaacacacgagggaacagcggccggcggctgtagccccatcccgtgggcggaatccgtggcgcgggcgcgtcgagcgatccccgccgtcggatgggttccgatccgacggctgcggtggatcgtggcgcgcatccgcgtggctaatccgtgggatcgcgtctcgaccaatcacagcgcgtcagctgcgtcacccgagtcctccactcgtctccgctatttaagccgccgtcttcgcctccggcctcctcacccacatccgccgccgccgccgcagaatcggaagcaatccgccgcgagtcgcgaccatttcttgcgagtagtagtagaggggagagtgagtgaggggcgtgctgcaatggcgactgaggaggttgtccctgaggttccggtgaccgaggtggaggctgccgcggcggaggaggccgtcgaggagacgacggcggcggaggagaaggccgccaagccggcgaaggagaagaagaaggccggcaggccgccgaaggagaagaaggaggccaagccggcgaaggagaagaaggtgaaggaggccaaggccaagaagccccgcgtcgccgccgcccacccgccgtacgccgaggtactaaccgtctcaaccctccgccgtcgcggggattcttggattgaaatcatcggatgggttttggattcgtctcgatctatcgtttgcttttgcgtgtttggatctgattttgttttggggtttttttcagatgatcatggaggcgatcgtggcgctgaaggagaggactggatcgagctcccaggccatcggcaagcacatccatgccaaccatggcgccaacctgccgcccaacttccgcaagctcctctccggcaacctcaagaagctcaccgccgccggcaagctggccaaggtcaagaactccttcaagctctcctccacccgccctgccgctccggccgccgccgacgccaagcccaaggccgcccccgccacgaagcccaaggtcaagaccaccaaggccgcgaagccggctgccaaggcgaaggctcctgctaccaccaaggccgcgaagccggcgaccaagaccaagatcaaggtcgccgccgcgccggcggcgaagcccaaggcgtctcccaaggcgaaggccaagaccgccacctcgccggtgaagccccgcggccgccctgccaagtccgccaagacctctgccaaggactcgcctgccaagaaggcggcgccggtggctgccaagaagaaggcggcggcgaccaagaagaaggcgtcggtggctgcggcgccggctgctcgcaagggtgcggcgaggaagagcatgaagtagaggtcgccggcgatgatgccacctggattggattgcccaccttttgatctccacaggcgacagcgccattagcatcatcatcagcaagtagtagcagaaattgtgttctgtaaatgcttgttcgtcttagttcgtttcacctccctctaggcggtatcatcatcttctcgcctgtaatgataggatcccatcatcctcaaaaaccataatacaaatatctatttcgtcttaatctctcgtgcatctctttgtgaatcgttcttgaattttgatgctgacctcagatttgcctgtaactttcatgtgccttgattggttgatttggatttgggaattctaccgtactagtagtactgatgggtcgcgaatgtttcatgtgcaaaaataatcagcgattcgagttgtgaaattctttcgcgaaattctttcgctccagggcgtttgaatgctgtagtaactgaaatttgattggggatactggtggcggagtactttatacagttgtccttcggttggattttttgattttgaatttggactcgggaagaacgctcgcttcggaggcgggaaaactttccatttttggtcggcccgtgggccgtgttgggccgaggcccacgtgggagtgggaaggcccacgcaccgcgatgatgagttgatcgacggcaagggaagcggagccggagggtggaggcctaactaaaaccctagggcttccgcgacctcaaccctagttggcttccagaagcttctagaaggtgcccgaggcgtcgtctcggtcgagcgccatggatctggaccccgagggcctcttccgcgacgacagcgacgaggatgacgacaacgtccaggtcgcgttccaccctgttcgagcttccctatcccccattttttctgtggctcgaatcctgtgaattgatgagcggtttggtttcttggagggaacaggagagggaggccaacaaggagatggtcgtctacctcatcgacgcctcgcccaagatgttcacccctgcgaccaaggtgaaattccagcagcttcagcgcctaatttgataaatctctctgccctgtgcgagctcaagtgttgcaattagcgatggatattgggaatgggatgatacatttaccgattattttatctgtgatgtttggtctggattggattgtctatgttcaatcaagttcttttgctaggtagtagttaagcatgttttttctgccatttattgcaggcagatgaaaaggaggagacacattttcatacgatagtgaactgcatcacacatgcgctgaagacgcagattatcggtagatcctatgatgaagtcgctatatgtttctttaacacggtaagactaattaaagaactatgtgtcatcttatatattgctatgactctgcttctattagtcagctagttaatttctttgctgtttaaatctatgatttctacaagtatttaacatccacagtgttgtaagtctacaccacactgttgcttgttagttttaattaattatattttctaagcttgacagatgaacatacttaaaatgtgaaaaaagaatcagaattgccaagtggtaaaaggaagaaaaaaaaagacaagttgctatattttggtaacagtaactcttaattggttgaaaagctgatctgaattttgttactttgcaccatggagattataaatataaatatatgattctcagataattggtaaaataatctatgatattcttatcccactcactatccttagatcattaacaatgtaggatctgtatatcgttatccttatgtcattacaagatatgcttgtttgatctggtttttacataactattgcagaaagaaaagaagaatttacaggaattggctggtgtttatgtttataatgttacagagagagaaccacttgataggcctgatgcaagattgattaaggaattttcttgtatagaaggtaatgtaattacataaattgttcttttctcaatacatgaatgtggtgatgtggtcaaggtttgtgggatatgcatgctttacttctttcatgtactaggtatggttcatagatcatcattgaattgtccaactgaacgcttgcctttcattacttgtatggaatattataggattgacatgtttgttttcttttagcaaaatattctgagaaattgtgaaatttgtgattatgcaatctttcctatcatctatctgtagaatttgtttgggttttcattttcttttgccacatcatcaccattcctattccacctgcattttctagcttacaatttgtgctgccttatatgttctatcttcttctcaaaacttatttaacagactataatgcctagtgttttagaaagtcgaacacatgatctgttatctgtgtcttgagttgcttctctgttcccattaggaacttaaggtttgataatatcatatttcttctgtaaaattgactccaagatctcattagaagcagtacatcactatttcgtattgatgttttatattatatttattttgtctgaaagtccaggtagattgaattggcctgctatacttattgtgtagcaaaattgagcatctttttttgcatgacatgattataaagcttattttgattaatggtagattcttttatgagtaatattggaagtcggtacggaataacttttggatctcgagagaataccttgtacaatgctttttgggttgcacaggcattgctgcgtaaagggtaacacaccactttccctccttcagctctaaaaagcagcatagctttaataacaaattctattagagctttaacatattctctatatacctcaacctgtttttcaggtgcactcaacaaatttaaaattttcgcatattgcgcaaaaatgatgcattttgcaccatttgcattatactgaatgttgatgaggatatttaaatactttaagtgaatgaacattctgctggtggttttataaattcttcagatctgtgaagactgtgagtaagcggattgttatattcaccaacgaagatgatccttttggtggtcttacaggagcagtaaagactgatatgataaggacaacaatccaacgtgcaagagtatgcctatgacagatatatgttcaatttcgtgctgaatcacaacaacataccatgttcttagtggcctttgtatcattaattgtctattgtcttcctacaggatgcacaagatcttggcctgtccattgaacttcttcctttgagtaggcccgatgaggagttcaacatgtccctgttttatgcagtaaatctcttttatcacatattgcgcaacccttttaagttccaacggctaaacaacacctatttcccaggatttaattggtctggagggagatgaaatagtggattatctgccatcttctggtgaaaagtattgctccctaagcatcgatttcacttgttgattgttttctgattagtgattagttgatagttgcagatttactatataccatcttttgcttgcattaccaaagtacggaacaaaagatccatcattgagtggagataacctgtgctacagaattagacgtagcaatgctgtcctctatttttctgtagtaggtggcagttctgcttggagttccctgtagtatattgttaaaatcttcaaagttgaatagcttcctgtctgtgttccagccttttgggcatcgtgtatgggatttaggtgaagtagcctctgggtgtttctcatatgaactaatgttgcactaaacttgaacctctgtatggttgctaattaatagtaatgaccgacttacactatattaagaaacctcagtaatgtctactcttggccatcaatgtcttagtcttagtcatctattaatatgcacaagctactctgttggtccctagtaattttagaattctattgtttgaacggcacagattagcttagacctagttattctcattgtcttatccagtattgtcttctttgaaggctggaggatatgactaatcagctgaaaaaacgaatgatgaagaaacgcaaagtcaaaactcttgcatttgcaattaccaatgatgtttgcatagaggtgaatacatatgcgctaatccgttcaactactccaggtatgctctaacaactggcgatatttacttctttatctctttgcataatgttgctgtgagaatgtatgtataggcttgttactgtgacatcctttttgtaggggcaattacatggcttgattctatcagcaacctgccattgaaggtgattcatgcttcatgacaaagagatcaattttgtgttacttttttttttttggggggggggggagattcggagttataaaatatcaagttttatgcggtactttaacaagaatgtatgtgtaggctgaaaggtctttcatatgcaatgacactggggcccttattcaggatccacaaaagcgcttccaggtgtacaatgagtaagtacacacatgagactggtgaaccaaagcggtgttatttttgtataattttctgggttgggttctgtgatctgcttcttgattgcttcatcaagcgcagaagtctacagttatgagtcatggcacgatcattgtctcgtcattccgtcatgttgttccttttccgtttcagtttgatgcttatatttgtaatccaaaactactttatcatatattcatgcacttttttgcacagcaaaattgttaaattctctactcgtgaattgtctgatgtgaagagggtttcaagtcatcatctacgccttttaggattcaagccactggactaccttaaagattatcacaacttaagaccgtcaacatttatttaccccagtgatgaggtaataacattacttcatgtacttcttaacttcaatcttgaggccctcttggcacagctccggatccaagatttcttggagctgggtattccgagctccacaaatccatggatctggatctgtgattacgttgataaacatttggataaatcatcttgttcccatttaaaattttaaatcactataatttaatacacaaacttcaaatctaccgtttgagttacagtttgaagttatactagtacaattatctccttcatcttaattttttttgtcaaacacgcaggagagctgcgtagtcttgacaatattttgttatcttgttcgtttgttccctagattattgtacttctctagcttgaagcaataatataatagttgaaaaccttaatcattttatttgatgatattatttttcataataaaagatctatttgtgttcgatacacatccctgctgcatgctacttccaaactaaactaaatctgtctgaacatatttaggattgtattgtggtgtatgcttatttctttctcagtctttacttaaatctagggtgcatgttaggtttacctccttttgtttgatgcagcaaatatttggaagcactcgtgttttcgttgctttacatagctcaatgcggcgtcttggaaggttaagtcgacttattatatttctgccataatttctttaattttgaaagggtttagaaactgacatagttataaatggacataatgtatgtcaagtcataaaatgtactgtggattaaattaattaacattactgctcattttttgggataattagtgaggggatgcaattgaaaggggatgttagttttgttgaaatatcactctatgcgatagttatctcaaattacagctcactagtaatatgcccgtgctaaatgctacggtccaattttatttgtctttaataattttcaaaacgtcatgttagccaaaaaataaaaataaattatatgatctgagctttacgtacatcaaacaattttcacacataacacatcagtctcctttagatgtagataactcaaaataaacacataacacattagtttcctttaaaaagaataggcaatcgaagaaccatataatatagatagaattccttgatatgccaaaggacaaaatagctgaaaaaatatatgttggctagcttatgaaatgccacaaaaacagaaatctaactttagaatcaattaaataaagtttgcatatagtttgagccagaaacatcaaatagtaatactcccgcaaatcctaagatatcatttgaaaaggatgtgctcgagtgaatagtgatacaggccgccctccgaaccttctaaatgaactcaacaaagcaaaattacttagtggtttcatatttaaccatacaaatagttaagccaaggcactgtcatgttctaatattcagattagcattcaagtgtccatataagccctaacaatttattccacttatacttaaatccaacccattcaactcacgttatacattggaaggaggaactacatagagtagagctctcagcgttggtgggagattacacaggaaaagataaagctaccaacaaaattcagcaaccttaggggattactgaaatgtgtcactctcgccatcctccggcatccaaaatctgctctgaaatcctctgaattagcttctaatagtgatctcctcatggaaaacccaccttttagaagcagaaaagagctatcaaagtgaaaagagtagtagttattatttctgtcaagtacagataaccaagaacatatttgttaaaattgtaagttttatccatcgagacagaacagaaacataaataactgaaaagttggactcttgtgcatctgtaagatttgagtgaataaacactaaggatggaccatagcagcaacttgcaaagcacaggcttttttagctagtttatgcaaaggtactcaagtgtccatagaagccctaatgatgcattccacttatacttaaaatggaaaatgtcaactaaaccaaaaccatcgccaattaatgtagtccattaattatccatgctaatccagttcttccataattatgcctactaacataagatgccataagtaattacaggaggcctcccatctggatgacagaagagatagattgcttttagcaagaaaactgaataatattttttaacacaaaaaatcgcaagatacaataaaccagtccaatcacttaacccaaatgagaaaactgtatgccagatggataccttgttggtctggccacaatatagaacactcaagaaatctagaacgctaaagatgtgctcaatgaaatgcgtctgtgctgccaacttcacggtcgcaccagagctgctcccctacatgaaaaaaagaacacaaaataaaaaaagaatcagaaaaaaggaggccacaatttccttcagcggatgccagcttagaacgaaagaggttccacactttgtatccaaccttagtttcactcttgttacgtgcatacacaaacaacattgccttgcacactgcaatatagaaataatagatgaagttctagaaatagatggatttcgttactgcttaaggcctcaacggacttggattcgccggggaccacgctccttgcccgcacttcttcagatcttgttgcagagaagactacctcctgacctcttccaccactctctccgcatcctgcatgaagcagagtatcatgtatgatggacaagatgataatggtgaataatatggttcttatatgcttaccatgtaagattaaatggagatgatgcgggagagagaggacactgggagcaacgtggtcacggtggattgcgaccggcgcccggcggggcgtggacgcggccgaggagagcttaccttgttgcctagatcgtgtcaccgctgtacgcctcccattcggcctccgcatccttgcctcgccgcttactaccgcccgcctgaccgaagaaaatccctcctacatctgccgttgtcgcgtccttggtcctataaccggccaccgcctctgctggcgcaagggcaacgacggcgctagtgttgagggggcgccggtgtgtggaagggctcgagggcgaggtggcacaccgaatccccaggaggcagatatattagcggcagctccagtcagccacggcctagatcagcgatgcgagcggtggtgacggcgacgtgatttgcgaagttcggcgtgatttttgcgcagggagggagggagggagcgcggtggggatgtagagagcggatctgggagatggagagagggtggcggagagccggagaggggttgtgctgggttctggcggcggagcgaatcgtcggcggggagggctgtgcgacggcgattttgcggagggaggcgcgggatgggggtgcgacgtgcgagggcgaggccgtgagggcggcggctggcgatttggcggagggcgaagggcggtgtgcgaaagaaaagggaaaggaaaccgagcggtgatcccgtgcgtgcgattttccgctggtgaccccgcctgctaagttgttgattctgatgcgtcagatctcagcgagataatctggaccgttccatgatgaatgaaagaatgaaagaatgagtaaaagtatttgttgaactatagggtagataatgtacaaagcggcacagagttgtttgaattgttaaatgacaatagaaaatgttttgggattttttgccaatcttgtcattgcaattcactgagtttttaagaaaatgagaaaaaggaagaaaacaggtgttattttatgatttgtaaagctatactgttgttgacatcagggaatatatttctttaagtcataggctcaaatggtttgtttatttggcacctttttctgaactgtaagtttccagtgatgtcacttaggctttccgtcctaatgcaagtcatgtatttgtgacactaagtgactgggaatatgtattccgtcctaatgcaagtcatgcataggcaaaggtcctctgtagcctagtacatgcttatactaaccatgcatatgatatttcatgtggtcattttatatggttacatggtgcatttgaaaacttacaattatgaattgtaccatttcaggtttgcacttgcattttacgggaatccaactcgcccacaacttgtagcccttattgcacaagtgagggattctctccatgtctatattttgctttacgacatttgctgcattcagaattctagtttacaagtacaatatcagtgacctagttaaaacatatatatcaattgttaactaatgggttaatcctactgtgacgttgcaaaagaaagttcttatgctatttggaacttttcgagattgattgtggtacaaacacctgttggctacaaaaaaagaactagactgagccttgcttctttccacatattcccagcagccacctatatattaacatgggtgggaattgggaaaactggtaaagtgttttgtgaaatgcataacatagagacgcacatgcggccacatattttcgttttgtattctgtctgaattttgtttgtcagggattcttattacatagctatatcttatatactttttgaaattgactctggagaaaaataacaggaagaggttacttctgctggtggtcaaattgaaccacctggaatacacatgatctatcttccatactcggatgatgttagatatcctgaggaggtaatgattggcaccgcatccatatttcatcttttcagtaagctaataatttcaccttggcgtgcaggttcatctgacttctgatgatgcacctcgtgccacagatgaacaaattaagaaagcttcaaatctattgagacgtattgatttgaagaacttctcagtatgccaattttctaacccaggtaatcactgcatttatttgaacctcttattcacatcattaccgacagtactacattgagggtctgtttggttgttgcctaacattgccataactcagtttgccataggtgtggcatggcaaacaaagtgtggccaacaatttgttggccacaagtgtggcaatgtttggctagaaaatgagtatatgacatgtaggcccatgaaataagaaagtgtggcttgccacaactgaaacaagcaaccaaacgctaagctaacaatctgtggcatgcctaacatgtggtgtggcaatgtgtggcaccaaaccaaacagcccctgagttcatgtatttgtgaacctatccttcatacataaattctgataccatctgtgagcaattgctgctataatccgtagagctcattgggtcctgtcaataggcattaaagaagtattatgaacactccaatatgcagtacgactgaactattctgatcattgttcatgttttctattttccaccatgaaacagcattgcaaagacactatgggatcttggaggccttagctttaggtgaagatgagatgccagatgtcaaggatgaaacccttcctgatgaagagggcttggctaggtacttgtttttatttgtctattggagtctgctgaaatctccaaacccttatctgttcctctcgaatggaaattattgaataactatagagtcaagcatgttcatgttatttcagacactgaagatgaaagtgcagtctactacatattcaattcagttttacttttttgcataacaacaacgtacaacagtcacctcttgcttatgtgggttgtttcctaccactcttatctcaggccagtagtagttaaagctgtcgaggaatttaaggcttcagtctatggtgaaaattatgatcaagaggaagccgaggcagcagcagcgaaggctggggcttcaaagaagaggaaagcacttactgatgcagctgcagagaaaagtgcagcacataattgggcagaacttgcggatactggaaaggtaagcatgcaggtgctcttaccgatgggacaacaaagtgttctctaggcactgaattttactatgaaatatcttcttaatgctccaattaatctgataagaaattgtcttccagtagtttacccctctatggttctatccaccagtaattcaaaatgctagcttgcagtttgatatgccaatgtattacggaccttgcttatgtatgcaccacagcccaaaaagttttgaggcacataaataaaatgttgaaggctgtaatctcaagggaacaatacagccaggagctctatgctagtaacaattagcaactcatacttgaaacatcgatctttgcctgctttagaatttctgcctagtgatctgtcctgttcagctgttctgctctggaaatccaaatcaaccgtaaccctaatcgtttcgtaatttctgaattcgtaatttgcagctgaaggacatgacggtggtggacttgaaatcttacctgagtgcacatggcctcccagtttctggaaagaaagaggcactcgtcagcagaatcttgactcatctaggcaagtgaaatggtccacttcgacggcctactcagttttagctaactctgtaagctatctaaatttctctgaacatcttgaagtgcctatcaaaaaccctctccctgcttaggctgtgccaaattttgtagcaatatgacaacagctgaccccagttcatttggtatcatgtgcttttgtgacatgtaccactgggatttctcttaaatgtcactccagtctgcagagatcagatcattgttggtagaggaaagtgatccattagagaaagcaacaccaaacaagattattaagacattttttaagtgaagcagttgcaaccataatattcattttgagagaaataggtatgaaactaggaaggatcaaaggaccaaaagtgagagaaagcaagaagattggtacatgaattcacatcaatctgacgtctatttgttgtttttgccagcaaagcatatgcattaccagcaagatctcatataaacataaataaaatataaataactcttaaccttcacatagcaaatatttctatgtatgtacagacaaataatctggaaaaacaaattgcccactttacgcattctactactcctaccaagttcacctaagaaagtcttgtcaaatcaaatcaacaaattttataaccacagacaacttgagcaccgaagcttcagtttgtcagtcaccaaatggctaaacaaataaacaatgatattataacataaaaaattgtcaaagccggtgcagtaatatttattgcagcctgcatagcgcacccaacaagaagaaagagttcttgtcgaggaaataattaatttaatcaataagatctcaaggaagatgttactactaggcaataggcatggtgagattttccttgttcaatgttcgtggttttacttttaggttagaatagtagatgcctttccgtcgtccaatgcacgtgcacgaagtcagattattctcaccttattccctttccacttcattttattttttacttgaactgggctccttacaagtgctggtctgttttagatttatcctaacttaaaacttctttttaaagtctgattaagtttataaaaaatgtgacatcatccacaataccaaattatttaatggaactaattttgtgttgtagatgctgcagtattttttaaatataaatttgatcaaatgtattaaagtttgtcttgactgagaacaaacctaaaactgagatagtttctaagcaagggcataatgatctttgcactagaccatgtaatactatcttacgttaaaaaagaaattaacttgacaactttgaacgtaactgttttttataaatcccaaaagaagttacacaagaataatattacgtctgcttttgttatgacatactacttggttgcatcgtttttatatgtacaaacctatactgtaaacaataatcatggtcaaatttaacttgtatttacagtacaaatgctaacacagcattcttctgtacatgaattggtcataacaccaaccctagcaatctgcttttcgaagggattgacgaattcttatgagaaatccaacaccaaaatccctacttttgtactaaaaaaaagagatcatccagaacatgcagttgctgtagttgtttagctacacaatcattgaacatatgcagaagagtccagaccaacaaaaagtgtgaaattaggcaccgaaacttgcatttctgcaatgtaatgcctccaagatgccaacctgccatacagagaacctcactgcgtcctattcccccaaaccagtgttctctttgctacagggccatgattattgtgagaaaaattcaattatttcagtcagaatggaaagcatgcatatgcctttccaatcctaccacccatggtagtaggttcagctttgatgcttatctgaaaactatacaagccaaccattgcacaaagttgctcttaattgcctaatcattcagatcagtggacctctgtaactctcactaagtcattttcaattcttttcttttctcaaattaaaacctttaatgaaaccataattattggtctctgatgtagctgtgttagaggtgcattcagacttgtgcaaattgcaaatattgcattacttacatggtatacatagtttacatgattaaagtagaattatttgtataacacatgataagacatatgtcaacatctaaggaatgagagagaggatattgaccagatggggacttgagaggacaggtgagcaatacgtgtacatatattatatatataaattttataacttattttggtgcaaataatgcatgcaaattgctgtatccgtgtgtgttcatgcattgcattggaccatacaagatcaccgacttgtcaccataaagtatccttggatggagacccctttctcctctacttctagatgccccatgaatgatggtaagctggcaaatctcatggtatgggccatttcaatcatttatcagaatctagcacataaaacaagtaaattaaacattttgaactaatttgcagggacgattaaaaaacaaacgatgcaataataatcttcgcttcctcaaagaataattcctaggttgatcaatacttgatcaaagttgcccacattaaaacaaaaggataaataaattagtatatccctttgtgcatcatggagctcccaattgaaaatgttatgaaagcagcaatggatgcctccctgcaatagctggcaatgtgcaagtttgcatgttcatgtgttagatctattgtgtaccagagcttgacatggatgtccttatcagagacagactcacaactccaaacttggacttgtgttttgtagctttggacaccactatagtctcaatgcctttttttcctgcctaatcaaacacaaagaattaaacactgatcaccaacttgttatctttcagatgtcagctcaggaaactttgccttatgttactactgaatgacacactttgctttgctgtaccccttggataagaatgccaccctaatatttcttctttgaataagagacgtaccaaatatgaatgaaaaacatatgcatctttcctgattgcactttcttgcactactgatttatggtcagagaatgctagatacagccatgcatgtaactaactgaagccaatgaagattggaagtaattgcacttggcctacctaaactgtaccctatcttcttcagattcatagcacagtcacaaaacgttatactacatctttcagtttcttccctacaatatatgctaaatctctgaaaaaaagacgagcaaatccaatcttgaaactgtagatttactttgtcagaagggcatgtcgaacgtcagtagcattgttcaacagtacagactttgttgctcttgcaatgtgtcggcaaggtaacctctgaaagtgagcagcggctgatcgagattgctgtcagcaattccccctcacaatgagcaattccccctcacaatgatcatgaatcctttgagctaccatggtcatgatcatggtggcggcaccgactcgcgccattgctcaaatccaagaacccatcaatggttgtaaacatcgccgatccgtatcgcctatcagcgtcgaattgctcgatcttcggatgttcatcatcatcatactgaattactgatcatggctgttctgaaccttgtactgtgccatcttgtgcaatgccattgatgttcatgacctccttgtccttgcccatggcgtgctgctcatggttgctgcctccggtgtcagaggagctcccctgcaaatgctgctcctcttcgtcgtcgtcggcttggaacgtgatctcctcaaaccggccgtgcagctcggcgcaccgcctgcagccatggcgctccgccgccgccgccgatgacatgaagtcgacgagcgagccgcaggacgacgacgacgacgccgccggccggcagttcttgcagcaggcggcggcggcgccgcccggcgcgtccggatcatcgccgccgccgacgagatcgtcgtcgtcgtcgtcgtccgtcgctggacccggcctccagcccggcaccagcgcggcgaccttgccgtcgatcagctgggcgatgcgagtcacctcgtggtcggtgatgtccagctcggcgaccatctccgccgccacggtcatcgccgtgtcggcctcggtgtcgaaccggaagcagattatccggccacgccctgccacaattcagctcgaattcagacgaaattcgcccccacatttgacatcattttgtattataaatcaaatcaaatttgaacacccgccagttcaaaaatgcaacgatcacgtacctgtgccgttcttgtcggcgatgcgcaggccgaggtagacgccgccgtcgtccgtcctcctccccttgatggtgatgtccacgccaccgacacgctcgttggcgtcggcggcggcggcgtcgtcgtcgtcctcgtcgaacagcatgtggatgtcgcggagccagttgtcaccgtcgtcgtccccccgctgcacggccgcgtccacgtcgttgtcgccgacgctattcgacggcgacaagccgccattgctgcaggcatggtggtcgtcgatgcaagcaggctggtgcaggtagttgtacatcagattgtagtagccaacgccaaaaccgccatgtccatcgccgccgtcgccggagaagaagccatcatcctcaagcggcagcaggaacgggtcgtcgagcagctccctcgccgccggccgccgcgccgccggggcgaggcaccgttcgatgaattgcctcaccaccgggtcgctcaccctgtacaacgccgcgggcttgatcccctgatcagaaacacgcattctcttgatcaaatcgtgtccaagaattcacgagaaattctgtggtgatcagatcatacggagatgactcgcttgtagatttggatgggattggagcactcgctgtaggggtaatcgagggtgaccatctcgaggacgcacatgccgaaggagtagacgtcggcgagctcgtcgtaggactcgtcgtacacctcgggagccatgaactccggcgtgccgacgcagcgggcgtggccgccgccgcggcggaacgcggcgaggccgaggtcgccgatcttgacctcgccctggttgccgttgacgaagatgttgtcgcacttgaggtcgcgatggatgatgggcggcgagtgggcgtggaggtaggcgaggccgtcgaggatctgcgcgcaccagcgccgcaccgccgccgcgctcacccgccggtgcctctccctgtactggcggagcgtgccggagacgaagagctcggtgacgaagttgagggcgcggcgcggcgcgtccacccagtaggcgtggaggcgcacgatgccgcggtggcggagcgcggcgaggaggtggacctcgccgtagaaccgctccagctcgccgccgccccgcacgacgtcgcgcagccgcacctggttccacgccacctccactcccctccactcatcgaaccccctatacctgcacccgaaaaatcattccaaaatcaatcaaacactcaaattctaatcaagaaacacaatcaaacagaggattaaactaatttaggagaataaattggatcatctgatgaacttacacaatctttgacgatcccttgccaagaatctcattgaactgcagagagagagagaggaagcattaagaaacaaggtaagaagaagctggaggaagaagacgatgagatgggattagtagatgattactctgccatatcttccagtgggatcaacctcggcatagccagcctcagcgaggaggaggacgccatggccatggccattgctctgctgctgcagggctcccatcattctacacacactctgctcagctcagcagcaacacatctccattgatccactcaagaagaactcgtgagcgtggcacgtcgatctcgaggagatggaggtagagagagagaggagacacctctctctgttgctgcgtttttttaagtactattattcctgggtaagaacaaatttaatggtatagccaactactagctccaaatcatctatagttaatttaatagctagtttatataatagttatctataaacttatattgcactattaatttctagtcccacctgtcatacacatattgcgtctttaagtccgtgctgtagtactgctcctctcttatcttttatctttttaaaatatgattacagctcgtttatagtctgctattgtacttgttcagagctagtgagttgcatgtgcgtgattagagatgaaggagacggtgattaggctatgctacgagcaagtttaatagtatagccaactactagctacaaatcatctatagctaatataatagccaatttatacaatagttgcttactactatactattaatatctggttccacatatcatacagacattacgtctttaagtccgtgttgcagctggctacagatctatagtccgctgctcttctctcttcatttatctctttaaaatatgtttaagctattgtactgctctaatgacggtgcttaagcttagtggatgctgtggtggcggcgcttacgaaaagtggagcagcttggaagctttgaaaaaaaagtttgaaggcgatatgacaaattgataaggtgttggtctgcactgggcgtagaatccaggagctgcaatcaggaaattcttggtctttgtttccattaaaaaagaatacagtgataattgaaacttcgttcccattcaaagatagtaatggttgagacattggatatgtgggcagccggataatgtgattttttttctttcgccattagttacatcatcagacacatgtacaccacctgtagacacatgaatgcatatgcatggttttggggagaatatggaggggtttgtccggcctgtatgagcctaatctcttatcaagaaaagaaaactgaatgctcatattcagtttttctttctctctctttctatgggtgttacccagatgccgaagatggtgcaaaattgcaaaaaacctctgataatctataattctatctccattttatattataagatgttttaactttttctttagtttataaaaatattagtaacatctactacataatcgttttgtataagaatattactatatttgttctacaaatttaatcaaaatttaaaaagttcaacttagaaaaaaaaatcaaaacgtttttcacatacacattgacagacggctctgacaagtagataaccagatacctgccggtagtagaaattgcagcccagcccaccaaataacaggaggtcaaaacggcaagacccagaacccggtccaacaacatcgttctggctcaacaaaggaaagggccacaaggtggcagcattcacgttattataacaaaatgaacaatagtcgagaattacggcggagaattttattatcaactgcaacagttcaggcacattagcaaaaccttttaataattaatcccccattagacatatcttcaattcaggtacattagccagagacgacgatctgttgttacgttatggtgacgatacacatgtgcgacagcgatactgcataaatacgagatccaaaattaagcgtgctaattatctgcctcctgtagtagcaccgcatctatgtccttttttttttcgctttacctcttctctacttgcaacatgcacagtctgaagcgcaagagagctcaacgccatcttgcagaagctgacaggtagggtgctgatcactcatcatcagtactcagtcatcacttcttcgcctgccttcttgatgcagctccgatgaggagagccttcccaacaagcccagtgttgagcacgcagacggcagccactgcgccaccgaacaccacccatttccagtcgaaccctggttgaaccgctctggaattctcactctcatcgatggttttcgctgcattggagggctcttgatccagggggcaactggaactagcaatagatgtcttggtggttactcgagccatgatggcactgcgagagagggtgttctctgtgtctctcatttgctggtatgctctaaatccggactggaacttctttacagcaccccacatgccatgccggacacccaccttggcgacatctttagggatgcccatgtcctcgtagtggaccagcgttacttcacatgcggattgctgtccatcttgtttcggtgattgaactgtggttacccaaacagaaaagggaacagaatgtcaaggtataaacatttgtgttccttcttgaccaaaacttgtgatgaaaggaactaattcaggtgaagtaagaatagtggtaggaacaaaagttacctgctctaatacgccaacttgagaaatacagttccacacgccttggtttttccttcttaggcaaagctggataaggaactccctgcaaatggaagtgtttcagtgctcacaagtctctcaacaagcatatgcgctataatagatagtagtcaaattttctacatagtgcattgccaacaatcttcaaatacatgtatttctaatgttgattatgcaagaatgctaggccatggcgtctgattctctgggctgagatccaggtttgaaatttgaaccaaatgtaagaagagctacatgcatgagctatgcaaaagtatcctctagaagccagacactattgacttcgatctccattcacatcaactacaccttcaacaccttaaaatacaatggatgtatgtttgatctagcactctcaaaaaaagtaagtacaatcgtatcgatgtcagaattgcaatttgcagaaagccaggcaagattgctacgcaacaaacaatgttttagtataccagatcttttgttcactaaaagatctgccttgtagtcactaataaatctaattaccttctagacctagaatcctcatccttttagataattggaaaatatccagcctctgcgtcaagagaagcacccagaccgctacctagaatcctcaaaaatcagatactatctctattcatgaatatttatcacttttcaccacattttcttctgaataaatatttgtcacttcatgttcccaagtagaatttccagttttgtccttattcccctttccacttttggcagaaaatagtaagtagtttacttactagggttaatttggtcacatataaatagccttcgcaacagaacattggttaagcattcgtgaacagaggtagtatcttgcaataggtgctcatacaattacagtagttaagcacttaagttagatatccatatgagaacatcagccaaagccaggttagcatatcataaaaatgtcttgtgaaaatagtaatactggaaccttgtggtagaaatacctttgtaacacaatagtaagttttcccagattcccatatccgccgcccaaaaatgtattcacggtcactgcaaaagaaagggaactacaaaacaagcaacatgttgaaattacatgattcaatatgtaatttgggggatatgcttgtcaagagatatgcaggtcaagttgtcataccttttttatccagtgaataatcatagttccattttgggggaactcctccaaaattttgaaatatgcaagcatgggatcccacttcagacgaaattcatcatcccagaagaaatctctaacaagctcaggagtagcatcctcaaaaatagtgcgactacagtacatgataggtcccacctacaagcaaaggaagatcagtccattagatgttgcactataacctatatgctattgatttggtcacatcaaacgtagattcattgaaaagacaggaaatgaaccaaaggtgcaaagcaaggaaatgaattaatattataccacggcaagccaaggtcatcacaggattttaaaaacataaattctgatcttggtacagttgattcaactttcagagtttttctttcaattcagatgctagtatttaacttatttctaatacagggccctctaatcatttacgcaatcacgctatacatatactttgacatctgtttctttcctacaatcccattggaaaacatacctcaggctcacggcgccaggccttgtaagtcatgttggaagtggtacgttccatcaaatgctgccatgttgtatccccactctccttgttatcaagaagttgtacgaggtgttctaggtccttctcagtgacaacatgatggccgccctcaaaaaatgttctaatatggacagaagaaaaggattttagcaaacagtttgttgcataaacctatattgaagtcagtttaaatagatgcaatcatgctttgaaataactttttgtttgcattagttattaactactgtaacataacaaatgggtcacccgatgaaaaaacatatcaactaggtcaatatataacaggcaatcatgtaaaagttcaattatgtccaacaagtctaaaattctcaagtcctaatcagcatttgaaatttcagtcagaagctcccagtcatttatgttgatgatggcttgatgcattttatgtcagtacatcgaccattgatcacccacttgacccaatgaactcaatcacatcaaattcagttgctaaagaaagaagaataagtctgttactcaactccacaatttggcaataacagtattggtcaaattcaagggtaaagtacaatggatcatcttattaacagttgtacttaacaaatagcaaacgaattttcttgtactaatccttccactatatgattttaatatgacacattgaaacccttgatacgcacaactttcacttaatgttatctgtcggagcataaatactacggacatcaagcaccttaattttaacataacatcgataatttgaaattcaagcatgccataagcataaattcgctctgtcagtacatgtttttttagataatggattttcattaatccagcctctatagctctgtcagtacatatggcatcatcatcagttcagttaaaattatgcaatttcaccaaaagctacggcgctcctaacctgccatcagcattagtcaccacagaattgagttgtgagcacattgatttcgattatcagtaataaattcaatttcgagatggcgcacacctagttcccaacggacgcagctaacaaggcaaacgctgcgcattcccacctcatcctaccacgctaacccacagcgataatagataatccaactcaagaggatcccacctgccatcgacgcaatcgccggcgtccccggaggcgtcggcggcgtcgtcgtcgtcggccaaggcggcgtccttgcgctggtgcttgccgcggctgccgaaggcggtggagaggagccgcggcgcgacggagaaggcggagagcgcggtgcaggcgagccagaggcggcgcgcgccgaggcccgggggaacgtagaggaggcggaggcggcttcggaaccccaggtagagcagccccgtccatcgcggccgccacgcccagccgatgacgagcccgatcatgacggccgcccagatcggcaccgcgcacagcagcacgtccaccgccatctccgccaccgccggccgccgcagcagccccaccgcctcctcgtaccaccccgccattgctagggctcgaagcttcctccctctctctctctctctctctcctctctttttttccccttgcaaaaatggagaaagggaaggggaaggggaggagagagacacgggccagggcgacgagttgtttttggaggggtgggtgaaacatgcgtcggtgaggctggccggtggggccgcggggatctgggcccacctgtcagtggcagcgggggaggggcggttggtgaggcgggcccacctggcagtggataggggtgaatcggcagcatatgcctccgacatatacgggtctcgcgaggcggactcgtgtttatccggagaccggagtggatagaaataataattaatttagcgtgcgagattcacgatgagatccctccgcttgtgacgtggcggggcgttaatggccgcgggtaatcgttgaaacggtacgggcagtggggattggtcactggagcttgctccctgacacatggggcagccaattaattactgctccgctctgctttgacctgcaatgacatgtgggcccagccatctggtatgttgatcgagagctccatccataaattcgtactccctccgtctcataatataagagattttgagttttttttatttgtacttcttgattgctcgtcttattcaaaaaaatttaaaattattatttattttttttgacttgctttattatccaaaatactttaagcataacttttcgttttttatatttatacaaattttttgaataagacgagtggtcaaacagtgcaagcaaaaactcaaaatcccttatattatgggacggaaggagtattaattttgacttacaataatcaaatttgaccaatggtataaaagaaaatgctccatattagtttagtcaagttggtactatattgttttgtgttctagtcaatgtagtttatggaataatgccttacaataacagatattatctttactattaaatcatcgatggtacgagttgaaattaacaaatattgacaattggaatttgggagatcggtcatgtttgatttagattattaaacgaattattaaaaaataaacataataaatagcttagacaagttaataatgtgctagaaaacatctttttgagattgttttgttaaagcatggtgcaaataattcggtaaataaactgaaaagaatatggcaggagtaattatttctgtagcaacgcacattcagatggattcatggagtgcgttgcgaaatattcagagttggtcgaccttgttgatatcggttgaagacaacagaaggaatccagttaggcggctgcctcctgcatatcctaagcgaagcagctgggtcagttcagttcactttctcgaatacattttcaagaggtagcaacagctaatagcacgaataaaatatgaggcggttgttcaatgatgacacaaacaaagctgtaccgaattgacattttgagtctcaaccctcaacgatcaaccagaacatgtgattgcatcacgacaattattcgatcagaaaggaacataaaagtcatggaggaaaaacagcagagagatcagaaaagcgtatatgaatatataagctcgtgcctgtgttaattgagattccagaagaattgtcacaaaccgttgaggaacatgagcctagacgcttaagatacaataatttgaaatcacattaaacgcatgtgcaggatgtactgccaatccgagcagagagcaagatttgcaaagaaaacaaaaaaaaaatgtagctagcacatatactacttgtacaatcctcgagtgccatacatagaagagctacacttgaaaacaaacttctcgaaattactcaaattgagctacctttagaagaactatattggctttgcaactttactcaaccaaccatttcttgtcttgcaaaattcagcagcaccatcccttgttgattgaccgaaaatagcctgtgccccgatagtaaacctaatttaccaaccagcatcctccaatccctgcaacatcatgatgcatttaaatactgaagaaagcaagtaccagttttgaaataactaaacacttcattggaatcgagctcctagcaactgatgatctctttgctactcataaaattttgggggcctttcagtactctcaatcttttctgaagtaatctatgtgaatgctcaacaaacaaacatcaaggtaaaatatgtacccttggccacttttaatcaaatttacatattatattgttgaatttttttttttgtgtgcatggacaagagtaacccctgtctagtccaagctccagccaacattagtactacaccatcttgtccccatctcatcctctaacctagcccctccagcagtgcctcctttcttcacaatgcattggcatccataggaattgagagcgactctactgcccacacctttgcacagggcaggctttcgctgcatcaagtgggatgaagacacattcagggtggcttgttcaagtccataaaaaaactgagcacagctagaagctgatgaagcagttcactgtctttattggaagggtcaagtccgatttacccccctcaacactattgcaaaagtacaatttacccccttcaactataaaaccacaagatacacccctcatctattcaatccagacacttaaccccctcataccctgttttaggtggtttagggctgagttgtcttgacattacttgttctcatacaaaccttgcttctgacacattttgtgttctcataaagaacaaatccctgtttgtcattacaatgtcaacctggtgctattaagacttatattacttgttccttgtccttgcttctgtttctttttttttttttttggcacagacctcattgcacaaacaatatatatgacaggaaacaactgatttatatttctgtaaagaccttgggggtttctgcaaacaactgatttatatgacagaaaacaacgataaatttcttcttgtccagaacttggggggttttgctgttacattgcatggctacattttgatgttttgatctactaacggtatatgttcttcgctgtatgagtcagtcactgaaatgcaccaaattgtgagttccaaagaccacgaggtgccatctgggagaaatggcacaggtaaaaaacaagtgcctgcatcaagctaagtttgcaagattcagtggattatcaagacaactcagctctaaaccacctaaaacagggtatgaggggggcttaattgtccggattgaattgatgaggggtgtattttgtcttgtttcgtagtttaggggggggggtgtaaaatgaaatgaatccatggttcaagttccaggcctcacttaaatgtgacattgttcatagtgttaaactgacatagttcatggtattgttctaattaataatctgacacggttcaatacaaaaacctcgcatggccctgactagtctgggtggagaagcaactcgacagatccatcctcagaatcttctccagagtgaagtcagcaggaccggaggagaagaacatattccggttcagcgcgcttttgtggctgccatggcttgccgttcgatcaaggttttggggtcgggttgggaatgagttagggaattcagagctcaggtcttgggtggggccaggaatagccagtggtaaaaaacatccagtcaaaaatgcattgctaaagaagataaaaaatcgggcaaagggtatacaatggcatgcttggaagcaacgccagtttggaatgacatatttctaagcctcaactgatcagtggcatacatctaaagtggtaactatggagtagcaccaatctagtttttcttatattgagtacttgttatgggagcaaatattctggttgtgatatcaacttggactaccacgctgtaaattgggcttccccaaggcagcaaggccccacttacactagaatgaaattgagatcaagatttacatactggtcaacaaccaattcaaaataaagtatcagcttgcaagtattcaatgatctatgatgcaatgcaactcagtaaatcacccacaaagaaaaaaaatgtagtcattcagattgtcaaagttcaaactctaagatgcaatgaagctacacgcttttgatgggaatagccagaatgtggtccagaaaaaggatatgcatcagaactatttgttcacattcagcttcgagctttcaactatcataactgatatgtactgaaatttatatttacctgtctaagttatgacatgattgcctctactttggatcgtacttcaaccccagagaacgcttctaattaacttataatttataaaatactgtttcagaaatctaaggtggtgtttggatgcagggagactaattttagtccctatcacatcggaggttgggacactaattagaagtattaaacgtagactaatgacaaaacccattccataaccatggactaattcgcgagacaaatctattgagcctaattaattcatgagtagcctatgtgttgctacagtaaacatgtgctaaatatggattaattaggcttaaaaacttgtctcgcgaattagctttcatttatgcaattagttttgtaattagtctatgtttaatactcctaattagtatccaaacatccgatgtgacagggactaaagtttagttaggggtatcaaaacaccccctaagtaatcacactggaaaattaggtggaaaggaattgcattctatgtgtggacaactggactttaaagtgggtcaccacacacaagtcatataggtgtagattctaaaatagagacctgccacgcttgaatagacacacttgagactggcaattttatgaggtttcctatgttataaactgtcactattaaaccaccatgcgataattccacattttgttaccataataatccaatattcacatcaaatgaaaaaaaaggcccataacctatgttggacatctttgggctcaaccctgtcggttaactggtaaaggttcaatctgggaattttctcaacactacataatgcaagaccagctgtgattgacatgttgcaagtttgtttgatcacttccatgagcaaagtttgtatcataaaggccattggaactcattatttatgcacaaaataaatactgattaacacatgaaacacacctatattgatatggtttactccacttatcaacaacagaggcaacaagacaatttacattgttttcaaaaatcatttgtaactacgagattcgaccatccatagccttgcattatcgatacaattgcaagcaagtacataacattagtctccatttgcaaattaagaggcatcacaatataaccaagtagctcatcctccaatgcgcagtacataaatatccaatgcgcaatacataaatatctagcccccagagcatcttttaaaacttctaacgtgatttttttatactctagttatgcatctactgcataatcataaacttgcaaggacggataattatctccaagcaaaagatgccataccataaccaccgggagcaatcacatgcgtggctgcgggcgaaggatcatgatgatgatgtcaatggccatgaacgcgatgagcgggctgaggtcgagcttgcggccgaacacggggggcatgacctcgcggcagagcgcgaggaaggggtcgcagaggtcgcgcagcgcggagaatggctggcggtcccaggggatgttggggaaccacgagaagagcacgccgacgagcagcacctccctgtacacccccagccaccgcaccaccgccgacatcgccgcggccaccggcgcccgcagcggcgcgaggttgacgctccgcaggccgacctccagcgtcgagagcggggccagcagcccgcccaccgccgaagccgccgcctccgccgcggcgcgcggcggcggcggcgacgagcggaggccgcgggggagggggagcgggcggagggctagggtttggggcgggaggaggcgggtggcggggctcgggaaggcgcggcggaggaggggaggggggcgcaggcacggggaggtgaggacgccgtgcatctcgccgcctctctggggttctggaaggttctagaaggggtggggaggcgaggaggcggaggaggagatgaaggtgggggaggcttgcgaagaggaaaggatatggtgtgccaattgggatcctctcctgtaatgtatgtgcagtaagtgccactgacatgtgggcccggaataggtggaacccacatgccagtgacacatactgcaggtgcagtacagtgtacagcagtggatttgctactttttgtgggctccacttgtaagtgggtgtgtgttttgtatagtatccatgtcaaactggattaggctgcgttcagcatctctagtttccaaccggaaacaaacagttcgcacgaaaaatggagcggtatattagtgcgtgattaattaagtattagctattttaaaaaaaaatgaactaatttgattttttaagaaactttcatatagaaacttttttaaaaaaacgcaccatttagttatttaaaaatggtgtgcgcggaacacgagggagaggtgtttatatacggcttatatactccctccgtccctaaataaaaaatgattttggttgaatgtgacacatattagtacaacaaatgtctagattcgttgtactagaatgcatcacatccaaccaaaatctatttagggacggagggagtatattagttctaaaaacaaacttgtctgtggtcggcaattctgcatctataatttcataacttttttatttacaattccattgtgatgaattaatggccggccagattttggatttctttctagcaaaactcctattagaaagtagaaatccagataactagttatatatgaattttagacataaccagatgataatagataagttgtgttaatagtttaatatgtcatgattatttttggttgtgattgtatgaattatcatgacagtcatgtcaaaagttataattaaactcatgtagccatgtcaaatataattgatagtggcaacaaaatatactactccctccgtattttaatgtagggaaaattggaaccatgccattataattttgtaaaatttgagatatgtcattctgacccacatgtcattgactcatgtgggtactacatgtcattaagataccgatggcatatctcaaactttgtaaaattataatggcatggttccaaattacgctttaatgtatgacaccgttgactttttaatcaaagtttgatcattccttttattcaaatcttttgtgcaaatatgaaaatatttatgtcatgcttaaagaacatttgatgatgaatcaagttacaataaaataaatgataattatataatttttttgaataatacaaatagtgaaacgttagataaaaagtcaacggcgtcatatattaaaatatggaggtagtatttttttcacactgttaaagcatcagagtattaactattttgtagggcgaagaatcaaaattccatcacatatattcgagatgaagcccaagtgtccaactcccaggccctgcccacccatgggtgatgggccattgataccctgtgggttggcctgtggactattgagattatagcagcattcccttgcatgaaaataattctgagttttgtatttggaatcgattttttttctttttatgaactgttgcaataaactgaaatgactaatgtattattttcctcctgagaaatatcttttggcaatactatagttcaaacttctgacttctgaatatagataaacgaactcgatcgttgaaatctaaggatgaaatgatgaatgattgttggcagcatgtacttatatattttcagatataataacagtaacaaatcacatgtttgccattttcctttaacagcaagtactaactcgagggtacaagcgaatccaacaacaagccaaatcactgggcggaagcacaaatacctttggtatattaaagatatcaactgcagacctcgtcggctacattttttttctttcttttaaccatcagctgcattgtcagctaaccatcttcttatctttcaatttctacttgaggcaacacaacatgatcttcatgggaccaagacaagatatacaacttgataaacacatcacaaacaggtgcaaaaagataaatatattggacattagagcatctccgacattaggtaattttgcagagttgtagatgtcatgtcactgatagataacactaatgctgaaatagttatgaatactcgggcacagtaatatactagtgtttagttccaaagctgccaaccatgaatatgcagtgtcatactcataccccttacttgtcattaagacatttaatagtacaaattacagctccattaataataccagggcaattacttaaattagtgcttcaataaccacagcttagaaaaatcctaataactacattataggattccacggtgcagaaaagcatctgtcctagaaataatagcatgatggaggatgccaaagcaaatcttccacaacacagggaactactttccctgtggaaaaatcaacagaatgttgatccctaaaggaaaaccaggcaggcaggcaccaccaacatagaatgggagctgtttacggctttacgcctagaaaaacatgtgccaagtcagtcattatatatattaactgaaccaatcaagtcaaataaaacattagaaaaatcatgcataatgaaacattgatatagagaatctatgcgatcctaaatatgcaaaagacaaagtaacatctatagctactgaacagtgaacatattaagcttctagaaaaccaacatataagagcaatgcgtgttcaacacttcaactaacaattcaataacttgcaaatacatatgcatatcgtcggaaaaatacacctgctttctctctgctaattaagttcagcgctaacaggcaaaaaagtcttgcatggtaacaagtcatggtatgattttaatagagacaacgttgcaatcataaatgacaacgataaccaaatttcagttgtgttgattgcggctgctgtgcttagggagttatctaagagagcttggaacatatacactctccaggttcatgactgatcaaattgtgttgtactttgtcctcaaggtcactacttattgattgcaattttttgttgcaaaacctaagaagccagtacttcttctaagccctttagcagctccagacaagcagctgtgagactaataattgccaaccttgtatgcacatatcttatactaatccggtggaaagccggtagattccgaacaaatttcataaaccaaaatttaaatacaaattcccttagtttaccgataagctcatgaaaaccggtcggctttggcgaaattccgggtgaaatcatcgaaatttcaatcggtagctagaaaaagaggtaaactaaaattgatttcctttttttaattcgttattcttttcttttctactgtaaatttcagtaaatacatggaatacatcatttttttcgaaaatttatatcccaataggttctattaatatcatattatttataagattttatttgattttttcccttttttatcaattcaaatttgaatttgaatgaaactcatcgaaatatcagacggtttctactttcgagcctcgttgaaacctcggaatttcgcggaattcgaccggtttccattggaattgtgaaccctggcacatattggtgcaactaatagttcatttgtgcggccggttaagcacaaatgcaaagctgaaccaagaacatcttataacaatagttgtaactaacacacacaaaatgtttgtcaagaaaataagcaatcagtgctggtaatgaatacagacacttgtaacggtttgtaaacccaatcgagaaatgtgtgtacatctaattgcaatacattatatccaattaaaatgcaaagctacagccgcacagctgatctgggactgttaatagtataactttaatactaggaaaacacctaataattaaattgatattaggaaaacacctaataactagtaagccctgggtgcaagtgcaataatcagtgaatgttggagaagcccaatagaatcattcccctggaagcaaggcttcacttaccccctttctccactttcttttcactctctaccccttgctttctctctgaaagcttatctgtcccttgttccttcaggcagataagggaaacaatgagcttgattaattacctctagcaccacaaaatgctccaatcaaaggaatggttactactaaagagaacaatggagttaaaaaaaaattggtcaccaaccattgtctattaaagcaacatgtgtagatatgatgaatgatgctggtaggacttggtataaaatccgccgtaagtcgtctttatgatgctggcgacaatgacggggtttgaatctcctgaagataaagatagagatgaatattaagtgtttcacgtaaaacgaggtggtaatagcgtgtgattaattgagttttaattattataaacttgaaaatggattaatcttatattttagaacaactttcatatagaaagttttcacacgaaacgcaccgtttagcagtttgaaaagtgtggcacgaaaatcttaatcttcatccaaatcttattagagaaagaacagggccgattccgaggttgtattgtgcaagacaaaattccatgtgatggtaaaagacaatggtgtcgctaacaatggtaagaaacgcactggagttgacacatagattcctcttaccaaggaagagggaattgcaaccgatggtgctcaccaggacaaccattcccagcataaggtcgggtagcctgtaaactgaaaaatgccgatgaacactactaagatttgaggtggtcaccagatctgaatctccaagccgcattccaccaaattgtaggataaatgtgcttcgggtgttcttgctggacatttggcaatcaatcttggcggcggcggcgaggtgtccgtcggtgaatcgatctgcaatctctggttcatcgtaaattggcatgatcatatactccctcagctccgtttcattttaagtgtggttgtaagttttggtgtccaatatttgaccatccatcttatttaaaattttataaaaaaaattaaaaaataaagtcacacataaaatattatttataatttatcatctaataacaataaaagtattaatcataaaaaaattaaataagatagacagtcaaacattgaatacggaaactcacaattgcacttgaaatgggacagagagagtaacacatatagcttgccttggaatgacaatggggagaagaaattcttcattctcctgtttgttgaaatcctccattcatccattgcttatcgccggagatggcgacggacacatacaccgttccaaatagccacatcgtgagcgagacgactccaccggcggccactctgacagcggcgcgcgcctcgacgtctctgagacaaaaccacttacctcacatggctcacgtatggcagctaggtgtccagcggcgggaactcagcgatgccgccggtgaagggggtggaggaggcggatgatggcggttgttggagtgtataaagtgaattgcctgtcttttcctataaagtgcaacatgcttacttaatatggtatcagagtcagaggtcgcgcagtggtcgcggaagatgagagagacggacgcgggcgatggcgccgccggtggagaggttgaagaagctgacgaaccccgcgcagcttgcacggcgacgacacggccgcgcgggcaggtggtggctcaccagatcctccgggagagatgcccacgacgaatcatcccgagtggcggcgacggcggaggcggccgaccggccgtcagccgccggcgcgtgctcctgctgctgcctccgcacgggatcaaggcagccgggcgcttgctgctgctcgccattacgagacctcgtcggcgatggcatgccgcgcgcgtagacgatcggcgccggcggcggacgagctcgtcgcccgcgaggcggcggcggccgatgacaaagtctagggcatatcctcacggcccaactctttgtttttagactagcccaagcccaatctactgggcctcacacaccgatggcccatgggccattgctagctcgtggagaatcatggagagcatgaccgatgcaaataaattcagagcttttgtactactgtattactaggtcgctatattttatagtgcattaggtcgctaggtcgttccaaaatgttatcttttattaagagttttattctttttttgcgtattaaaaaaacatattgttgtagatgggtattgcatcattttcgacaatagttcagacatcagggtacagatgaaacgacttctcgtatgaatcttcagttctgagcctctttcccaacttgctgaatgaaccttggcagatgtgaaatgatcagaatgctgatacattttcagatatagttacaatgaaaaatcacatgctttgctcttttcctttaacaacaaatattttgggaatttgtttttttttcctagctaatttctgaagaatttgtactgcttcattttattgcaagtgactctgatgcaatgatgcattctatccatccaatggttattgttagtcatctctcacgcaaattttgccgacatgctgcagcctcaagattggtacatccaagctacattgccatgatcgagatgagcaggatgcagacgttgtacgttctgtacaaatcaaacaatcacatgatattacttctactactactactacctttttttctaatttcttcaccaaacagcaaagcttcgaaataggatcgagatggtgactgccgactagactagcttgtactacgtattgtcaaaactgaaaaagaaaaaaaaaagaagaatgacaattttgttgcttcaaaatgtgtgcaaattctacatgtacactcccaaagatgtagttattgaactaagtgcagtgtaggcaaacaattcagcaaaaaatatatgtactggatcgatccattaaccacatcgctttgcttaaatgtgtagctttctactcctctttaatagtgtggtaggctgtcagttgatgtaccagtgagtgattatgggatctcgacaagaattatggctctagctaggacagtagtactcagcaaatggagtggaaggtatcactttttttggtctgtgcaatcatcttcaagatctctacagggttatattgatggttcatatactaaaggaaaaaaagtagaaatttgaaatttcacgaaggatcgaggagaaatttcgccaatcaaataatgatctaacggctcataccactcggagagaaaatcagacagtacatgtttattttatgacttgacactttagtttgtgagaaagattattttttccattacgctagatggactctgaactaccatctctcattctaaatataagacggtttagacttgtttctttagtgcaagtcattttgaaacatctactatacattttaatccttttcctccacgtctgcgcctcctaaataaataaatatgactcattttttcccaatatttcatttcttagttcctgtttgttttgtcgctaaaattaaccctaatgccaaattttggttatataaagatgttgatgtaatatttggtttagaaccttaccaaaattgggtgcagcatttttggagtgcaagctttcgaagttgccacaatttggggatttaattatttgacactctttaccatatccgtctcgtccttatcacaaagtggcaatttgccacccatctctctggagtggctaaaaggtattatcacgctaatatttgatagggtagtaatggccaatacatgtttggtttgttgcctttacttaaatttagcatcatcaaaatttgacacgtttagtttagcaacaaacaaaaccggccttcaattaattcttatacataactctaaaacaacttatattaaaatcagtaatgctacttctaggattgttcaagaatgataaggtgccacacatatcacataattaatcacacactaatttgagctttaagataaccaccctatctgttttagggggagaaaaacaaataacatcccccaatggacaaaatgtcaagatcagtgttcctttcttaaaatgcaaaaggtgtctgaatttgcaaggtgcagcatccccatcttaaaatttcacactgcatgctgaggtgagctttgcaacatgtaggtaagatcagatggattggacaccatgagtggacaatgctggccggataaaatcaagcaaaccattatccctgcttgccttaaggaagctaattaattaaagttcatttcacactcacacacaaacagcctctgtgtattctgtggcaagataattaacatggtgaggtgaggtgaggtgaggtgatgttgctgtccgccatgcattattaattagtgtcccccattatcgagctaagctagcgtcgcttttggattaagggtttggtgctttgtgctaatcgagcttggactaattagatccaggcgatccatccatcgatcgatccgtcattgaagatggccacttctcccctgtgatgacttttattttgctgctctatctgatactgctgaacggcagcagatcgatcgatcgcgatagtacgttgcccattgtctgactggggatggcagttagccagtagccagttactgctgagtgctgacgaattcacgggacagtaaccgttccaattcatgctactgccaccgttaattgctgctatctgttaatgagttttctttttcgtcccctcctcccatcttacgctcatgtacgtagcacgagagaaaaaaaaagtgttgaaaatgatgtccgtggtatatataatatatctagccaaaataaatcttatcaaattttggtaaagttattagatagtaaaaagtacgaattacccccccaaactatcgtggtcgtccgaattaccccctgaaccacaaaccggacattcttcaccctaaactttcaataccggatgaaataccccccttgacccaattcatagcggttttatcctacgtggcgtatgcgtggcagtccagtcagcatttttttaaaaaaaaattggtggggtccacctgtcatgcctccactctacctcttcctaatttctctctccgttctgtctcacttgtgcgcgcaggcgcaagtgcggagcggcgggcggacgacggcggcgctcaggggcgagcggcggacgacggcgagtgggggcggcgcggagctgcggacgacggcggcgcgtgggggcgcgcggcggatggcggcgcgcgggggcgggcggcggacggcggcgagtaggggcgtcgcaagtgcgcacggtggcgcggagctgcggacgacggcggcgcgtggtggaagccggtgtgcggggggcggacggcggacgccggcgagtatgggcggcacaagtgagctcggcggcccggcgccgcggacaacggcggcgcttgggggcgagcggaggacggcggcgcgcgggggccgtcggggtcccgcatcgtccttccagatccgcgcgtcctccgcccccgtccgccgccggtcccgcgcgaacaagctcgctggcccagccttctccctcgtgcgctgtcgccgccgccggtgccccttcgtgcgagcgcggcgccgctaggcctggagcgcgggaagaaagcgacgccgccgtgtgcctccccgtgcgcgcgcggcaccgtcgcccccaactggtccgcccccggccgtcgccgtcctcggtccccctccgctgccccggccgtcactcaagcagctcctcgccgaggcccacgccgcgctccaccgccgcgacgcaacccgcctcgcctctacattgcgtgacctctccgcttccgccgcagcgacgtccgactccggcgagtccgcgctaccgccgccgcctccgcatcaccctcatcccccaccgccggccgccgccgccgccgcagctctgtgtgcccggcctcgcgcccgtgagagagagagaggaagagtatgacatgtaggtcccatatttttttaataaatagaatgctgactcagctgccacgcgtacgccacatagatcaaaaccaccgtggattgggtcgaggggggtattttgtccggtattgaaagttcagggtgaagaatgtccggttttgtggttcaggggggtaattcggacgacggcgattgttcgggggataattcgtactttttcctattagatatatgtatctgttaagtgtttttaccaaactcttttaaatacataataaatcttatcaaaacttggcaatattgacaatttacaagatttattttggctataatatgaacggatccgaaatttatagagatggggcacgtcgtttctatcaattgtgttgtaaacgaaaccaactggataaaattaatatataataatacgttactctctctgtttcaaaatataagacataaccacctctgaccaaaaaaccaagaaataattattatcatcttgtagtttggatcatcctaataaatacaatgcatgcatccaatagaattagacaacatgagggtgaatgatttaaaaaagtaataatttaatagaaaaggagttatagttaattgcctacatgtatgcatgtcttaatttaatggagtattatgaaacatctaaaaaaaagtggttttgccttatattatagaatggagggagtatatataatgcctaagtgatttctaactagttttccgatgattttagaactcgaatgtggtataatatatgtactcgatgccagattatttaaaatctaatacattttgtacgaaaatggctaagggcggttacaagtgaaataagctgcgagttcctcaatatagtttctacgaaatcaatgtataacagtataagcccgtcttacgcgaaaatgcgtgtgcaagtagccacgacgaacactgcaccggcctaaaggattgaactattgaagactccaaaactgctttggatttgattaacaaccatctcaaaatacgtttaaaaagtacttgatgcacacgggtgacgagcgaatccacctggcctgacgaacaaccactttcggtgccctcgcctatacgttggctgacgtcacttgtaaatacagttcaaacttccaacttccaagcatcctgacttttgcttcccatctcggagaaagaaatcatttgtattttcgttttcgaggtgattctgaaatgtgggagcatgtacatatccacaacaacccaaaaattctctgtggctcactggctacttggctttgttttacagtactatgatttttaaaaaaccgacagtggctcaagtttttttctcactctctcttttggattacaagatatatataagacaccatttaaaactcatgaattattctatttttcacggaccatgaattgattcgtgtgaggttttcacaaggatcctatatgaaaatgctatgtatcactacaagacaattgagctattgccaccaaattattacaataaaaaataattcgtagcaatatattgtactattgcaatgataatttttctatggcaaataattatattttattgcaacgatctacaatcgttgttttatttagtacttttgttgcaatagaaaataagatattgccaaaaaaaacttattgttgcaaaaacatgttctatcgccacaattttaatttttgtggtaatttacatagtacatggtatttttcactattttttgttgccacgatcaacaagttcattacaataaaaaaattgttatctcataatttaacttaatttattcatatggacacggattgagacaaattttatatgaaaattatactctcgatgagatctacaattttataggtgataactttttcatttgaaatattttagatattcaaatctatgattcaaatctcagttagctaggctcaaatggaacgatttgcattttctaacataattgatgcgtaggtgagttggcaatagaactaatgccacatatgaagtgttgcaatatgattttttgccacatccattccgtggcaacatcgaaatttattattaccactaaataaaaatcgttgcaatagcctattaccacgctatttattaccacggttagcaacgattttaaaattgtggcaacatgtatctattgccacaattttaatgttgatgccacgatttttttcgtggtaataaatgatttttctagtagccaagcataagcgcgcacacactacacaagtttgatacgctaaaaaataaggatgacttaaaaaaaggctatctatattatttttttaaaaaaatgatgataggagtaaatatgtcatccgccacggttacccccacctatttctattgtaaattaccctttcaacttcttaatactataaaaacaatcaaacaaaagtaaatgttaaacataggaaaaaagatgggtaacacatttcgtatcaaatactatacctcaatttattttaggtaatattataatatattttatttgatccatagccaagcacgagcattggactaatgtatgtaaaattttataaccaagaaaccttaagaaattctagtgaaacatgcacctgtgtgtaaacagtggatagtatataatgtatgtatgaatccatatacttagttaaggctgagaaaccgacaatttcaaattgttttcatatgttagttgagaaaaccaggcatgcatggtaccactataagattcaatggctatatatgataatgagcttcccatgcaatatgtcctattatactctttgaaagaaatgtttcaggacaaacaaaatctttatatgaaaaactcgaatggttttcatatgcgttggttgagaaaaccaagcatggaccactacatgattaagtgagactatgatagtgagcctcccatgaaatgtcctactatactccttggaaagaaatgattttagacaaaaaataataattctttaggtgttaattttttccactacaaaataaagaaaaatgttttgggccatactatatataatttggatggtagtgatctctttaaagaaaaggacatatcaggaccatatgtagttgtgtacaaccacttcttgtggaaaaaaataacacaaattaaatggcatcaagtattcaatcttagatataaagaatgttgtctttctctccattactttgaagcaacatgaagattctccttgccttttcagaaagttaataggaagagtgcaagacaaataatatatacggatcatatgaaaactccacccagccctaaacaggaaaacaaaccgaccctaaattactttgtaagagatttcaatcaaatttcactgccttattctgaaaagatagccgtgcgtaacagcgtaagtacaatcttctaaagcaacaatatgtacaagatcatatgataactccaccgaatttccatcaactgcattcctcatcatgcattcctttttaccatgcaatgctaaattttgcacgtagccaacaaacaatcataatttctaactcatcaacaaccattgctgatgtgaaaatccctagcctaagggagtcaattctaaactctcgagggaacatccccttattatttatatatcattcaaataattaattaaaaaaaattaacaagatatattaatatatgacaaatcactatacaactatgattgatcaaattaaccttctacgagttgtaataaaaaaataatttaattgtacatatacattaattggttatagggcttgttcactgtgctaccattttcaaccttaccaagttttggcattaccaaatttttataaggttaccaaaattttggcaagattgccaaattttggcaagatttcatatgtacttactaaaatttggcaacaaactaaacataggatgtgtttagttcacgctaaaattggaaatttggttgaaattggaacgatgtgacggaaaagttgaaagtttatgtgtgtagaaaagtttttgatgtgatggaaaagttagaagtttgaaaaaaagtttggaactaaacacggtggtagtcaaaattttggcaactttattaaaaaatggtatggttgaaaatgacatcaaagtgaataggcccataatttaatttatttttaaacttgtactctctccgttttttaatagatgacgtcgttgactttttctcacatgtttgactattcgtcttattcaaaatatttacgtaataataatttattttgttatgagttgttttatcactcatagtattttaagtgtgatttatatcttatacatttgcataaattttttaaataagacgaatggtcaaacatgtgagaaaaagtcaacagcgtcatctattaaaaaaatggagggagtattaaactatcaggtcgaatttctctaaaactaattataactatttagataactctcgagagcgtactagtgatcagctctcctgtacacaataaagagagttagagagcgcaaatgaaagtttgctttgaagtgagcctgtggatattgttggttgggctcgttgccgctgacaccggaggcaggagtggggcccacctgtcctttgacttttcaacgccctggacaaggacacgcgggggaaaactaacccagccggcccaaccagccacagaagatcccggcccaccgcgccgcgccaaaaccggcggcctttcaaaagcgccggaacccaccaccgacgtgtccggtcccccaccgaatcccagccgtccgtttccacaccaacgccccagatctttcgaaagcgcggggggccagtgacgtaattgttgccaccctttaattaacacgagtccccccgtcgcgattagcgcgctgaggtggcacggattaaaaacaccgcggacgagcggggcctagctaaggtcgatgacgtgtggggccccgggagcggtggggcccacccaggtgggtgtgggtgtgtggattgcggtggttaaggtgggggctcgtgcggtgtgtttcgctgcgggtcgcgtcaccgcggaacggaacggaacggatcggcggcgtctcgtccgttttgggtgtgtgtgtggtagttagagagtgcttagcttgggagattacaaccttaatcatgccgttttcgttatctcacatctggcaagtggtgtgaagatgatgtttaaaatgtgggtggttaggttgaaacctcaatcgttggctattttatcataattcaaggatacgcaaataaaaagaaacccaggtaaataagatagtagaccatgttgaatgcttaaaatgatgatgattattattcggtttactcattgtttgtgaaccttcattaacacagcctatcatttgggagatttacctagcctagtaatgcctagagttttgtatatgttttaaatctcgtgttttcaaatcaagtattctttatagcgatccaaatctagatattcaaacacataacatatagcatctagagtttgcatgtagtgacggagcgtcccatatagcaagtgatcgagctagccaccgaagagaaccttaccctatgcgccacaaggccatctctactaggtatactacatatgtcatctatttgctgtcgagagaaagacaaattaaaaagtgttgattgtttttgagtctgtaactatattggtgggtcgttacttactatgattggtgctttagtgggccgacaagtgcaccagtggacaaaaccgacgtgtggacacctcccgctcttgcccccaaccgctcaacgcctcaactgtagcaccgccgtgctttacgccaccacctatcctattcattgtccattgtcgccactcgctcgttttatccacccgtcacctaaatggccattacccgtcttatttggcctacatatatttgtttttttgtgctccatcattgtttgcatgtactcccaacccttttcaaaggttatcgaaacaatacgtcattgtttttcaaagtacatgtcatacaagatataaatattaaataaacaaaaatagtgaagcgaacatattttcctacgtagccctttgactcaaaggattggaattttccaaatcctaaaatttttgtatggaatgacttatgtacgtaggttttagaggaaacttagcaagaggtccaaccatttggaaaaatttctgagtctatccctctcatccaatatttttcttacggttcaatcaaacgattatttctatatttttcccgtattttacaatcctctattttacacttacattcatgttagaatccatgtttttcctatttctcaatttttttcatttctacgattcaaatgagccctaatactataatacacacgcgcatgtatcttctacacccatttgaacactgtcgatttcatcaaacatcacaactataataattgatcgaagaatgaagattatataatacgagactaccatgcactggtttattttctcacaccaaacatgaaagcaaactaacgtgatcacacaggtgagaggtcaccgctcttcgcaacgacaaaacactgctccaaaacccatttaatctaattaaaataaaattatcattactacttatttaacgattcccagaatcagaatagccaacgaaatgctaactaacccgagtttccacgtggctggtcaaaaccaaatcccccctcctccccgcggtaacctcacccggtcaccggtgggccccacctaccccctccgcccccacaaacaac

SEQ ID NO: 64560 - DNA, 9085 bp, Oryza sativa
agtgtgataatcggcaagatggctctacagtgtgtggccaagtatatgttcacaacttatagaagcccctgcagagacgtcaacgccctagatagaaaagtcttcgtcttcttccccaaaaatacaccttttttaattatcacagacaaccttccaaccacagttaagattaatatacgtaaccctatggcttataattgctgattagtgattcggattgaaatccatggaccaaaaataattaaactacgagtagctaccccacttatagtacgtcgtcaacctgtaaacttgcgtattcaaacacttcagctaaatcaactgatacctgcacacttcgatccattatacactgcgtatatttcgtggccagtgtaccgaattcgcaatcagagaaagagagaggttagaacttagaacaagactgtgtcagaggaaatatctctgaaattgcgcgcatgcatatgccgacgttagcattcatacaaattgcaatagcgataaaattgattaatcctagtttgactgaatatcatccagaattgaatcacattttcataaagatttttcgtgggccggaacgccggccgaatcctatatacttatatagttcatccccactaaatatagttaatgctatttctctcttctctcgttaagccacatcactctaattatttctagcttttaaataaaagatctatgatccaaattgtctcttctttcttctctctttaaaaacatacaatcttaattatttttaggctcaaaattatttcaaattgttttagttttgataattaaattacatcttatttgcacatattatgtaacttaatttttcgcagcaacgcgacggggtattcatttagttctattaagaatcaagagagcaaattaatatcatagtgatatacaggtctagatatatattgattgatctctctcccccagttagcaactaccggccgaatggcaggcagtacagcgacatttgcagtttaatttacatgcacgtacatttgcgccaatgtggtaaatacaatatgattaatctctcaacaacattcaaattgttacattgtaagcatggtcatttttcgattgggctggaaacctggaaggcagcaaaaattaaactccccatcttaacaaacttgaaccggatattagtaaaaaaaaaagttacagaaacgtttgtggtttaattaaatgaattgtggtcattcttcgtctgattggaccggatggtctacagcaaaatttaattacataggtagatagataagttgtaatcagattagtattaattcaactgtgatgtatgcacctagctcatgatcgagtcatgtcatattggacggatttctacggctcaaaggcatacgtaatttctgttactgatatgtggtactccctccggttgtaaaaattaaaattgacgccgtcgatcgacttttaacatgatattcaaacgtaactatttgatttttatgaccagtaaaataaatagtaattaccataaatagtaattacctttttttaacaagatgcatgatcaaaacgtaatgactaaagttaactgtgtcaaatatgtatgaacagaagaaacacttactaaatacagtagtatggaagcatattgagtagctagccagcagcacactgaacatacacacagcatacagatagctagagtacaacacaaaaaacagtctccggctagtacaattatacaacacaatactagctagctagctacccacatgtgtatatactatatagtacattagcaacttcatttttccttgaagcaggaaagccggtactactggtttacacttcttcggcagttgaaaaaaaaataacaaaactatagaatcacgagcactcattaccacaaattatttggcggccttccgtgattatttcttctgaataataacttaacttaactgaaccaacgaacgcttgtagaatttgagtacgtacgaattaagtatgtgccaacatgcatgcatgcgtgcacatgcagagttgcagtagatatcgatggagtcgatcgagatgcagaacggagaggagacatcgacgaattgaattgaagcaatttaggaatctatcaggctcagtcgaatccgaacctacggtccatatagccgccgacggcttggaacgtcggaccgaagagcccgtttcgtcctcctccgccgccgccgttgtctctcctctcgccggagttctcgttctgcgacgacgacgaccctggctgcgtcatgtagatgacgttgaggtacgtcggcgccgaccctgagccaccctcctgccgcggcggcgccggcgcaccccagccggaattagagccatagccataggaggcaggggcgctgccgccgccgcctccggctacgatggcgccgccgttaccataggaagagccgccgtagccgccgccgttgccgtaagtagagccgccgtacccgccggcgttgccgtaggaagggccgccgtacccgccgccgttgttgtaggggttgtagccgctgggggcgctgctgctgtagccctcgttgttgccgtaaccgccgtagttgctgtagctccggtctctctcgccgccgtcgtcgtcgtacttgtagctgctgctgctgctgctgctcttcttcttgttgctcttctttcccctgcgcctgttccggtcgccgtggtcgtcgtcgtcgtcgctgcccgtgccgctgcggttgtcgtcgtcgctggtgtacctcgggtactcctcggacgtcgtccacggcgagcggccgttgccgctgccggctgtccgtaccggtcgtctcctcctcctccggcgaacgacgagctgtcagagccagcgtagtactggctgctgctgctgctgcttttgccgctggatttcttccaccaggacatcgcctctcgacttcttgattgaacttaacttaaattaattatggtcccagctactgatcgagctagctagcatgtaattaacgatttactgattagcagcaagatatgatgcagtaaataaactcgaatgagaaattttttttgaataactcaagctgaattagcatgcatgcatactaacccgacagtagatgatcagatgataggccagataagcgcagatactcacaagagagatgcctctaaaaacttgatcttatagaagctcaaagacatcgatcagatcaaagtctcgtcaacttcaatataaaatagggcactttttaatttaatcatcacctaatgagacctaaacttcccaccaacagcagttacgcgtggatatatcagagataaaatgagacccaaggcggctgtgccctgattatgatccaaatctagggttccaaaattattagactacgagtccacttgcgaagtatggcatcacatctgacgtgtagacttgcatatgcaaaacacttgagctaaaccaaccaatccctacacgcttaattgcactgcgcactgcgtagatttttggtggtcagggcaacgaattttcgcaatcagaaaagcgaaacgaattaaagagttaactaatacaaatttagaagtagactttgtcacaggaaacatctatgaaagttcatatatatgaaataatgaaaacgttatgcatgcgacaaagagtttaacttagtctgactgaatactgtatatatccagaattgaatttgaatcacatcttttgataaagatatatatgtcgctatagcttgagagataatccccagttagcagtagcaattagcaattactagacggaaggcagtacagcgacacacacacacacacacatacatatatacataatatatatatatatatatatatatatatatgcagttttaatttacatgcacgttcactgttgtgtcaatctggtaaaagtgattaatctcagctagctggatccaagtaattaattgttacatatgcaaggtcatttttcaacagggtataaaaaacggtggcatttggctgttaattttggccggaaacctggaaggtagcagacactatccttaattaacaaacttgatctagctgcaagtagtaaaaaaaaatgcagatatgtactgtagtcaatgagttgtagtcaatatcttagtctgattaattaattggaatggcccatatatatgggacaattacgttcttccttttttttaaaaaaaaagaaatttcggtcatgattttaatttaccactggttttttaattttatgattttcctatcatttttaactaataatttcacacatgcccttgcattttatcatgacttttgcccctttttttaatatgaattcaatttttaaatgaaaatgtgaggacaagctagcataagcttgaaatgaattttaacaccattaagtcattttaatgaaatgacaggaacaagcttcagtcaaaaaatgagagcaaagttacaaagttggaaaagtgggtaaaatcataattggaagtctcaacagaggtaaccataaatgcctattaaatatacactgattgtctagaacgaaaacactatgtaagatgtaattagttttagcattaatatatagtttgtggttttttttatcacatgtatatagtttgtggttgatgtaatgtgatgataatcatactagcttaaattaggttgtataaaaaaatttcaagcgctgcttgcacttggcctcatcaatcatatctaacattggacgaaataatactataaccgttgtccttggtaaaactacaaatcactggacggcatattcaagcagagacaaaatttggcatatagcaaggtgtgctttaacagcataggatcggactaaaagtccatttatgatcagaacttatgaagaaaattaaaaattgcaggcttggctgcgctcggccctgcagtcccccattttatgatctggagtaacttttagtgtatatttaaattagaagaaattacacttgaatttaattacaaactgattaattacaatatgatgcaatcacacatacatacattaactgagcacaaacatacgtatatatatatacgcatgccgtacacacatacttatgcacacagtgtcacatatatatctcacacagtacatgaatatatacagagtacagtacatgaaacaaaccgacactgcagtcggaaaaaaagaaagaaaaaataaataaaaataaagccaattaaccacaaacacatacatacacgttgcggccgtatgcagatgcaaagaagaaatacttattagaagcgagcaattaataattacgtatacgcacgtaaatacggtcgtacgtatactagagctcgcagacggtacgtacgtacgtatactgatagtctgatgtacgtatatatgcatgtgataatagtacaagtttcgtgttaattacgcgcgtcaccgattaattagtataattaattaattagtcgctgctgtggaagccgaaccttctgtcgaagaaatggccgacggcctcgaacgccgggcggaagaacccgccgctgcgccgcctctcgccgctgccgccgccgccgccgtagccgtcgccgccgtcgtacggcccatgcggccccccgtacacgtggacctcgcgagtgttgatgtacagcggcgacctcgcgccgttctggggagtccagtacccggccggcacgccgccgccgccgccgtacggcacggatccaccaccggtgtaacctccgccgccgccaccgccgtagtacggagtaccgacgccggcgccgtagagggtgacgctgccggcgttgtagccgccgttgtaaccgtaaccaccaccaccaccgtagttagcgccggcgttggccttggtgctgccgccgtagccgccgccggatgctgcgtagccgacgacggcggcggtggcggcgtcgtcgttcctgccgctggtcttcttcaggcgcgacggcggcggcggctggcgcttcgccgacgtcttgtcgccggcggcggccgcttcatactgctgctgctgctgctgctgctgccgtcctcctgatccgtaggtgtcagtggaggaattggagtagctgctgccgctgaaggatctaccgctgctgttccacatacctatccagcggtcgatcgaacaaattaagctaataaaattgcacgtacatgtcaagaatattcagagattcgatcgttgcgttgttttatatatagtatatatatttggtggctgcagctaatacatgtaattagtatgtgatatattgcattcagctgacggtatacatgaacggatttgcaaacgaattaaagaaccaattatcatatactcctataacggatacttcagatatattcagaagtattcttgaattattgatcagctagagtttaatgaactgtgtctgacgaatttgattatgtcgatctggttagctagtggttgatggatgaactgtgcctgatatggtagttcttcaagcttgcatggatgaacataatccgctagaacagtaaaaagtgaaaaagaaacataaaacaaagtaaaaggaggatcatagataagatacctttaatttgtggaggagatgacacttaattggatccggtataaggcaccctctgcagttgccaaggggcgttctatatagagctagtacactcaagtcaaccacacttcgagtctccggttttgcaataaaaaaaagaagacacttgtcgtcttagctatagagaaaaagcttcaaattatctgcgtcatatttgaatgccacccacaatgattaccatattttgtgttaatgtaaccgggggcgaatttactgttggggctccaattgaacaggtaacaatgtgttagagcaagcaggaacaacagtttgcagtagaggagcaagtaagaaagaaactgaccaactggtttgctacgatgaagccggccaagcttcatagcttcagattttatccaatcaggtctggtagcatatagggtataggcgatagtaaaatatgaatatcaataatttaggctttaggtataaacttacaactaatttattctttattattaacactacaaatcattttactttcatttttggtgtttcagtactaatttgaaattttatgagcgttaaatttgtgttatggattgcgacctaagagccccaactcgattttcattctacattcgccactgaatataactaaagttaaaattaattaacacatattaattctgccaatgaatgattgatcttcttaattatatgatcatttaacagttaatattcgccactaacaatgatcaagtaatgatagattcatgatttgtgcgtgtgtgtactgacactgttcacccagctagctaattaattactctcaccagaaaaaaaaattaaccctcgtggtaattaatctctgcaccaagcgagaacctttgatcagaaattaatgaaaccaacaacggtcagatcaagctaggtctcatactgtacttagaaagtagaaaatgtgtcacgatctagtatacgcaaggctgacttctagggatatacgtgtgcttgcgagttgcaagcagccaagaggacgtatgaactgtatcatttcatgaaacagccaatccctaactagtcactgcattaattaattaaataattacagacagtagtctgcactagtgcagagagctcagatcaattgcgattatactccctcagtactcattaaaaaaatcgtttagaacaacgtttaagtcaaaccttaaaaatataaattatgaataactcttaagttgttgagtttgaaaatataaaaaatatataaatagatttgtcttgaaaaataatttcataaaaatataaatatatcattttttttaataaatatttttatataaataaaaagtcaaaattatattttggagaccgtatcactatccaaaacaatttcctttaccggagggatcgagtacagcgagagctgtggacttctcagacacgcatgcattaaaccgtgtgcacgtacgcaatttcggcagcctctctctctctctctctctgtagagtaagctaaacagtgacactgaaagagccatcaaaattaaatccatgccacatcagtctgatctggattactttagaggttagagctacattttcacaaccatatatttcatgatcgatcagatcgaccggtctagctaatgaacgcccatagctcacttaagtacctaacctggcttaatttgtagctttaattaattaacgtgcacttgcatgtactgtctgaatttaacaattaatgtggtaaatgatttcaattggcatgcaggcagctcgaatggtgtgtatgataataaaatgttgacaggaacagatactatagtgttaattaacccatgatcttgagcgtgaagttagtagcaaatcctggcttgtctctacaacctcttgcatctagctaacttggttcacacgtcaaaccaagtcgatagatccatgctcgattgacccttgacttgaaccaaattttattcagaaaagtagatgaaattacctgctagcgattgctacgtgccaaaatgacaattttagtatagtagcgacatttatattattatcgcaacctttctataaaattaaacgtaatctctccgttctttcattcgttaaaccctggtcaaagttggattatcgtcatgatacgttaagctaagtagatgaccataaccatttcattaaaacccaactaattgatattattgatctctccgatataagcaagtttaaaacgtttctaaactgtacgattacttgtttctttatttctagctagaaagttcgatggatcaactacctaatattgggatattcatggccactgtatattatattcagaggggattcaaacagatttagacctgtaattaggaaatgtttatatgagaattttacaccaacatgcagaaattcataagatatatgaatccaaataaggagacaagaagcgtacctaacaggatcttcatctctgtccctctaaaataaacagcatctcagaattcatgcttatcct

SEQ ID NO: 64561 - DNA, 55849 bp, Oryza sativa
  unsure (1)..(55849): unsure at all n locations
ttcgccagacgacgacatcgatagcaccaccgacgttggctcgagggctaccacttagatcgacaaaaccgtcacagacatcgagaccactcaggactagtgaacaccgcttatcgaactccttaacaccaacaagttgccgcaagaggacacgggagtagaaaactctcacgttaagccaaggcctactatatgattgcggaccaccctataaaaatggtatttttttataaaaaaaactccatcaaaatttagcaaggcttcaaaccaaacattcaatgctacaaaacgtcaaatgtatcaaattttgacattattaatttttggtaagataccaaattttgttaattttgaaattacccactcttaaaaattagtaaaatttgttaagacatcaaaccaaacaccacccaaccttaattctatattattaaaatttggcatgtttttcccaacaaagtgaacataccctattctttttgaaactgaagcaggagctctgctgtttcattaagaaggaagagagaaaaggttgactgggttgatttttacctgtaatggttttgaagcccagatgcctatgtatcctgccacttatcattagcttctccaggtgagatagaggtttcaagttgtccatagatcaagaatatatcgatcgcgatcttctgcgaaaacggacaatgaattcagagatgtctgattgaggcccatagatctgtgttgtgggactccagtaccttcatgatctcatccctgtcaagcatccaatgtttttaaccatgtagctgttggcttctatgcttctcagagactgtagatgttgcagttgacttattttgctacttgctgacatcccaaaccgcccatctacgagtaggtggtgaagcttagttaacattgtggtttcacttggcaactccagtacagaaccattgagataaagcatttgcagattgctaagcttccctatcaatctcggtatgtctttcagttttgtgtacccgaagtttaggtagtgcaagtaaaacaattggcactttctgaatattgcaatttctcaggcagcagtctgaaccaagacgatgatatttcctctgaaaacacgaacatggaccgaagctgagatgaacattttgctgcttggactaaattgccataatccttttgtaagaagcacactgtgatccattggtaattccatccgagttaggacagtcccatatggtagcaattttttccttcttggatatggttagggctatttctctaacaagatcatgcatctgggcttctggaatctctttggccttccttccatattcattcatttccaaaacctgaagcaatgatcgactagcaagttccttcaggtgacaatgctgctacatctgccattggtgtctcaggttctctgtcctgaacagtttcttcatctattcacaatctgattaaccattttctgtcgatccgataatcttcagggaacaggccgcagtaaagaaagcaattcttgaggtaaaaccaggttgattgtaactgagattcttaacactagtgtcccagctcagctctggattgtttactcagctgccacctaagttgattatagaacaactcccttctcatgctcctccatttctttgtacgataaaaggctccctatagctacaagagccagtggcaaaccttggcatttctccgtgattctttcagcgacagtcttcagattaagggggcaatttctgtcatccaattttgagaaagcctttacatagaaaagagtccagccttcctgcttcggtagaaccatagaatttcatggtctgcaactgctagagatgccacaatttcgattcgagttgtgataacaacttggctgccattgttgttcttaacaattgcatgaccgttcggtgtggcttcagtcagttcagtaaactggaggaattatttttttactccagagaagagagagagagagcagagcagagttcatctgaaaaatctgacaaaaaaaactctctcacactctctaaaaaagagacattctaacagagaactagcaagggttgggctaaatcaatttcagtgcttctctaggtgacaacctactgcgaagtgaactgcagttagtgcaccctaagtattactaagtgctgaagggggaaataaatcatatcagaatagagaaaccaatctctgatccaaccatctgcaaagacaaaaaaaaaaaaaagcgaagaggcacagtaaacaggtggtgtggaactgtggataacttgcatgttaacatagtatcttatctcaagctttgccttttgtgcttaagcattattgactgcattaccaaaagatacataaggttaattaattttaaattcgtccatgtgtccaagtgagacaagtccttcagagctttcttgagtacggatttgacattaatgaaccatggatagtatgaattgcatacagcaaattggacccaatacaatggcagacacaatcttcaagtgcatgtctcaaatctttattgcaaacaaagaaatgaatataaatgagacactagtatagtcgtggataagttttatggaattaatgtacgtagctgaaagcatttcgcatcaagataccaaacaggcatgtgttaaaaacctttccgatgtatgatatcaccagatatagaacaaattttgccaaaaagaaacagtgttcttttcagttccccaaataatgacataagccttaattgacactatgtttatgacacgcttgtcaagatgcatagttaaaagtagctatattttgcgggaaaatatgtagtgcaaaccatatatgtagtggaaacttggaaactaccgttggatcgagaaatggacgtccgagattcgtccacatcaccatgagttaaaatttaactcccagtaaaattttaactcatgagtgaatctgcgagttaaattttaactcatggtgacgtggatgaatctcagacgtccatttctcgatccaacggtaggttccaagttttcagtacatatgtggtttgcactacatattttcccatattttgcgacagaggatactgaatatttctcctcacagctatctgctaggagccaataacttttctccctagcattatgccattgagaaaacaattgacaatttaatctaggactgatcatttcaactatctctgtattattatccacttctgcataagttcactatttggtgaagcaatttgtgacttccagcatttcttggtcactacatgagataagaccatagaacaatccattttctatattaactgaatatatgaaaatctgatacaaatgttatgtatgtttttttttcaaatgcaaattagtttctgttgtaaacagatcataacagactcaaaagaccctcccattattgtgctttttttcgcggggcagcggaaagccagctgaagtttattaagggaaaagaaggggttttaacaactgttacaacaaaattacagtaagcaaacagctgagcaaccaacactagagcacaggcagctcaactcacagcactgctaagaacatacagcaagcaacaatcaacaatcaaccaagaggccgcaacagacccgcgaccctccacacctcccactcatcctcgatagttacacaaagacccgggttattatgctttctaatcaacgcatggagaagaaatatgttcgctcggctcaatcctccttaagcgacaacttcagcaagaattgcctcttgccagcaattcataattataatacatctcaatgaatagatgatcaagtgtttaattactgactgaattcattttatttctgaaaaagaccatcaacctatataggtccatttgctaattgcagttggagatcatcatattttcgtgaccttgtggaagttttttgcatcataaaagcaactaaggcaatgaatatgaatcattatgattaatgatggattttattttatttccgatgaaacaggtcatcaaaggccatttcctaattggagttggagatcatcatatttttgtgaccttacggaagtttttagcatcataaaaacaactaagacgatgaaaatttaaacggaactaataaaactgctcttgttatttaaaaataaataaccaaatgaagttgatgtggctaaaccaataaagcgcacaaacataaccaaacaattccatggatacgagctatatgatgatgtgagaccaatctttaccttgtcacacactccctcgacataataaacttccagtgtacacacctactccggtatagatgctcgtttgagttatatcccagaaagtgttagttactggattataaatctgcactatcccttccgatggcatctgcaaccagagtactacatttccctcatccgtcacaagcaacggatgcactttcacacaatctccaatcccatagaaagatggatcaacattaatcctgtactctttggaccatgtacccttttcagaatcagttagaaaccatagatccaccacataaaaatgataatcccaatgcgctgtacacaaagtgtctttaattccagccaacataaaatgatagtcaaggtcatgatagctaagtctgtcattggcttcctcaacaatgctcttcgccggcccctagagggtcatactccactgctccatcgcgaggtcgaaggaaggcaggcaacctgcctctagaacggagggcgaacattggaggatatcgaagttgaagtaagcagcccctttgaacacaactccatcggtgcagaaacaatcaagctgtacaggtggattctccaccttcctccgctgctgtccaccgacgccgcggcggctgacggtgataacctcggacacgtaacgatctctcaatgtcttcacaatctgaactagcttacgctctcatgtgggagatgctacctggccaaatgcaaaccaggcaagaagctagcattgagcagtctgtactgacgtcgccatagtggggtaaagcggacatggattcggtggtgggtaaggcggagatggatccggtggtagggtcgagcaggtgaatgctatgctccttaccgtcgaggaagacgaggtcgtctgaggtcgcactcacaaccatgcctctccccacttgggattggggttttgggatcagctgcttgacaatgtcgccagacaggtcgacaagatcgacacagaatctggggaagctctgcacgccgatggcgaggaggagggcggcgtgaaggggggtggcgggcggcgtgcgcggcggcgaagagcgggtcggaggtgaaggagcgcgggcttggcggggaggcgaagcaagacctcgtgcagcatctccggtggcaagacgccatcaaccacggctccgaaccccttgccctcgccgacgtccatcgacgcgccgcggcggcgaggctagggctcacggcggcgatgtctgaggctcacggatggaagtatggaaccgcggctcgcagcaatcaaggggaacaagtctattctgccttccttatttgtttctgctaatcgaaacttctccctcaaccgcaaaacaaaccggactgagaactttcttcatcttcgaaaatcggtgaagatttcgtaagtggttttatgctgaaacgaaacgtgggacccacgtgtcaacgactcattccctatcaagggatgtgagcatgcgacgttcgctagatctcttgtgggtgtcacgccccaaaaaattagccaaatttttcagactattttgtgtataatttcttgtccaggaatcaagccaggtaataatatcataaatctttatacatatcgaaatataaataaagcgtaaatacttgcagcacagacacttaatcctcacactaaaaagaaagtagtggcggaaaaggagcgatcctgatgacgctctctctcgtggcccaatcttctggtgaggggatagctttctctttgatcaagcgcgacgtttgcgatgtggctacgaccagaacaagttcaagacgtcgtgtaatcgctaccccacaaacgatatcgtaccaaccgtgacgcgtggttgatgatccctgcaatgctaacgagagaacattttaagaacaagataggatgtaatctaaatattgtgaataggtgattaagcacaaagaaatagttgtaattgaagtggtaaatctaatcgattaggcaaatcaacacaccaactattggcggctctcaatgcatagtcgccgactaattgagcgagaactagagacatgatgaatggcactttgcaaaattcaactaaacaaaatccaattgttttagagggtctacataaacatttatagaggttaattcgtggagctgaagggagacacttccgagatggccctagtctaatacaaggcctaaggccaagttcagattcagcaacaacgatgattcccattgactcgagataaatttggatgaaaccggattagggtgtggcaatttccccgttgggccggggacccgcccctacgggggcggggccgggggagttctcacccgtgggtgagtggggacagggccccgcataattccggcgatggggacgggaatcggaattaacccgcgggtgacccagaggggccccggatatgagttatttctataaaagttgcacattgcaataatatagacgtaggggtgaaaacaggtcaggttcggtcagatctcatccttcccatatcctaacccacaatttataatcggaatcgggtcggacacggatagtatcaaatacggatataaactcggataatatcgggtataaatatagaacgaatacgtaccaatacagatacatacgctatcggttacgagtacttattgagacaaacatgtattacacgtactagacaataatacctaagcatagtattatcgtagttaaaaatcattttatattgttgttgggcaattcctcactctcacacagaaagtctcgatttctctctcctaatcctaaacagtcatctctctaactctctcttctagtcctagacagtcaatattattgttagtaattgttagacagtcaatattgttattgggccttgtggtgaatgcttagggtgtgttcgcagctggttcctaacccggaataacacgggaaacggagcaatccattagcacgtgattaattaagtatttgctattttttaaaaaaatagattaatatgattttttaatcaactttcgtatagaaactttttacaaaaaatgcaccgtttaatagtttaaaaaatgtgcgtgcggaaaacgaggaagatgagttgagaaaaagggtgccgaacacacccttagtgggttggtggttggtcttttggctttattagggtaggcttgtattagattatccgagtaatacccggatatttaacagggtaatatccgtattttttccggataacccgtatccgtcggataccacgctcccaaacccgatcccatatccgacaataaatagttgtattcggactcgctacctgtgaaaacatccggatacccgaatttgtcccgaaataatatggtcgggcgggcggtcaggaaatatccgtcccgttttcacccctatatagacccaacaatcgcattcaaattaacatataaaagctcaacaccctagttcccctcaaccgtaatccctttccttccttgaaccaacccgcaccgccgagggctattgaaattttatcatactattattcagtgtattgcaatatttgtatggagtattaactccatccggctgatgcaggaccccggtcacccgtcgggtcccctgtgggggtggggatgggtgatgtttttcactcgacttcgtttctggggtcggggcggggatacccgcatgagggcaggggacggggcattccaacccaacccggccctgcccgccccgttgccacccctagaccgaatgcgtttgaaaggtgacgagataagctttctatcaagctcaagatcatctaaatcagagtaggcatgagggcgctatgttcgtttgaagtcagtgttatctccggaggctaaattagacttggacgtggaattatcattggaacgtgtgaagttatatgcgtatatgatgaaatgatgtcctcatcaacgaggtttcagctccactccacaagcaaaaactcaactgggggtacaactgtatgagccttggctctttaactccgtcttcaacacaaaatcactatatatgaaactagacctgccttaacttaatgaacaggttaattaattgatctcattttatagttaacctatctcatgcttatagttgcattgcccattcttatctgacattgtgcagctcgatcggtgcaccagcaggtttgttccgtcccctttcacaatgagaagtcattttaatttttggcactttcgacctgtttcgtatggcaatggagcctccaagttgcacctaaaagcctaagctgatagggaaaggtggacaattcactttatacacttcaacactcttcctcacacgagaccccctcaagtctcagcgtggaatattggagtgggctgcaattattttatttnnnnnnnnnnnnnnnnnnnnnnnnnnnnnnnnnnnnnnnnnntgataccatattaagttgcatgcatcagccagttgcacctaaaaacctaagctgatagggaaagacagtcaattcactttatacactccaacattatccaccaccacgccggtagtagaggaggacaaggaggaggcggaggcaacgatgacggggacaaaagaggaacagtagcggcggcggccaatgttggagtgctgctgcacggtggccgccggagctaggcggtggcggtggcggtggcggtggcgcttgtgcttgtgctgtcagccgccgtcctatcttgttgtcgaagaatccatcttttgaacccatctcgtcgaaatcctagagcaccaaaacacccctacctggcgcgccactgtcgacgtttgatgtcgcaattctggtatttgcatagtatggagatcgtcggtgctaggatatacgcgagactgaggtaaaagagacggagacagggacttttatacaggttcgggcccctgaattatcaggtaataaccctatatcctgttggccgaagccggtattgctcttattcaccataatcacaccagtacaatatgtggggtagcctatctaactgttgtcgacatggcggtctgaaggtctgactcgtagtcgacaacagggtagtcttcctcctcgaatccgtgcccggcgatatcagagaaaaagacaatcccttcctatagattaccaaggaatagtaatctttttttataggtgaaattagattggatttagatatataccattccttgattatatgagaaacgctttcgtctctactgacagtatccagagacaccataggggactagccgtgtctatccctgaagtcgatattcggcgtcttgtcttggtgtatgttgtcttgtatgttgtggcctctgttgttccctccagtctatggtgggtgtcaattgaggtggtcgtgttgtccgtccccctctcctcctagagggccttgtatttatacccataggtgtccctttgttcaagtagaactagggaaaccaatatggatataatccgaatagttcttgtcgtttccatgtagaactctggttgtctttccttatccggaacttcctccatatccgcaggttgtttccatataggacatggtatgtggtgggtcctgccgagatttagtcaactactattaggtatgtggtatccataaccctgacagtagtagagaaagaggatgacacgtggatcctactttattttttaatttatttgttgactgagatgtcacgtggacgtcacgtcaacaaaaccgttctctaaaaccatcaagagagtcaatttacaccggttttaatagttgattggtcgagaactcagggatatgccactagttaagggagtcaatgtgaatcttattatgaatcttattattcctgggtatccatccccttaggtctagcccagaacgatgagtggaccaaggcccaacagccacgaagtgccgtcgcacgccgcaccactgcacagatgcaggcctcaggagcatgtcgtggtggttgtgttcggcagccgaggattgtaagaaatttctcgcgtgcatacttttcgaacggttaaacggtgtgtgatttttgtaaaataaaatttataagaaagttattttaaaaaaatcatattaatctatttttaaaatttaaaatagttaatactcaattaatcatatattaatgtctcatacagtagaattgttcttttagaaaggcagattagtagtctttgtcaaaactgttattacagattatcactgttctgctctgttaatttccttctagttaactgaactatctgaagccacaaggaatggcgcatggaaactcttctgtaacttttgagcttctttttttttaacaaaatgggatggcttcatcgcattgtacatatggcacattcgcagaatatccggcaatgccacgccatgactcacgatggggtcgctgggtcaagtcagcagggaaatgctcctcatcgtgcacgacatgcagtaaatcggaaggaaaaaaaaaagacctgcttttcttttctttttctaatgaacaaggttggatcatgatctttattatggatgccaaaatagttttgtcgcaacgtatttggaaatcttgggtgtctagttcaagcggtaggagtaaccactctcttaaaaaaaaatactaccactaattgcagcgggttttgtttttttaatcaagagtggttttgattaaaaaaagagtttcagtggaatttacaattttttagggcaattattttttgtgaaccaccagattagtgtcgattataagtgcaattgagtagctcggacaaatcagcctatgaacataggcctagtttagttcccaaaatgtttttctcaaaaacatcacattaaatctttagacacatgcatggagtattaaatatagaattaaaaaaaattaattgcacagttaggggggaatcacgagacgaatcttttgagcctaattagtccatgacttgtcataagtgctaagtaacccacatgtgctaatgacagattaattagactcaaaaaatttgtctcgcggtttctaggtgagttatgaaattagttttttcattcatgtcccaaaaatcctttcgacgtccgatgaaacatccgatgtgatatcttttttttttcgcaagctaaacatgcccataattgttgcagcaaagtcagtcaaggagacatcaccaaaatacttcataactagtgtatcactgtggagcagttgcccggaatttgattctgtggccaacaagctagttgcaggaaagacgaatatttatgcgcgagaacacatgactattaacgctgatttgggaattaataatgagcagtggggtttggggccagaagcaattcatggacaaaacaattaatttctttgccaagaggagaaaatgatattcaggacatgagaatgatagcagtgcacaaatgccataaaaagcaaatcttctttcttagccaagaagcttttcttggaagtactagactagtactaccccgtcccatattatgtcgctttgagtttttatttgtaatgtttattcattcgtcttattaaaaagatttaaaattattatttattttgtttgtgatttgttttattatcaaaagtactttaagtatgacttatcattttcaatatttgcactaatttttcaaataaaatgaatggtcaaatgttgcaagcaaacagtcaaagcgacaagtaatatgggacagaggcagtaataaagagagcttagatgatgtttttttctcccgaagatgaagattaagtttttttacgcaaaatgaggtggtattaaagtatgattgattgagttttaactattacaaacttcaaaaatagattaatatgatattttagagcaattttcatatagaaagttttcgcacgaaacacacagtttaacacagtttgaaaaacgtatcacaaaattttttatcttcattcaattcttgttggacaaaataacgagaccctaacaagttcaagaacttaaagccgtttcaatggacttccaaggtttccgtggagtgatatgtacatatattcaagttgcatgtttctacttttttattattatatatgataataaataagacacatataccgcatcacattggacatttactctagtgacatttgttgaagaaaaaaacatcttaattcaggccatgcattttcttgggcatctcaatgcaaaagaggagaatgacctcaattggatgcctccaaagatatattcttacacatcacattgagaacaaaagtgaacacattgatggccacctccaaagcccccactatttcaacgttgaggtacctttcatcgaatttggataatggtgtcgcaacatgtggacacttattccattgactattgcgcatggacgcttggcagcaaacaatttctaatatgggacaatttctaaagcaacaagtgccgatgcattaatatcgaatggggaaaaaaacaatggaaatcaatcatttgagtcgatttgcaacatatacccggtccaacaagaatattttatatttcccttgtcttgaaaacaaatttgtttatacaaataagtgacgcggacctaaaactcagttaaccatccaaaactattcatactcaaactcccttaaactattaatccatcatttcgcctataactagttataagccataacatttactagcaaacaaaagtaatacatagataaaattagaggttgttcatattatagccaaaataaaccttacaattttggcaagttgataatattattaaaattttgataggatttcttatatatttaccaaagtttggtaacaaactaaatgtagacacttttttttggcaatcttgttaaaaagaagttatggttaaaaataacatcattctgaacaacccctagtatacatatgttgtgaactatgatgaaaacgtcaaaatcaactttaaaattaagattaaattccaattgtgattgatgctgataagttgaagagcaattttaacttcagaaaatattttaaaaataatttaggtttttcacatattttcaaccacttaattaggttaaaaattggccactcaaatcggtttttactttttaaaagtataaagttttattccaaaagtactctcattgcttcggtttaccaccttttcaaccacaaaaggtaaacggtaagaaaacactacaagcttgtttggcacagctccagctttctttttctgagttggagtccaatcaaacagtttcggatccatctaaaatgggaatagagctagatgaaacattatcacaaaataaaagaggtggagttgagtttaaacggctacacaactccactccaaacctaactcctagagctaaaattaagtgtccctttgaatcacacgatttaaaaaacaaaggtatagggaaacataggattcagacaggaatgcaagtctaaaataaaggattgcaaaacataggaaaaacacaggaatgatcgtttgattgttggatcacagtaaaaatacatgaattagataaagagagatagtcttaaaagaaattttctaaaaggttagagtttttgctaagtttcctccaaaatctatatgcaatgagccattctataggaatttcatatgatttaaaaagtttcaatcctttaaatcaaataaccacgtagaaaaaaagttatatatgagtatgaaattacaacgtagaatcttttgcttggggccctaagagtgacactaccaaacaagtcctacttctatgctaagcgaaacgacatatttacgaacacaaaataatttgtaaataaaacttttatatacgtgtagcgatctaaataaacactgaaaatttaaatttcaataaaaaaccctaaaatcaactttaaatttaacactgaaaatttaaatttgggctaataaacatatgcaaaagttaaagccgtaaattgccatgtctgttcatcttgcttatcagaacggaataatctttacacgcgtggcatatagcatgttcttgcaaatttgaacactcgaggccgcgaaagttccagaagaaacgcgttccactgcaacacgcggacgagcgtgacgacgtcagcgtcctcggaacgcaagggcactccggtaatttctccaccccttctcttggcctataaattgccacctgcgccgcggcgaaagaacgcaatctcatcgcaagaaaagaaaaaaaatcctattcaaatcgaaacccctctctttgatctcgtcgccgaggaattaggaggagagagagcaatggccgccgaggagggagtcgtgatcgcctgccacaacaaggacgagttcgacgcccagatgaccaaggccaaggaggccggcaaagtggtaagtttcctggcgcagaattttggggatttttttttgggggttttgttcaccagggggtcgcggttcgtcttagatcgataggattttgaagaaatttaggatttaatttcttgctgagatttgtggcatgtggtgaaatcgcgaggagatcgattgtttctattttggcgattggggcgtagggttgtcgcggatttggggattgccgattctggtgggggagattttagtagtagattttcatgaatatattttaggatgatataatgaacaattcttttaaaagaaatctgttgcagtaattacagggcactctgtatttgacatgattaatcgttgatgtttggattttaccatgagatggggcgatttgatgcttacatctgcaagcgaattttcatccgctatctgtatagtatttgactccataggcgaaattgttagtgtttaaatttaccgtaagatgggatggtgtgatgtgatgtttaggtttgctccagttgtttcatgctgatgattctctaatttgagtataagctttgtttaaatatatagatatattcttaaatagtactataatttgacatgattcgccagagttgaaggaaatctggttctaatctagttcaattgttgttatggacaatagattgccacttcacatgtcttggcattgttatgatgtgatgctttgtacagataagcgtccgccctgtagtattggatttggtttcttgctgcgcggcataaacgaggattttgaccaagagtattatatttgaactgtattagatttggtttcttgctgtgcggcatcaccgaggattttgatcaagagtagttagcacttaccaggctgatatattgttgtctatggaattatcaatggttcttggatttattttctttctgtgcaacaacaacaaggttgccaaagaatatttatctagtatgaaattctgaactagtggtacttatgcttgtcatgccaataactgtgaggctaccgttattctttcttactgcgcaattgaccatttgttcatgtcatgtttccatccctaatgatggccttttctggactgtttgatctacaggtcataattgacttcactgcttcctggtgtggcccttgccgcttcatcgccccagtgttcgctgaatacgccaaaaagttccctggtgctgtcttcctgaaggttgatgttgatgagctgaaggtgcgcagagttgcccacaatcttccaaaaacatttttgtcacccctgtgatagtgagtaatgctgttttctttatccaacaggaagttgctgaaaagtacaatgtcgaggcaatgccgaccttcctattcatcaaggatggtgctgaggctgacaaggtcgttggcgccaggaaggatgacctccagaacaccatcgtgaagcacgtcggtgccactgctgcatctgcttctgcctaagaattctcgcaggcgcaagttatcaaataaaggccagcacctggtgttgtagtaggtattagcgttagtcatcgttatcgtcagtttggcttgggtgtcctcgaatatcatgcgaaatcgattccgagttctctttttaaaattcctgatgatgatatatagtttgtggaaatttggatctggctattctgtacgagtttgctgactattaaagcaattattataatatgatgatgctggcaagcttgtagatagcttgaatttgtcctgaatcctgttctgagcttattattcctgcatggctgcatgaacgacgtttgttcatgccatgaattcgagatgatatctctaggcagcagcatctacttctagccatgctgtgtcctttgctccaatgctactgttatgcttgtttctgaagtatccagtcgatgaggataaggacagctagcatttgttgcgatagtagtaataactgttgtgagttgtgacagtaatctgttcctaacttaccatctcctgatgaaagtcatgttgaattgaacctgctcaaccgctggaagtgcaattggattgcgagtttgtgacaggctgacagcgccaagaagatctcggttcagacagcattttggcttgttcagaagttcagagctctcgagtccgagtgagtgactcgttcaaaactagtagaacacgaagttgagaccaagcgaaaaaaaatgagaggataagataggagttagaacaaagaacagatgggttttcagacatcaacagggcacgttaaccataagagatccaccgatttgttcaaccgtacacgttgatgccaggaacaagtgaacaactgcaccttctattacgtccaaatccaacttcaagtttgaagaatgggttcaaacggacgcgaaagatttgtgctgccatcggttggcaagccatatatatggctgattggaaataataataataataatttatggtaaaacttttctttatttgtccttaacgatttaaacaaaaatacttcaaatatataatttcaaaaaaaaatcaaaatcaacttttaaaaatccatatttcggaatctttgcttataaaaccagtctctttttttcagttttgtttatataagggcagggctctgcctgccaatctatcaaggaagaggagggaaaggagtcatagcatgttgagttgttgttgggctaaatggttcggcccgtctctgagtgggccttatcgtcgtcttcggggttagcccaaaatttaggggtactacatactgagggaaagagaaggcgaccggggctctgctttcctctatccttcggttttttagtggttttaacgaccggaattgtaattttctcacttgatttgaagatgtggcttgcaagttggaacaattaaacactagatccactgatccacatgcataataagatgaaaaagaaaagaaaaataggccttggatttgcccaaagatttccaagtcggcaatttctccaatccacgctcgcgagcactcgggctagccagaactggtgggtgacaaattgtgggagtctgggagagattgggccagctatggactaaagaaactcaattcgactgtagaagtaattgaagcaaggaataagtatattttttgtcgttcatcttatgtactcttgcttaaattgtctccctcaaccataaaatcggatataacacattccttctctttgaaaaccggtgcaaatcgattccttcaatagtacgggaaacggttactacaggtgaggtccatatgtgacatatgatatgtcattgagatatgacaaaaatatgtggtaagccccacgtgcaccggaaaatctttcgggcctgtattttacaccagttttggatcaattatggaccttccaagcaggccctaagtttaatattttgaacccagcgagcaggttagggcctatttagttggcaaaaaaaaatgttgcccctccatatcacatcagatatacgaacatacatttgaagtattaaacataatctaataataaaacaaattacagattccgtcaggaaattgcgagacaaatttattaagccttattaatccgtcattagcaaatatttactgtagcaacacattgtcaaatcatggcgcaattcaagggcgtagccagctaggtggcaccgtggtccatggaccacctaagaatttgaaattatagtatatgtgctagttaatataataaaaattgtatagtggaccacccttttaattggcatattacatatagatggaccacctttactttaaatcctagctacgccactggcgcaattaggcttaaaagattcgtcttgcaatttcctgacgaactatgtaattgttttttttttttgcatctaatactgtccaaacattcgatgtgacaacgtgaaaaattttgtttggaaactaaattggaggaaaaacataggaattttggatgattccaattctataggaaaattttctatgaagccctttgaaataaaggattgaattctatccaatcctttgaaattcttatggaatggacaatcctatagagattttggaggaaatttagcaagagcttcaacctcttggtaacttttctttgagtctatctctctcatccaattcctgcgtttttcctgcggttcaatcaaacggttattcctgtgtttttcctgtgttttgcaatgctctattttccacttacattcatatcaaaattctacgttttttctattcctacgtttttttcaatcatgcgattcaaaggggccctaagcaggctcctattccacgaacatacatacacagtccaactaaactgtactcttatatatacaccattgatttctctaaatggaaaaacacaacgcagagcttttttatataggttgtgtttagttcagcgcaaagtttagattttggttgaaattgaagatgatgtgactgaaaagttgtgtgtgtatgacaggttgatgtgatggaaaaggactgaagtttggatccaaactttaaatctaaacacagccatagtaaggtacaacagattgcagtcctacttttatttcaagagcaggtagaagctgatgagagaacaaaatgctaacaacaaccctatgtttaggaggaaattagtaccagctggctgtacaaaaatcactactggagtagtaccgtgcatgattagcaccagttcagctcgagacaaatcaatcaccagcagctgtctgttgggttgtgttcacatcattgctacttccaaacctatcaaagtttaatagtaagatttagttccaaacctattaaattttaatagtaaaatcgagtagtttcagaaactctctcataaaaacattaataaaatacgataaggctctaaattaaaatagattcaagataacacaaaattgaactacctccatttcgaaatatagcaatttctacttatgtatatgcatatgcccctatccagatacatagctagaaattatcatatttaggatcagatggaggtatgaaaattagtactacctttgtttcaggttataagactttctagcattggccacattcatatagatcttaatgaatctagacacacatgtatgcctagattcattaacatatatataaatgtggacaatactagaaagtctcataacattagtcggagtaagtaccaaattttaataacaaagggaacaagccgttgattttaattttcttttaaaactccaattttaataacaaactgttgtgttggagaatggaatgacacgaagaagccaaaagggatggagtggatgagatggcttcccagtttggacggcccagatgagagcacaactgccaaccgcaccaaccaccaccccagtagtccagtacaccgaaccctgagcacgcgccacgtaggacgcccgcgtgtgaacggaaccccacgagccggatatttcgtggaccaaacgcgcatatgcgccacgaaaaaaaagcccatattgccaaataaaattccattttcaaaaatcgcctaaaaaacaagctaggtttcatctgggcgaggccgtagctgacaaaaaacgaatgaaaattaaaaaggctatgtgctacacgacacgagaaatttaaacatggaaatttatcgcaactggagcaagttggaatcttcccagcaaacacgtaccagccgcatacctacctacgaatacgttttttttaaaagaaaactgagtaatatttactttttttttgtaatgtactgggagttagatgctgctgtgacgatgagtaagcacagcgtgtgttttatagggatgtgaatgtgcaaaggggctagaagacttgtattttattgatgaaggaatggttcgtaggaattgttgggaattttattttgttacagttgagtcgttttcaacgaaaacttaatttgagaaaagaaactggtagaatgcattatatcatttttttttaccctctatgtatggtgagcttcattggtggcgaggagagctgacatgagacgacaattcaacataaatcaagtctcataatctatttcatggtattttggttcgtcatgtttacatatcggcctctagccttgctgctttgctagcttggaactggatccactagtgatctttgttttttctttccttattggtagcaaccttgtgtttcaaccaaaatatatatatttcttttgttgttgaaaagtgcaaattaagaaacaggaaaaaaacaaaatactattacacactattgaaaacacatgtaaaattcaatcacatgtacatgtgtacagtgaggtggtttgtttagaaaaacaacatttgtttttttaaaaaaaaataacaccggaagctttgatggaaaagaaatattagagatgcaagtgaggcgggtttgtaggctttgaggcccactaagccgtaattgtcattatcttttttatctgtttatatactagtgggtgaaaaataaactgatgtgtatgtcttacgcatgatagcatgctgcccgcttgcattcctagaaaatacttcctccgtttctccgtttcttaatgtaagtcattctagcattttcatattcatattgatgttaatgaatctagacatatatatttatttagattcattaacattaatatgaatgtggaaaattgtagaatgacttatattgtgaaacggatgaagtacttttgaagagataatatatattagtgggacaatcgactttggaaaagaaaaattcaccaagtaagagctctagtttattctctatgcaattagaaacacacgaaagtagtccagattcagaacaaaccatatgtgctaggcgacatcattcattcttagttaagctctatagaaccatatgcattgaacattcctatacgcttaaatataaaacttgtatttgaaaaagtccacagtgaaagctcctaatctttctttttttaaaaaaatatcttaatataatatttctccattgttcctatatttctaggttcccgcatggcccatatgtgtaaagaaaaagaaacctcacgtcagtgttgtggtaaatatgtgatgtcgtcttttaaaaaaagatatgcggtgtgttttttttttcaaaatgtactccctccgtttccggttataagacgttaaactattttaaatttgactaattctacagaagaaagtattaatatttacaacaccagcattgtttcattaaatctataatttaatatattttctgtaaaattagacaaatttacagtagtttaactttaagcaaagtcaaaacgtcttataacctgaaacggagggagtatattctagagttaatgaaaaatcatgctctcttattggatttttgaaataaaaacatgggaatcgcatgcctctccagtccctagttggcgaaaagaaacgaaaataaaaaaaacaaaaacgttttctttctgaaaggcaggcgaagaaacgcatctgtcacgcagcacttccacgcgttgctaatcacacaaaagagagagagagaaaccaaacgaaacgaacgccaacccaagccaacccagcccaagcgagaggaagaagtaaacacggcaaataatcaacaccgcattaaaaatcttccatccaagtcaagcctcaagcgactcctcccccctataaaagccccctctcctctcctccaactctctcctccccaaagaaatcgcttcttcttccgcctccgcctcccatggcagctcccagctcgtgggacacctccttccacgaagcaaccacagcaaggcaatagcgccacccaccgctcgcatccacagctgctgattcgtaggaggagcaggccagggagggattcgttgattttatttggcagggaaggagatccgagaggaagaaggggaatatagatcgatggggaagtacgtggagctgctcgacatgggggtgcgcatcgccgcgcggttccactcccactgcccgcagacggcgaggatgtactaccacccgccgccgtcctcctcctcgtcgccgtcttcctccgccgccgccggttcggccgacggcggcggcggcggctgcgcgggcttcgccgcgaagaggatgccccgggccgccgccgacaccgcggagatcatcctctacgccgtcgtctagagttagcctctagactctcgatccagacgcttcacgcggaaatggaggaatgtatttttcttttgtttttctttaaagaggaaaaaaaacaaagtggacttggagattggttggtttattgatggagtgaaatgaaatgaatggaatgatttgatatttacgtgattttctttttgttttcatttaagttcgtactactactatctttttttaatgcggacaaatattttcaaaatacaacaaaaaagaaaaggtatggacggctgaggatggacgcgtcacaagctaagcaatcaaaatctcaaccaaaccgaatcctaggaaagctccaccaaaaataaaaacaagaaaaaaaaaaacgagaggcgcgcaggacaccaccagaggcgcagatctttacctttttcccccgatttcttggtgcttgtgcctaaattcacgccgaattcgtgtgtgcgtggggggcacgcgtttgggtgggcagagcagagcccaagcatcgcggagagctgagttgctggtctgtagagcatgtttggtatagctataagactcctaaatttaatttaaggagttgagtctgaagtagtttatcttgtgagagagctctatccagctccactctcagttttagtggagagagctccacccaacttgtttcgatggacctaaaactgtttgactgagctctagcttcacacacgagcgttttggtgcgcacggcgcgggggggttagctgtagctgtgtggtcgcggtgatgaaatgaatttgccaaccgatctgccgatacgatacgggtggtatatggggaaggaaagatttttggaattttcgtgatctcacgtcgcacatatgttgtgcgtctaggggtaggccggcggggcggcgattctgcggtgccacaccaatttacttcatcatatagagtacttacttgctactccatccatctcaaaataaaccgtaattaaatttatttattttaagataaaaaattatttgtttacttaaaattatttattttaagatgaaaaattatttatttattttttttaacaaaaggagtacgggtaaattgatagtatatcgtatcctctctagcaaacgattgggttaaagtgaaactgctaccaacgtcttttttttcttcacttgatattttggacatatggacggtttacaccacatctccgcatggtaggatttagtatcaagtttacagctcgagcgttcaccacccaaaatccagtaaattttcttcggaacttttgtggagtacaaccaggcatatgccaccgaacacaaggctgtgtgttctaaagaaaaaaaaaacacaaggctgtgctccatagttttcttgatcgaaaacggtgacggaaattcataactgacggagcatggtttccgtaaaacttgtattgtttttgcctctagccatatataagatcttttttcttctatattttaccaatgccgtattgcaatcatcactaatcactaaataattaacgggaaggctaaatggctgtatgatagatggaatttcctaaccaacacagaacctttattcccttacaaacaatatggttttcgactgttctcatcccttcccgctttgattcactacaaataaaaaactctgttactccaagcaagacctatgtattgttgttagagggatgtttagatcgagggacgtaaagttttgacatgtcacatcggctattatgtagggtgtcgcatagtgtcggtgatatgggccggggaatcaggaccagagggaggaggctgcccccgatacccacgtggcactcctccgagggggttaggcctgaggtggggaggcggccgcccctccatgcctgggggtcgagcactcgggctgccctgaccccctccgcatgacaccgcgtgtgcggggttaagtggacgcccccaacacccacctaaccgcatttaaggcaacatgagcaggcgcgccacatcgcattaaatgcggtgcgttgtgcgcccgaccggtttgtgaccagtcgaatgattgatgagaccggagtagtgcgcctgcgtgctgctcacttgtcaggcggcgtgccgcctaacatgccccctcacgtcatgatgatgagaggttatttagcctttcatcccagccggagtcagttcatccaacctagtcaaaagtagggtttccatttctcggtgcaagtgaggactcagaagtcttcactcatttaatggtgaatggcatgggtgtcccccgtgtcagctggttggatatgacggccccatgccgcggcgtctgtgtgtggcttccaagtcaagcaacaagacatgcaatgtcctccttcacccttaggtagacttctacgcccatgtggcaacccattgggatataaaaaggaggtccaagcttggtgagggagagagatcggttctttggctaactcacgcttgaatttcagagattgaagtgcgtgtattccatactcgatcaaccaagcacaggagtagggtattacatgtataaaccccttttgtctcatcgtttctggggccccgaccccgtctacatcacatcttccaccgagtccttgattttcacccgctgcccccgaccgaactaacaaagggggccttactgtcccccgcttgaggagttcacccttcgatacatagggtgttcgggtactaataaaagaactaattacaatatacgttaataaaccgcaagaagattttattaaggctaattaatccgtaattagcatatggttactgtagcaccacattgtcaaatcatggagaaattaggcttaaacattcgtctcgcaaagtaatcacaatctgtgcaattagttattttttagcctatattaatactttatgtaggtgttcaaacgtttgataagacatggtgtaaaattttagagtgggatctagacatgcccttatcttctggatgaacacaacagagaacagatcagcatgtttggaccatgataacgttattaccagctgcatatttgtatgctgcgtttgctcgcccgtgaacctgacttgccgagcacaagaggaagggaggaggaatatgcttttgtttttgctctaccttttttctcccatccgtcacagctgctgctgctacggttgcttggccggtagtagctgtaggtgaggcaaaaaaagacagagcacctagacagaaacacacatgcatgatgactgtgtgtgagacattggagtatggccgcattcagcaagcaaggcatagacggcacatgacgtgataccctcacgcagcagctagtggcatacgtaatccatttgcattcttgcttgcagctgggtgctaactcctgttaatttgtttattacaactagtagtacctttgagggctggattagttttttttcttaaaatacgatacaaacgcaagcgtccacaatacatgtacaacctccctctaagagttatcatgaagcgtcttactgtcgatgggtaagtcgcttaccattgaaagaaaaattactcgtaaatacaagcactcatgttaaatctagggggtttttatattgtagccaaaataaatcttattttggcaagttggccactaaatgtaggtattttttatagccttaaaaaaatagtatggttaaaaatggtataaatatgaacaacctctaggatttgaacccgagaggattggttccaccacaagaaacctaaccagtaatttggcaagcttagagtactccctccatttcaagaaaaacataattccgatgttgatttaacataatttaggataattaatatggatatgaggttgtccagattcgttattctatttggtgttaaatcctcgcttaggttattttttttatgaagggagtagtaaagaatcaatattttttttcttctaaaatatgaagtactcctttcgtcccaaaatatagcaatcttcgagcggatgggacacatcccagtactataaatctagaggatatgtcccattcgctcaaaggttgctaatttactatattttgggacggaaggagtaactatcagtactagttaaatattttggaataaaagccgtactcccttcatgccaaaatataagtacgtttggactctgatatggtctccaagatgctatttttgactaacaatatatataaaagtaagatgttttaaataaaaagatttgtatattatgatagattgttcaaaaataaatctagtaacatcaattttacatgattactcttttatttttgttgcaattaatagttacagttaaaaatttgatttatcaccatgcttaaaaatgactacattttaaattttggagccgcgagatagagtatgacctgacctctgatagagtggttgaggagggtgatgtcaaagcgggcgtcggtctgcgtggttgcgatttttctctcacctcacgttgtggaaaaggatggggatgggactatgggagaggttgggcggcggtcggcggagggtcctcgcgtgtgagtgccttcttcaccgaatgcttcgcattcgcatgcaccttttgtttcttcaacgttcaatggaggaggaaagcgtccccgctggcttttaattatttttctgcctgcgaagctgaccgttggtacatggtcatggtagtaatagtagcctccgtcccctactataagctattttaacataatattttacttatattgtttaaccactcgtcttatttaaaaatattatgtaaatgtaaaaaacaaaaagttatgcttaaagtattttagataataaagtaattaaaaaaataatagttctattttttttaataaaacgaatggcaaacagtgcaagcaaaatgtcaaaatcccttatattagggatggagggagtagcgtttttacccgaccgggaaaagtctatccctttagttttcaattcttacttaggtcaatttttttaagtatagtacagtggacatacacaccactatacacaacatcacactctcacatattcacgaaaacgccctcaagcacatgtctaatgaaatggaaaccaactacgcatgtctgatctcattaaaatttcattaaatacctacttatgtgtgggtaaaaatggtggatttgaaccctcgcatacccacgactctattgttacaccatcagatatcggtgatgaataagtagataatttgtggtaattacttgaaattacaaacaactaaagcacagaaagttttgcctaaagaatattacgacgtttagaagttcaggaagagagcctgttaatctattcatcgtgaacaaagtcaacatcaagttgcttggtttccgtagtaaaatagcacatccgtagcgctactagtggtagcttactacgtttgggttacgtacgtggttatcacgttaagtttttattatctttcaatccaccgtgttcatgttttctatgtagtggttaatttgggatgactaacgaaaggcctcaagccattagccagcaggtaaacgtttgtactccatgtgaccatgtagtttatttaaccatataatacccctagttgtaactcgaaatatatccaaacgacatgttctgctttttacagtttcattgttttgcttatacatatgcttatctgtattgcttatcaataacttttaaaataatttataaggtattaacataaataaatttgcatactaaataaatattgtattgctctctccatcccaatttaatcattagaatactaatatgcattactcattatgtaaatgattagataccatactacgatgtcatttatttttacacaaataaatgagtatataccggttaaatgatgataaatttaaaaagatcacaaaaatcttttcaaattgggataaagaagaaaataaattcattgcatttgttcccgtcagctactagcgagacttcccggcacataaaacgaagcagcgttttagtacgtgattaattaagttttagctatttgttttaaaaattgattaatatgattttttttaagcaactttcgtatataaattttttttttataaaaaacacaccgtttagcagcttaaaaaacgtgcgcgtgaaaaacagacagaggagttggtaacttgtactaccgaatagagacttggtcctggtcggtgctccacccaaagatacagagcacctacacacagtgacacacccaccacacagagagagagagagagagagagggggttgtggtccttgtggacttgtggcgatgggtggtgggggtgctgggggtagtggatgggccgcggagagtcgtcgcgtgcgctttccgttgttcatttttgggttttgcgcttgacatccggctccggcgttgctgcaagaaaaactgaccgttggatggatggatggccgtggtccactggtcctcgatactgttgcctgttggtacggcaccacaccactctgtttttattaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagaggtaagtttgatagtacagcccactaccagctctaaatcagtcaatgtagtagctaattcatataatagttgcttgctatactattaatatctggttccacctgtcatacacacattacgtcttggagcctgtgctgcaactggctatagatctgtagcccgctgctcttctctctcttcatttatctctttaaaatatatttatagctggcttatagcctgctattatacctactcttactgcaccaaacccacaaggtcactgtgcctttcgcttcggtagcagtcaggtaggcgcctaggtgcataggcctctctctctctctctctatctctctcggtggtgttctgttcatcacaattcacagctcatggcttggccagtttggcctcatcactgcactactcaacgtaaaacaaaatgaagtactgtagaaccaaggcacagaagccacggtagatgtcagaacgcagtattacttgtttcatcaatcacttttaataatttatattttttttcttttttacttccaatcatcctctcatatctaaccataaatcatttaataagagacattataatatttttttcctcgaacctaatcaatactgcaggcctgtttggataggtgctgtagttagcgtatagtttggttgcttaacgcacattagtctaccgtaagaagatagatgctcatgaaccacttcgccacttgtttcttcgctaatgttgtggtgctcaaatcattcgtccgacttgtggcatgggctagcttgtgagttgttacgtggtaaattggagtagccatccaaatagaccctaaataacccaaaacgataactaatatggtacagatgtagtatatactcccgtacagtacagtagagcaaacttgaggcagcaagcaaaaaaaacgggaaaagcaaaacgaagaaacggaaaataggagcgacttgcgagccctttttgtacgagcggagctgtgttcagcagttcagcaccaagagccaaaggctcaaagctatccaagcagaagtccgcgagtcaaattgagtggcgaaaggacaatcaagaacagatttggcctacagctgaccaatcgtaaaaacaatgtagaataaacttaaataataatttatagataaaaattttaaacatatatttatatatgtgttatccgtgattttaaaggtaatgctaaaaaaaagaattacgatggaaaaaccttaaaattaagttctgcaattcaaattttagtagcggcttataaactgagaggcaaacaagattctgcatgaaaatgcttccacagtaaaccaattgttttattaggccacaaaattggcatgatattttttttctctgagacagggtagattatactatattaaataagagaagaaattacaacctcgttgttacaagaaaagaagagataagacaaattttacatgatactattgatttaccacacaacaggttttccacaagtcgatcaactcttcaaatcgtgttgcgtgggatcatcttttgctcatgaaaggtagtgtggagtttgatcttctggacgaatatgggaaagactcatgggtgctctggtatgccaagggcgacgagcaaaaatatgatacattggagggtggatgtgaacctggcaaatggcaaggttcaaaccagcaattgtttcgatttcatacgacttgatgatggatgcagatgcataagtatgcttgacaacacattcacaatatcaacacgtgttatttccgctcccgttcttcgaattcttaagctcatccagctgcgatgagaaatgcagagtaagtgatcaaatgcccagctctttctatacaaaacaatctttttatttggacttcaaagtaagctatccaaatgaaactgaaaaaggaacaaaaagagacagttctgaacccagacagatatgatgatgttatcagattttcataagttatttttttcctgaaagtacagaactgtgcttaagatgttaactgtcataatgagaaatctaaattgggtccatcaggattcaggaataccatctagcttgctgtgtgccagccgattactcagcagatgctatagctatcctatgggctgatggaaaactccaagacaataagaaaggcacaaccatgaagaaggaaacatcgctgaggacagaatgctatatacagaactaacaaaatacagtcaaggaattcatttgtgtatttgcacctaaattcatacagtttaatcggactgaaaagtacaccactgaagtattatctgagtggtggagatcctaaacacgtgcaataccaaagtgcaagagccaactaactgcagtgaagtgaccacacataagcaccaatcttgatagacaagtaaatgttagatttccatagagatctccatctctaacatggcattaaggttgtaacacaaaatgctactgtccatatgaatagatcgagtagcaatgcatttacgcaaacacattaaaatgctatatatatacctgtctgcatgtttccttgtgtgtctctaaaagctcattatacttcaattgcaaatccaacttctcagctttgagcttttcatagtcggatattgatggaccacccagcttctgctgaacaaacctgggatataccagcatgtttagttgttggcttcttccaggacaatcaattattcatgccatcttatagtcaaatcaactcactcgaccgcagatgaaggcttgtcattctcctcatataatgcaacaagaactgcaagatgataaggtggacttaatcataatgtatctagccagtggcataactagaatttgttgatataaacacataaggaacataatgcaaacctttcgtgagagtatcaagcacaccactggactcgaggtactttctgaacgcctctttcttggcttctctatcctacaaagaccatcacaaggccatgatcatcagtttggaaaaacaaattgtagcacacatagctgcaccgtatggagatgagtttgaatttggtttactcgttgtagtacggttttttatttatgtgtatggcagtacggtagtatactagtatgctagcatgtgttctttctatgctaccagcttgagagaactgaagcttttccattccaggacccaggacactaagctgaaattaccaaagctgcgaagcaaaatgctcgcggcaaatggcaaattggaggaagattgatcaattcttcctcacaaattgcacactactgtactatactgcaccctacagattcaaccaactaaaccagtactctttaccacaataaataccgcatttgacctttgacattgactcgctgacctccatctccatgcatatgctagctatactaatctcaccgcagaatcaaacatctctctcaccaggggcggatccaacaaacaaactgttacttgtatagttgtattaaggttaaggctctgaaattaagggaagagcttcttccagatctagaagagaagctagggttaacgaacgaacgaacgcaagcaagcaaattccagacccgatgggagagagagatgaatcagaaaagaggatgcggatgctcaccataatcctctcccctgctctgctcgccagatggagatcgccgcccctcccctgttcagccgcgactcgtcttggcggcaggagacgggagattttctttcttttacgtcacaaagggaagggaagacactcgagactctaactactgagaattaagaatttgccactgtcacacatgtcatatactaataaggacacacgtaggacacaattcatattatagacggtgagtagtaaattcttaattactacctccgtcctataatataaatgattttgagtttttgtttgtattgtttgatcactcgtcttatttaaaaaatttgtgcaaatataaaaaaacgaaaagttgtgtttaaagtactttaaataataaagtaagtcaaaaaagaataataatgccaaaatttttttaataagacaagtggtcaaacagtgcaaacaaaaactcaaaatcccttatattacaggacggagggagtaccattttaaaagtggcaaaaatttaaaagcctcagacgagtactctcacttttatctcaatattttactactttaagactagctatttctttataatgactagtggcccacattctaaaaattaacaaactcggttagcgatcggttagcgatttgtgttaacagcaaactcctcatactaccagcaaccactaactgttattccacgcaccgccactactgctctttcttcatgagccaccatcgttcctcatcactgtctttgcatgtgcaaccgcaccctctagttacactgcatgagccactttttttccctctccctctcatcatgcacactattgtagggactcacggaggcaggagtcgacccgatgaaaagcggagacgctagattcaggctccttcttgctggagctagcggttccctgtcagagggaaaaagaaaatggagagagagagttagtgtgtggttgctgagtcactggacttggagatggatgaaataaggtggtccaaattgaaatgtacagttagttgttctgtaaataaaaagaatggttaaaggatgacataatatgaaaatttttaagaatacattgtacgaactgtaatttacttttttttctttagcacaattaaagatgagttgtctattacccgatacttctgtgatatactaagtcttaagcacaactaaagatgagttatctattacccgatagtcttgtgatatattaagtattgttgggtcagtgtacttggctattactaatagtctcatgatatgttgacgcatgaagatgtagacttctattaacacaggctgattaattatggcaagatagattcagctaaaaaaagataaaattaatgccatcaattttgctcagcaataaagcattcgattatggtctccttttctcactgcatgatatacgattgtagatatttccgtaattctttcatattatttttttctacatatacattaatttggactaatattttttctcataattagatagataataaatcatttttcatatttctcctataaaatgtgaagagggcattgtataatttcaaaattatattataagtgtatgtaatttaatgtgtaagatatgaacttatagtataagatttaactttttataaaaatgtcgcacgatagtagataggtaatgaactaaacaaccataaaatatatagagaatctatcgtgtgttattgattttgtccttattctacaatatgtcactaggtttgtcaagttctaatatgctatagcactttgcttaacatctataacataccatcgtcgtctagttagcttccgttagtattatataattttatcataatgaccgaaatagccatgggacgaaaaattccaaataccagattgtaaaatttccaaagtttgagatggatatcttctctgccttgtttataatatgatatttcggaatattcggccaaattttcgaatttctatcccggggatatttcggtcattaaaacaaaattatacagtgctaacgaagtctaaatggacgacaacggtatattatagaggttaagcaaaatacgatggtatattgtataacttaacaaactcagtgccatattatagaacaaggacaaagtcagcggcacacagtggattctcttaaaaaataatctagtcaaaaaagtttatttattttattcaaaacaaaacatttttttaccaaacgcgttaggagaacttcaaaagaaggtaataaaaaaaagaggtttagtcattagctcaaacacacatggttttgataataatattgctacaatcagcactcatacttgcacatgaatactagcatctaactcatatgtgtgtgctccgtaatatatattatctatgtttttacatgagtaaacaataattattatatttgttaataatattgtaattatataaggtacctaactagttttctaagaagtggaaaaatatttttgttaaacataatctagaatgctataaagattaataatgttgaatgctatataatcatatataatcatataatgttactcccaacggatttggaggttggaggaggaggagaaatggcgcgggcgagctatcggctggatctgccgccttcaactgatgctggcgaatctcagaaccgtggaggagaaggaggatgcgtttgcgtgaagccgttgtacggtggaccagtggtcgatggccgctttcggtggaccggatccacattaattccccagttggctgggttggaaactttttttcccctccacttgctagataagcgttagattaatatctctatctctactattataaatagaatagaattgaagatgtttttattggtattttaatatgttatctgtgtttgagttagtttttaagtttgtttacttttaaaaatacagatctgtgtttgagttggattttaaactcgtttgcttttgaaaatacaaaaggagtcatataagaaatctctttaaaaaaactcatgctaagttaaagatgaaatatagctcacgatcttctaatgaattttaccataactaaaccgtataataataataaaattaaaatagcatttacccgttgcaacgtacgggcattttttctagttagataaaaaacctagaagatagattaatataatttattaaaacaactattttacatattttctaaaaaaatacatcaaatttcgcagtttggaaagcttctgtatagaaaataaaagagcagaagttgtgaaatgtagagatgtttggttgggatacactattgccaaagtttgccataattccgttagctaacacgcctaacatgtgcttaacaaatttgaagccacactttagctataagagagcaaatttgacatacttttatatgccaatgacatgtgaaactcatatcacagtgaatgaattttgccttaagtatggcacaaactaaacagacgcctaacttagtaaaacatgcctaacttaagttatggtatggtgaggtaaattattattgtgaaccaaacaatttcgtagtgcagaacacagcctaaaccagctaaagggaatgtggagctgctatcttctcaagaaaactgtcatgactcggtctgaattcgaagaaaataaaataaaatactactactaattttttttctgtattgcatgaaattattcaaattattttctaagaagaactagagagtataaaaatgttatttcctttttaaacttctagtattttttttaaccgtagagcgtagcaaaatttcccagaatcatttggcacagtcaaattcgaacagaaatcaagaaaaatagaaccatttggccaaatctggaaaatggaattttttgaattggatctaactcctgcaaaacttctgcgtataaagatcaacgaattagcaatttagcacaaactaagaacaaaaacttaaagttcgctatgaagaggtgctaggaaggatatgcaaatatacattgcataggaaggatatgcaaatatgcaacgcaatgtgacgtgacatagtaacttcagttgcaaccacattgatttatttttgttaagttattattgcatcatgtgtttaaattcgaatagccagaaaagatgatacattgtcagtttgtcacacggggtaagacaaaatccaagctcagaatggcaatagcaataatgatttaactatgttttcggatcaataaacctaaccgaatgccattccctaaaaaaaaaaggctacactgttagttaccacaaaagtactaacgaacagagttttgagaaaactagtaattatatacaactttttagtttgttattcatggtgtgtttagattccaaaaaaatttggccaaaaatgtcacatcaaatatttggacacatgcatatagcattaaatgtggacgaaaaaaaatcaattgtacagtttgcatgtaaattgcgagacgaatcttttgagcctaattgcgccgtgatttgacaatgtggtgctacagtaaacatttgctaatgacgaattaattaggcttaataaactcgtctcgcagtttacaggtagaatctataatttgttttgttattagcatctttacaggcgaaatatgtaaaattttggccgaacatcttaaacacggcatcagttattcttgaagcactaggctgcgtatatttttatggacgatatagaagaaaatctgtaccataactctaaatttttttatgctgaggatatacaactgcaaaaagcctgcattctgccaacagaagacagggtgcacgatgctgattttttaagaatcaaaagaattatttattgggcccttcttcacagcaaaatcgaagatcactcttggagtgctctaacatgggaactcatctctctgacttgattctcaagccgtcctgggtggcagaagaaatcgacaaatactcgtctttcctgctgcacattgcgcgaaggttgttgtaacatctgcaaaccatttgtaaatttgagagcatgacttctcaatcaacatgcagaaactacctaaagctgttgaacactaccaatgtgaggaagtaacagatgaaaagtaccttggcctttttatctcgagccatcgttacttcgttaacacaagcagagacttgctggttgattatttcaattcttcaagcgattgtgctacaggctgtgataaatcatgcacaagtaaagtagtacatcagaacaaactacgaagtggcatggaagagtagggacatatgagaaggaatgtacccatggtgtcaatgttggttgcacatatgtaaatggtacagacagaatttgctcgagtgtttggatcatcctgcatctgcaaaggaatggagaaagcatgggtaatgattgaaccaaagatctaacagtcctatcaataggtgttgatgaatgcaaagttcaacgttaacacatttctcctgttgataattcacagtaaaggagattcaacagttcaactacacagtgcacagaaaatggtcaaatttatcaaggggaaaagtttcaggaaacaatatgcgaatattactcacagttcatcgatacatcttttgcgttcacgtggaagaacattttcaagctcatgatgaagatactcgagctcattttgcagatctgagatctgctcaactaaaccatatgctgaaacatatgatggagtcattgcttgagcacctgcagaaaattggaaggggaatgaattgttcaacttctggtacagaatgtggatacaatttacaacctatgtgtgctcacctgagtgagtactaagaatatccctcacagcatgaagaaaagtatcacgatcatcaatagatccttcttcaagcattacagatgcagcttgaccaattaaatgatatcggtcctatgcatttgtgcagtacagactatattttgtaagaatgtacacaaagtggataataataagaggctaaccaacaaaatgtactctcaaataaaaatataacatcagaaagcaataccagacggccatcaacaactgagaagtaaccctgcagctccattgctgctgcttttagcagtgaataggcacttgacatttttgcccgtccttcaatctggcaagctatctttagaaactgatgagcagcaagttgattaaccagataattgatgaactgcaagaatgaagaaatgcctcagtgactacctatttatgtaggaaattggtttgcaccaaaacaactgactgttcaaaagatacccttttctgctggcttatgtagcattcctgacgcagaaccttcaaattatgatcccctggaaggtcacagtaaggaacatgcaattatattgccgcaacagagcaaagcattttcaaatgatgattcatgagaagatcacaccttgcaaaatatttgcaccctcaagttgagcaaggtcagcacacaggcttgtaataatctaaagttaaaaaaaacattatttttttatgtcactcacaaagaaaataatatgtcacagttaatgcataagatagccaaacggatgaaaatgacattaaaattggctataagcagcaggaacagagtaaattgaagaaggggtgacagatacataattgcaaagacaaaccagtgaacatgtcagttttctgtagtttgcatttttggagcaatctttagcgtaactgtacattctttttattattttgccggggctgtgacaccatgttgataaagtgtgcttcataggaatacatcattgacccaaggtatcacagaatgcaattaattaaagaactctgaagcgtctgagataaaccatttgcttatccatggtacattaaaaaccaaatttcatgtacataataatttacctcagataggcatctcttcacttgaagtgaaagatccctaagctcttcagcaaactcagagtttctcctcctgaggatgacatggcaaatccaaaaaaaaaaaagaaaaataaaagcagatacttaattaatgaaatgtgaaaattttccgaaacatcacatgtacaaaggtttgttcaagtactaccatacaataaataaacaatccatacaacctaaatgttctcataaaaagatgaagcgctttctggtagatttcgttcaatctactttttttaaaaaaatatatgtcattataatacaatggaaccaagctgtttcatttagagatgtcccataaggatagtaccatgttctcaaaagtttcagctcaaaataatgatgctgtgctatttcagtacagcttttttttttagaaaataataaagtagctatgattatccatgtcttgcataccttagagaatgaacatcctgatgaacaagtgactgctgggatgccaattgggttctaagcgttgagagtatggcctcctccttagcatattctgcttgtgcttctatgtactgtcttttgcttctagcgaatctgttaacaaataaccaagcatcagcataacaataatcatgcatcttaaaatatcaaataaaatgtaaaaaaatgatgttatgtgactatatgaagcatattaagtaattctatgcattgttatgttaactcttttatgaactttacaacaaagtaggaaagataaatgaacaagacaactctcataatgataggggggattgctatgcctaaatactccttccgttttttatgactttttacgatgttgattttttcctaaaatagattttgtttttaggttttctaggtactttttttcctaattacccttattaaatgctaatagatatgaatgcccttgagcttgaccacctcgtatgaagctgcctgccatgccaaaacacctgaatgactgaggaagttggagacttggaggctaaattagagataaaacagatttaataggggtaatcaggtcagaagttttctaccttaagcatattgttaacaaagtttgggaagtgggtgtttggaaggttgatccatttgtttttgtcaaaaacaaaaggttgatccatttgaagaagaactaactaataaatgagctaaagaaataccttatagaactacaacaacacaaggtgtattcatcagaaggcagagttcattgaatttcataatgaatttgcatcacttttgcagaactaatattcaaaaaaagaagtcctaacacagagagtagggttgtggcctgcaggtgggctggcccactgacccacgtataagacattaggtgggccacttgaatctctagaggcaggacaggtgacgacccatggcacagttttttttgtagtttttttttccctaatggaaagacaaatgggatagtcctgtaacatgaagaagtgatatgcaatagaaagacaaaaaagggtagaacggtgacatccaaagactaataaatacttacatggaattaattcgcttcagttcaacagaaagatggtgtgacccttcataatctcctgcgcaaacaagatgaatggaaaattggctgttttctaattcatctctgcctaaagttgttaaacctcatattgaatacctaacccaagtatacatattaataaacatatcaacagtgcatagtacatagcagcaaagtgaaccatgaaaccagtggagaagaacgatatcaaacccttcgtttacaatgaccctcctgcaccctctaagggagaaagaccactcttatattttcaattttttaagagaagcagttggacaaatatgtatactaacatcaatttaaggacatgcataatatctcctatcatggttcaaggtcaatttaagccagtttagcttactcagtgaagaagacagaatttttatggtaaaattgaacggcacaaattcttcaggcacaaaaataggaaatctatatggttacctaatcatgatccttttaccaggaagcttgagttatcgaataaaataacaggacctgttcgcatttgtttaataacatgtgtccatgcaaaatttgaacttctaacatttcacataaaaagtaatatattgctgagaatcaaggtatctttctccaaaaacattatgcagacacaagaacaagtattgaatgtgaaatgtatggtatggagaaactacatgcatgatgactactaaacaattaaaccctcacctcttgacatgtcttctttggcaacaaattggagaggtccctggttgacaaatccccacccaaaaaaaaatcagcagatgataaataaaggttatagctaaattgtgaatttaagattaatttactttggcaatttatcataattccacatttaatttactgtataagaaaacaaattaacatactacagtcttttatagtatttatcaacatatgagatatgaatcacatcaaatagaaaaataagggacaatgaccttgagttcactttaataattcttgtgtaggatcaaataagctcgcctttgcatgttcaagtatcaagatacgtcccaacagtccaacactatgtttgtccctttaggcataaaataagttaataccttctcaaacttcttggagaaccatctgtttagttccttgatacaagccaaattttggattatgtaagactggaagtcactgtatgataggtaaattccaatatctgtgaggaaaggtggaagacaaaatgtattcagaagaataataagaaataaaaacaagcatcggattcatatgatgagctttatttcagtatctctatgtgcatagatgcaagtcaaaatggagttatcaggctttctgcacattttaatatcagtaatgcagtctgataagatgaatgtaatctttatataactgcatgtgaaagacagcaggaataccagcttctgaatgataataagacaactcctgggtggtagcagcaagttttccaagtaatgaattcatctgctaggattacaaaaacaaaaggaaaaataaaatatctgagggacaaccttctttatgatgcacaacactgaacaaacaggctagagagtaccatatattttaattcacattagtcatggagtgttgattatgccataaaacagaacatcaacatgcataaaaatctgtgaaaacaaacagcccagtgaacgctttccttttttcgcatctacggttatagccttcaatatctgatcgctgatagatcctgatcgccaagggaccgatcaggacgattgatcatagatcagccttgattaatcgacctgatcggtactatgtataccagaacctatattctatatagtgcatagtataaaccaatcacagtactaataattgatggcaagatggtcactcacttgccctagtataaagcaactagcagtagtagcacatattcacatgtgctaaaccttaagactagttctaaaagtgattgataggtgctctgatcggacgattaatcggacgatcagatttctgatcgagctgatcaaatgaatgtccctgatcagagttaggggaccgatcaggacaattaatcacgattaatcggacgatcagataacactgatagccctaggccattagatcataaagtctactggtctggttagttatcaaacactatcatgttccaaccgattataggctagataggtgacaggttctaaagccagacatgagtatcatggtgtaatatgaaaagcatatttcagttccatctatctcatgaaaatacagccaagaacagtagaatacagtaatgtggcctctgatttggatgataaaacaaaggaacattttacctctaaacttctcttagcaagtttctcatctaatcttgaaatttgtatattaggattagttttagcagatacacgtgacttctttccctgagtaatggtggtagcttgtgctgtaagcatatcaagctgccattcaagagaagcaagctgcctttccaaatcagaaacttcagctctgagtgtaagctttgagtcactgtaacaaataatcagaaaatcctatgtcaatgaagagatcaaaacagcagggtaacgagataagactaggtgttgacatggagcgaatcatgtggggctgcgctaccactgacagaaccatctgtcaatcactctcaatgtaggagttcagttttaccaaagcatctagaccaaataaattagggaatgatgccattttataacacgtgttaaaccaaataaatatttatacttgtaatctgtaaacatcacaacagaaggtggacaactacatatgcagatccaaacaagaggagcatcgaatgcttttcctgtgtaagacgagatatgacataccggatgtgctcaagactttcttctgtcagaaatgtgtcttcctggttttctccagtctctgagaaggccgaaatactgtcaaacgcaaagtctaagtcctccccctaaaagtcggtgctcaattagcagcatgccactcactagatagagctaatacattgcgataagtgaaaacaagactaatcataccagtaaattttgttaaccaacatggttttcgcctaactaataaccatcacatgtaactcacagtccaagtatttaagtttatcaaacaaagaaaccaaaaagctctatacctccaaaagtttcccttctagttcaagctgctcatacctgcatttaaaaaaaaaagatcaccaatttataattaagctttataagcatcatcagaaatcgttacacagtaacaaaaaaacattgtgtaatactacaattcatattatcataagttggtaacgtgcaattgatccaactaaaccagctctcatagtataactacacctacaaccttaactagatagtgtcatgcaacttctgacttctatggtttatagtactttatactacacatttgtccatcaaacttcagaaagcatgtgcagtgctgcgccttttctcatcaaagcccttctcctcctcaagtttcaaaaacaactccgatttgcccatcaccatttcgcatcccagcacacaccagagttcatccaacccctcaaacctccaaacaattacacccataccataccctctccatcccgttcgaatcaatcaacccccccaaaaccaagcgtaattccgaaaaaacgcccccccaaaacatctagaacgcgacgatcagagagaatttcgtgggggggggggggggggaaggggatcgagcgatggggagtggtacagggcgaggtcggtggcggagaggacgttggcggggcggagcctggaggagacccaggcgagaaggcggcgggcgtcgtccccctggaggaacggccactcgaggctgtccagatcgagtgggccgtcgccgtcgaacccggcggcggcgagggcgtcgcacagctccgccgcgctcatcgatcgccggcgaacgaagcggcggtgggaatggtggaaaaggaaaatatatttttcgcgagggggaggaggagtaggagggacgatgggcccgtgggccctggtggtgggcttgaccagatatgggccgggctatcggcccaggagtggctggtttttctcccatggacattttggccacactgcacagtgtgatctgatattctgatcatcgtcgtagatttgtactccctccgttttatattataaaatattttttcaagcaaacatctttaagtttgattaatttataaaaatatttagcaacgtctatagcactaaattagttttattgaatcccacattgaaaatacttctatagtatgtttgttgaaattgttgctatgtttttcttagttaaacttaaaaaattagattagtgaagaagtcaaagcgttttatactatgaaacggatggagtagtagttatagttctaacatggcgttttgtgctattactttttgaatttgtagcacaaaacaaaccaatggaattatggaaaagtatgagtattattagccccttaagaaaaaaagtgaataactgcattctagagtgattagcattgtgggtcaggagaaaaccaaaatgggccacggcttgggccagtccctttaggacacattgttgctaccatgatgaaaactaatgctattcctcatgttgtaaatatttgacatttataagataatattctcttgacttttgaaaccaatactattagaataatttaaaaaagagtaaaaaatctaataaatctgtgatatcattatatctttcaagatatatctatgcatatcacttcattgtttttacattaagcatttgagaaattattatgatggccaaagtctaaaagtatgataaaaacttgtctaaaagttaaaataatttttttaaccgaaggagcataaagtctatcttagtggcccgggcgacccggggcctggtatatactgtaaatgtctctggatatggtatatattagtgctagctatatgtgggcatgtggccatattcattgaatctatagatacggctgggactcaccaaatatagatggcaataattctctcgtctgttgtagagtcacgttatctcaaaagggagagtagttatacttatagcgtcatattttcacaaaagaacaatcaaattgttttttatattgtataaactatatattcttgcatttataattatattgtgccttttcaaatttaaagagtaattatattgtaattttcattgtgatttttctaatacacgatgtataagagaattaggattaaaaataatttattatccatttggaagaagagataggagaaataagcatgtttacatataggagaggaagcaatcaaataggaaaaaaatgaccgaaattaagtgaaaaagtgtggtgtctcaattttagccaacacataactagattagtttatctaagatgactacagatcaaatatttataattatctgcttttgattggtcaaatcccttgagatatcaaaggcaccttgtagttacatctaaatctacttaccatatatttacgagcaatcttttacgcgttcgtgaaaaaataaatctaattaattatcatcagcgccaagtcttaagctacccctttagaggcatttattttcaccatgcagaggcatgccttgatctaatatgtaactacccgcctcgtgcgcaacttttatagattaacttgttgatatgagtattctattaagccctgcgccgggatgtcacacaatataccgtgggctggtttgggcctggaccaaacctgtatcggcctctatttaccatataaacatttaattttgtcaggaaaatatcaaagttttaagagggttatatgcggcctatatatgcattcctattatttttctactgtttcagcatcggcattaatcatagttcagatagcaaagaatccaataactaattgcaactaccacacgcacggttagttgattatccattgagatcaaagaactcgatcagcttgtacagccgccaggacgatcatataatgaaaattaggatcaaattaatcttgtacttgaaatcttataaacacccaatacttattaccgatgatggtaccagatactccgtccgtgtatcagaatataacaatttttgactatgtatctatctgaacaagagtatgttcggacatatagttaaaaattactataatctattatattattaaaggaatagaaaaggtagcctccatgttcgctctcatggtttagaaattctcacattaatcggagaaaaagaaaaggcaaagtccatatagaaatacaattagaaaatagctgaaattcggaattaaaaaataaggaatattagaagaggagactagagtccatatagaaatataatttagaaatagttaaaattcggaattaaaaaataaggaatattaaaagaggagactagagtccatatagaaatacaattaggaaataaatgaaattcggaattaaaaaataaggaatattagaagaggagactagagtccatatagaaatacaattaggaaatagttgaaattcggaattaaaaataaggaatattagaagtcgagtatagagtcaatatagaaatacaattatgaaataactgaaattcgaaattaaaaataaggaatattagaagtagagtatagagtcaatatagaaatacaattaggaaataactgaaattcggaattaaaaataaggaatattagaagtagagtatagagtccatatagaaatacaattaggaaataatagaaatttgaaattaaaaataaggaatattagaagtagagtatagagtccatatagaaatgcaattaagaaaaaaaatagaaattcggaattaaaaaattaaggaatattagaagtagagaatagagtccatataggaatttaaaactaactaaaatttggaataaatataataaaattaaaagtagagtttagagtccgtataaaaatacaatttataaataactgaaattcgaaattaagaaaaacatgggaagaagagtttaaggtcaatataggaatacaatttagaagtaactgaaattcgaaattaaaaattaaagaatattgaaagatgaatttagagtccacatagaaatacaattagaaataataaaaattcagaaataaaaataaataatattggaagaagagcatagggtctatatagaaatacaatttacagaaaattcggaataaaaaaaaagaaatattaaaaaacgagtctggagtccatataggaatatatataatttacaaataactaaaatttaatattaaaaataattaataactaacacatatataaaatataatatgaatattaaacattagtagttttgtaaagttattgcaaaatttaaaattatgttgtcattttaatatatttgaataatataatgagaaaacatatatgctattatatgagagaaaatataatgatgctagccgcacaatctgcgcgggccaccatgctagtttaggataaagataacaacaaatattatcaatatcatataaatatataatctttaattggggttacatatctggaggcgtggtgtaccaagaatttacaatcatgttcatacattttatttcccattcatcctatatactgctataagaatacgatcaagcttcatctgctaaatcttaactatatgcatgatcaaatttgtgatcggtaaaccttatatagaaccatatggtatgatggttgacggcaacctaattaattagtgaccggcaggagcaggagggcggcagtagccaccggcgccattcccgttggtgcagccggacggcagcgacgagctctccatcgtccacgactctaccaccacaccacttttcctcacaaccggcacggccgtggtcttctccatattgaccatcggccgcgccgccatgccgccggagaccaggaagacgagaagaatgacggcaacaatagctgctaccactgcggtaaacctcatgatcgatcgatcgatcaaatgcttattttttattttttttgactggggatcaaatgcttaattctatcggtgcccaatcttgcagtaggtccttgcactctctgcacatatttatagtcacacggatgcatatgcatgcatgaatacatattgtcgatcgcctgtgtgcagtgtcatcactagtggagttactggagtatggggagagagagacgttttgcgttggaatttgacttagaaacaacgttaataatttgtcgcaaaggggagacgaagtgactgattggttgagccacggctggtaaatcataaaaaggataaacgaagcatccaaaaataatttaaaacaatattttgcacttccactgttttttaagaaacacaatataaacataggcgttctttgaattcgaggataaatgaaggaaaaataaaggaattgaaatcctatgttatccatgcctttgattcgtagaaatgagaaaaggaaaaacgtaggaaactttcctattcctacgattctagaggaaaaacgtaggaaatttaacatccactctaacctcttgtaaaacttcacttgagtctatctctctcatctgattcctgcggtccaatcaaatgttcattcctttatttttcctatgttttacaattctctgttttatacttgtattcctatcataatacttcctgtgtttttcatattcctatgatttttcaatcctacgattcaaaggggcccttaatattttataagcaagagttagaaaatatatagactatatatgatgtaaaaatacctagatcgatcagtaaaaaaataactttcaaattgaaattttgctagataagctgtcgagcagagttgacgaggttgtcaatggatatatatcatcaattcacagagcgaccacggtgtgcgactcatcagtgatcggtggtgtcattttcagactgccgtacgtgcatgcatttttccaggggaagcaacatggaaatgcatgggtgcgcagggtgaccttttccctgctcatgtgtcaaaagaaggagaatgttgtctgcacgatctaatttagcaacagtggatggttaggagtttttgtcaacttttaggtgcatgtatgtatgttgcacgattgtggcttgatattagaaaagttagctatgtgcatgcggatattccttaatacacgtactctatttctaaccccagatcctagaatctttagcagtataaacactgattagattcgactttcatcatctaagggcggatccaccttctaggcgggatggatggctaggagtttatgccctcaaaccattaaggtcgagcgacaatgacagagttagaaccgaagccctgcaagatggtcaactccctaataacctttaaaatttcatgatttttaattcaaatattaatgatttatagtacctaacgtttaactgtgaaatcatactagaaagttatgcacatactcattactaataggtactctgtttctaactcccgatcctagaatctctaggataacactagtcgaatcgactatcatctactaggaggatccaccttttgggctgaatggatgattgccaatgtttcacgccctatgcaagggagtcaattcctcaataacctttaaaatttcatgaattttgattcaagtatcaatggtatatatataccataactatgtgcaaaaacttgtggaatcagctggcccggcccacaggtggaagaacatgcaatggctattgccgagcgacatcccagctagaaacacaaaataatgaggttataaggttactttgtaacatatatagtcttaacccaaattaactaaagatttgtaacatatatagtcttagttaatttgggttataaggtttgtcatggctttacaaaattcatagctctaccactatcagcccgtcaatccattgattattataggacttggaaagaggatttttgaagtagcacatcctcatagtgccaccaagttattttacttcctctagaatgctacaatcatatacaggttaaactattttctatgaaattactgtaaaatccatattattgaacaggctcggtgaattgcaaaatgattaatgaaaaagatggagccaatgcattgtttaatatatgacatcgttgatttttagatttacatttgactatgcgtcttatataattcttttatgcaaacattttaaagaagttttaaagataaattaagttataaaataaaaaagaatgatgagacatatcttaaaaagttaatgatgttatatattaaaaaaccaaaattattaaataaaaggaaccctaaacttagaagcaaacgggcctttaaccggcagcatgcacgtacgcgtggcaaaagaaaaaccgatggaagaaaatgtgtgccggctatcagaaatgtcaaaccagggcctaattctctcttaactatagtattgtcctgcaggccacgacctgaatcaaaacctggatgattggataaccacccatcatggcacgggcctaactcgatcacaatataccctttttcaaaggtcagctgtatgttgtccgagttgtcagtaatcggagcatagaattcaattaaaagggttgtgattttagaggcctaatttgacacatttaccaagaaaaatgattagtactccctgtctcaaattataggatgttcttatttttaagaaaaaaatcaaactcgatagtttttattaataattacattaatgatatctacaccaagtattatgtatgttatattattgttattagattcgtattttaaaatactttcatgtgatactagttttataattgttgatgatataatacgaaataaattaataatcaaaatatgttattaaaaatcgtgtaaaaaattataggccttataatttgaaacaggggtaacacgtaaaaattcacaatttctgacctaattttttgaaatttcaagtttattggtggattcctttaggatgtttttccattcaaacataatcctccccagtccttcccaattttggatgtaccgatgggttcatgtaggacgtttttccatggaaaaaaaatcatctttagatttagtaaaccattttaaacttcagattttttttcaacatccgaaatttaaattttttggtgtcctgaaatgattcggcaatcccagatagtgaaccctgagctcgatcgccaccccttgttctatgagagctgcatgtttagttcagttaattgttgggctctaggcttttgcaaacgttttcaagagaaaaggaaacttcatttcaaataagttgttctagaaaatggctcaaaagtgtgaagttgagctatgcaactagttacttcctccgtcatgagtggtttaaatctagtattcttttttgggtagatgccgtaccccgtatgtacacacgtatatgagcacctgtttttataacgtgtttcttttttaaaaaaatgatatggctcaaaagtctccttggaaattaaatggctttaaagacaattcttgatgactcaaaagtgtgtttttgccgcttttccaacttttttttgtttcgtcaggtcgctgtactagaagcgcctgacatgttgacaactgctcatgagtcatgacactaaccaatatgcacatgctgatatatagagatatagccggtcggtggcgtgcatgcattgcttgcctttcgcatggcttcctcagctggctcactgcaagaaagattttgcagagagtcgattttgctcaaagtcagatcttatcaaccaaatcgtacaaatgtggacctcaagtcttttgacaacttatttttggtgcaaagaaaagtgtgcatccaacatttcgaagttattttctcctcaaagttttgtacttccatgtgataatggggttgaaccaaatggcagcagcagaacgtagagagagacatccaatgcatgagggaggtatttgccatttcagtacttctctgtactttttcccagaattttggcgatcccgaattcaaatatgcagacattcttcgcagattttgcaacaatatcaacaataacaagttgatgcttaaatacaataccataggatctgcgaacgccgccatacatcaacaacaatgtcacaccaacagcctatcggctgccagattagttcttacagcactgactcggttacccccttacaaaacctcgacaaatttacaacacggaataccacatggtctctgtaccaaggttcttacaaggagaatgcaaaaaaaataatccagcaacaaacacactgttgtcgggacatgatgccgtcatcggcgatgtgaggtataaattaaatcgaaaaattgcacgggaatgggaatggatcatgagttaggtttgtacagcaacattcgcagcacctggctttcccacattcttcatgacgcccttggtcgctctgggttttgcggctactccagtctttggagcactcttcggagaacattgggtcctgctgttaacttctttggagttcccaatactgtgacgatgtaaccggcaacatgctgcacttccatttttaccctctggtgtatgaggggtatcgctgcagctctttctccgtgtcaattttggtgatttggcacgagttggaggcacctataaataaaagacaaagtgaataccaacattgcacatgctaaaagctggcaagtttagcacatactaaaagttggcaagttaatggtcgccagttgaaccagcagcttgcataccaatgcttcatgcaacattgtgcacttctattattatcatacaggaaaacataaatactgcatttacattagctattctttttccctgcgtgttcgagaaaaaacattaactacttttaagtaatgtaaaagcctgggacatctctcgtactcttattgttcattcagggtattcccaatttaattatggctctgttcggctgcactgcaatgcagcccttgctgcagcagctacagacacatagtactgtttggattggctgcactacagttgaaacaagtgcagttgaacagggcctatgtagataacaataggaacaagcatgtagtcgagtatgtttttacagatacgcaatcagttcaattaaagggaaaagatctaaacagtaatgggttgagatattatcacttgaattaaaattgcattcaacaacatgaacaataatgagcacacatcgaaaaacagaaataatcattttagctcaagcacatatagcaggagatcggtgcatcaccttcttaagttcaaccttaggtgggggaccctcttgatagaagcttggcatgggttttgctctaataaccagattcttccttagttgtttcagagcttcttcttgctcttcctataaaagttgatacttggacagtgagaaggtatggcaacaataattagcaaaagggaaaatgaccctgctaatgcaaagttaaattaataaattgatccaacttgtctactacgctaactgccatgtcataaaatttctaacagtgtagaaaaagcaacataatgattaacagtcatcagtaacaagacgtagcacaaaccattcagtgaatccaaattatacatgtggtgtctaataacaggtaacaggccataatcaatgtcaaatactctgtagggctaccctgatcatggtaagaaatatcattagggctgtctattagagagagagaaaaaacttgggctgtcagctgtcggtgtcttgtaaagggatgatacctacatatgatacttgtttcctccacaagtcaagttacactaactgatttctgaccatcagtttttccaaaacaaatcaagatggacatttcatgattaaaggcaaactaatttgctgaacaagagcaaaatctggtatgggtgcttatatatttaaaagagtaaagtgcacaggcggtccttaaacttatagaggtgtgtcatttagatccctaaactctcaaaatgcatatctaagtcccagaagttgtcaaagtgtgtcatctaggtt

SEQ ID NO: 64562 - DNA, 748 bp, Oryza sativa
aaaacaaatatgcaagtacaaaacaattgtacattagaaatgcggatattttgggaaggagggaccgagggagtagtactggtaattaaatcttcgggttgcttgggctgtcatcgttgcgacccagctgctagttgtcatctgaagcaacccttttttcccagcattccgtgcctgtccagcttcagctttccaaccgccatgggcctcacgctgttcgatcgacaaacataatgtagatggagacgtacatatatctgtttgacgaagactaattaacactagttgacccaggcttaagctaatcaaccacccaatcagttcaaaacacgcaagccacatacgtgtggtgtctgatccgagcacgtagtagctgctgctgctgctgctgctgcaactttagacatattaatgctgacaatgctgggtaactgaagcttttgttcgatgtttttggtttgtccaacgctattagcatgtgcttaattaatcgtgtagtcagccagtaggctacgtgtccatgtcgttggctcgatctgcctgcgtgtgtgtaccaacactaggacaaaccaacactaggacgattaattctaaggtgtgttttggtcctttttgagacagcttcctttatgaggtccatctgaaggctgccaactgtagtcagccattgtttttttttctttttttttttaaaaaaacttgtagtcagtcgtgattcgaatttaagacctctaggcttgatatgcat

SEQ ID NO: 64563 - DNA, 746 bp, Oryza sativa
tgtaatgaagaagttgtttgggggtggttaaactataaaagcgataaaattcaatggtccaaagtaaaaagattggtttactggtgattcaaagaaaaactataataataaaatatagcctaaatttcaataactatttttttatgaaggaagtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaattgagcatggtgtttgcccccctggttcaatggacttgattgcgattgatgatgattttaattaattgctaatatatactaattagacatgtttcttaatttccccttgaaaaagatgaacatgcatgacatctataatacaggtt

SEQ ID NO: 64564 - DNA, 1323 bp, Oryza sativa
cgctctctcaatctcacttctgtactccctccatctaaaaaaattaatctaaaaaatttaatccagtgtaaatctggacacatataactctattatagatgtgaatctggatacacacttagaattaggtgtttttttgaaacgaaaggagtacgcaagatatacgtatgtatatagagagaacaaaccaaatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctg

SEQ ID NO: 64565 - DNA, 772 bp, Oryza sativa
  unsure (1)..(772): unsure at all n locations
aaggctgaancctnactgtatagagacactatagaatactcaagctngacttgtattcttgttttcgtcgattgaattctatttgcttctctgaattattccaatcaaaactaatacttgttgttctctgaataactgttcaattaatagtagagattcagtaattctttattcaagatcacggatacacatactatataacacactatgcccaaaagaagaaactaaaatcggttgtatttttcttgtcagaatcgcgagcaatcgctaggtacatctttcgcaagtacaaaccagagttcctgggactcggagaacgtggaagcctggaagagtcggcaatggtggacgtgtggctggacgtggaagcccaccagcacgaagccggcgtgaggcccatcctgtggcactagatcatcaacaagttcgaaggccgcgaccgcgacccaggcgtcgaggacgagagcgtcccgaaactggataataggctcgggagagtccaagcgaagctgtctggcttccaggtccctccccgggaaccgatctgcctcgcgggcctcaaacacttctgcaacatgcgcttctncaatgcatccgaatatccccagcngggtcgtccttacctccaccctatatattgtgtgaagcgctttctgccctcccctctgtcgctttaggattagccctccttcccccgatctgccctctcgtggtgcgacaacgctacgagccctctctttgtagctttaatttcccttagacgtcgcggtat

SEQ ID NO: 64566 - DNA, 2241 bp, Oryza sativa
  unsure (1)..(2241): unsure at all n locations
tgcatcaccatcattgtagaaccaatgtgcaacaccagctgggagtgcaacaatgtctccttgcctaaattgatgaatcttttggtgctcatctctaaacttttggctctgactttggccttgagatgaaaattgttggaattgttgctggtaagtcgcagggcaaccggggaaggttaaacccatagaacctctccctaaaaattataatgttcacataaggtacatacaacattaatttgaccatggagatcataactactagttgcatcgatagagttctcgattatatttattaggatacaaaccttggatgatgtagaccacgccaggaatatttgtgtatcgaggtaccaaaaggccttgaggctgaatgacacgtcggatcacaaaagtacccgtgcactggaataattcattcttctcatcgaagtactcagtcaccccagcttctgacctcactttccgaagtggttcaaatgcttgtagtctatcaaatctacactccctaaaacttccttgccgaggactatgccatgggtttgtgctgggattaaatagctgggccatagaaccatggcataatagaagaacacaaaagtatatagaaaaccgagagaaaacggaactcgccatagctatttgtacttgcttatggaaacttaagctaattgatgtgagttcaaagacagaccaagctagtttatatagcaataaaaaagcatcttgggatacatggtgatatagtttgttgcacgtacagacaatatatggcttgtagtgttaaaacagtacaaaaggaaaggtaactttgcaagattgaactatacatttcatgactcagccatgacaaacttctggtgcttttggagtaatacaaatggagtttgttaaagaaatgtctatccatactcttaatatgtatctttgccttgtcattatatttgtttttgcaccataaagctcttatgcttgagaagatgagtctaactttaagatgataataacttgtaagcatgttgtcatttttgcgtagcaagctatatttgataatttaggtgttccttcaaaataacaaatttgtaggtttgttttcatttacttgacaattgataagtaacttgtatttttaaatgacatacttataactntgttgtcttgtaaaatataccggacaataaagcatattggtgtatgtaatttttccatccataagccttcttgcagtttattgactatataacttgcctattgattttttaagtgttccttcaaaatagcaaatttgtagggttgttgtcatttacttgatacactacaattgataagtaacttgtatttgtaaatgacgtacttgtaactttgttgtcatgtaaaatatatcagacagtaaggcatattggtgtaagtaattttaccatgtcataagcctttttactgcttattgacccatataacttgcctatatatattatttaactatttgaaaaacacatattatgataattttacacatctgaccacggagagctgtgaggctacacgtgggcccgtgtcactcaaatccacccaggcgcacggattgcttcccgtgcacctaggacggctccccgcgtgctcccgctctatgtgaatcgtgtttgcagacgagtggacccactcgggataccgcgcgggggaccgagtacactagccttgtgcactcgtcctaggccacatcctcgtccggtccactcggtcccccgttcgtcgtagctgctccgtcgtgtgttcgctcggctgtgcccacgcagcacgctgggccacacgccgccttcagcccaaaaaggcagaagccatcccctttttcctttttctttttccatttaattcaataatactttttttctttagacagagaatcaattaatcttagaaaatccatatctcttcaactgtctgttcgattgactctgttcaacttctaaaattcctcaaaaatcgagatctattcagtggcacacttagtactcactaatacgagcttttccttggtcgttttgttgagttatctcgttccacgtgtagcttcggagccagaagagtcctagtgcgcggaatacgaggaagaagctcaagatatcaagcaaggtaggtcacctttgattattttgagcccataatttgaaactaagtatttcatttctcaaaatgcacatctctaaattacacatgaaatgttggccgcagtttgcaatataa

SEQ ID NO: 64567 - DNA, 1679 bp, Oryza sativa
tccaattagtctctccaacttgcacgcatgatcatcagtctggttcattgagtaaactcacgtatatattctgctgcatgccactagctctatacacatgtagccagctatgtattttccgcccgtgctccggctgtgcggcgacatgtcttcgatcgccggcgccgacgtgccacaccgtcgctccataccggccggcccgctggtcccaagctggcatgcagtcggcggccggcgccgttggtcgacatcgataacgattgatcatatgccgccgccgccgccgtcgcccgcggccggccggccggccaccggaaaagatgggtattgagcgtgtacgtgcagtggacattacacgggatgtgtacgcggtacgttgaaggaattaattaatttatggaagactaattttccttttattaaaaaaatagaagaaatacttcttccgtcccgaaataagttaatctaatatggaatgtggtatttcctactattataagtttgaacatatgtgtttgtctaaaatcgttgtattagaaatatcacattccatactagattaattttgttctgacgaaggtagtaggaagaaggaattaattggtaggaagattaatttcctcagacatatatgagtaagaggaattaatttgtaggaatattacattacgtcgatcgggagagagagagagatcgatttgttgcggtggatgccgatgggagtaagcggcaggaggcctcaaagtccgggaggtggcctgcgcgggtgcacgtgcgcgcgccgcgcgctcatcagcagctagctgcggcttctatcccggccggcacctgactttcagggatttatgctattttatttatatacactactactgctgctggataattcattatgaattcctgctcacaccttgtttggttgttaattcctaatacaaacccagtacacatatctaagaattataatttttttagtttcaagtactttttttgaaacaaatatgagtatatccatattaattttagaagttgagttgaaattattcgaaggtctattactgtatctatcctaaaatataagatttcactcatgcatatatagttgtatatatggacaaagtctctcatattataatataagtagtcaaagtttaaacatgttaactacatgtatctaaaatgtcacttattggtcagtggtggaagcaacttagtttttagagttaattgaaaaagacttcgataactttcgttatgcaagcttggctttcggttttggaccgccgctcatgagtcatgagccgcacaaccgcaaaaatgctttccaagcagctccaaattatttttctgtaattattaagtatatatatttgtatacatatactccttcatatatatatatatatatatatatatatatatatatatatatatatatatatatatatatatatatatataacttcattttaaacatgtgcgcaacaattaaaaaaagagctcagtgacttttgtttctttttattatattctgtattggaaagggtagtcatttttatgttggatattgtttaatttacttggctataacaaacaagaaaggaaataaaatgtgactgtacgttctaaataacctatattcatgaaaaaaaaaggttgattgaaatagacttacatta

SEQ ID NO: 64568 - DNA, 4987 bp, Oryza sativa
tcttgggccggccggcccgtaagctcggccgagccgccccttttctctcgggcggcgccctagcccgccgagggaagtctaatttccacccctctttcttttcttttcttttctttcccaataaggatttaataaatcctttttcctttagacgaaaaatccaagaatcttagaaattcaatatcctcccaaccgtagatccgtttgactccggtcaacttccaaaattccctcaaatctcggagatctatctaatagcacgcttagaggtcattaatagggctttattttcgccgtttgttgagttgtcccgtttcgcgtgtagtttccgagccctaagacccgcagtgcgaggatttcgaggatcaagcttcagctctcgagcaaggcaagccacctttgaacatcttgagcctatatttgaaatttaattatattgcttgcaaaatattatgcattgataggatcgcacttgatctgcttgtcccgtctgcaaggcagattggcagacctacctaattttgttgcatttgatcctccctttgttaattgcgataccatgtccccttgtaaccatctagttgcgtctcgatattcgtgcaccctgcgcgagtatcaacggatgccttcaaacttaaaatctgagtaacaacttgggtaaaacttgggttttgcaaaagacttggaaaacccgacacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatgggagacatgtggattcaccggggtggtgtctgggaggacccctgggcttcctggcacagtatggtctgggacctaacctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgacgtttgaaaatctgtagctgatgggatcagctaggcccgggtggccgtttgaaaagttgttggcccgggtgaccgttgaaaagctgttggccgggtgccaaccttgttttcatttctaaagactgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgctctatataaataattcccccctagttgctgaagaagatgaagcggatcctgctgatgaggagttctttcaggagcaagccggctacgatgagttttagggtttcgggctagttcccaagtcgcgcctgtattgattggtccaagtcctgcttccggttttcttttgtaatgcagttgtgagctcggggtctgtccgcagcccaacatgactgtactactactctataataaaaagacctctgttgctgtgatattctgtctccctgtgataccagcactgtttcctgggactggtatcgattaacaggttaatttggagcgtcacgggctagttccggtcgggactatttcggggcgtgacattcaccttcaccttcaatatcagttgagagttttgaatttgagttgaaaagtttctaaaatttaagttgaatgttttgaattttgagatgaaagttttcaaattttatcaaatattttgaattttgaggtgaaagcttttaaatttgagctaaaagttttcaaacctgagttaagttttcaaatcttgacttgatttttttaaatttgaattgaaagtttcaaatctttagttgaaagttttcaagtccgagttgaaagttttcaaatccgacttgaacgttttcaaatcgagttgaaagtttttaaatccgagttgaaagttttcaagtttgaattgaaagttttcaaatctgagttgaaagtttttaaatttttacttaaaagtttccaaatctgagttaaaagtttctaaatcttgaattgaattttttcaaatattgactcctactcttagacgtgtgtggtagttaacggcaaaaaaagaagaagaaaaaaacaagaaagaaacacggcagttgtgcctaccgaaaaaaagaaaataaaaaagaaaaaagaagcgcgcagactcggtcgtaggaggacccgccacgtggcacgctcgcgacttggagaagtcgcgcatacgcgcgaattaggattcctgtaaacttatatatttgtattgttgacgttttaataggcaaggctgaacgttaagataggaaaaatctcaaagttaacttaaaactaacattcgaaatccttttttttttttgcgggcaacaagccaacaagactataaaatcagagtgccatagagtagtggccatagtgtaaaattaaagaactggtgtgcttaattagattactggttagcctctatgggcaattaagaaaaaatatgttgttttttctaagttattcattgtgtgattataatttaattctatatatatatatatatatatatatatatgatttaactaggtcatgctaagtatgtttccttaaagaataaatatgttgtttttttataagttattcattgtgtgattataatttaattcaagatatatatgatttaactaggtcaacatgaagctgttctatatattttctgactcaaattaggaacatcactgttccagtgggtgaccatatatatttattacgagaaaaagaaactaacctcttaatttaggatccagtatttgttcatgtaattaatttagtccacagatagatgttaacacatggtagcgtataagatagcacatattgatcccaaattagctgtccctgcctttcggattatttgatgttgacgagatacgacttctacaaatttaagataggattaattaattaccatcaattgtttcctggatatatatagcgtgactacatgagatggttccatattaagtggtacatgggagtatacacatcttgttcatatagcagggtcaaagtaattataacaggggtctccaaaaaataaagcttcttataacaaattaatatatagttataactgtgtaattacaaactgtctaaaattaatttcacattgtaaattatatggcagaaacattttttttttcaatttgcaacccaacagtacgtgctagctgtcccaaaaaaacaaggttgcttttcttgagctagcttagcactggctgtctctggctcatcatcagtggttcagtactatacaggaccccatattaatgaaataaataggcaacaggcaccccggccagaaaacatatttggactttagagagtgtcaaagttaacacaccagcaaagtcaatcgaacatgccaccatttatgaaacagaaaccataataataatgcatgatcaaacacataataatatacacctaccaaggtcaggaaaccattaatatttttccctttagcgtgttgtcacttatgatcttttaggtgtgttgccaacctggactcgtttgtctccttttgcatacggtttccgatccatcttacgtaggagtagtagccaaaattaaacatgtgcgtaaaaaaaaacttcaacttttgtacagaggctgcgtttagatctaaagtttgtttggatccaaacttcagtccttttccatcacatcaatatgtcatacacacgtaacttttcagtcacatcatctccaatttcaaccaaaatacaaactttgcgctgaactaaacacaaccagacatggatgaatgcttaattcggctgcttgtttcttttaacatatagtccgaccatcatatacatactggttattcgtgttctctgttctctgttctgtagtactagttaaaagttcaatagtttatgtgtacagtcttaagttaatttagtgttggcctaaactgcacgcgtaccataataattccaatatttctctgttgcatccttccaggtatcgagatgatgacggggctagtgatgacttgatcgatcccaggtttacttttgaacatatagattttacaggattctcatagaatcagtacattttattcgttaaaaggacacctgaaaattactgtttttgtttaaagggcgcgttgttcctttgttagtgatgcacgcagcacacgtatataccacaaatgttggaggagcgtggagctgatctcatgtcagcagagagatgcttcgattttcctctctttttgtcgctaccaatatactctaatcgtatgatctacggctgataaaccatgaaaatcatgaactagcaaccaataatttataaataaatcttttatatccacttattccgtcctaaaatataagaagttttggtaacatcatagtactacaaatctgtacaagctctttgtccaaattcgtattattaggatgtgtccaatccaattaaaactttttatatttgggatggatgaagtatattattagtgacttaaaaagcaattgctagaaaataaattactaacatagaaaaatatacaaagtttacataagattacaatttaaatataaattttagttaagactaatgaaccaacaatgagacgaatctatgcgaaaagaaggatgaaaatggagggagtacatgtagtagtactcctccagtagacagaagtgagcggat

SEQ ID NO: 64569 - DNA, 3760 bp, Oryza sativa
cagtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacaattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagcagaaaggcgcaaccgtacgcttatggatatggtgcgcagcatgatgagctactccacactaccactcggtttatggatggaggcgttaaaaaccaccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagtttgagaaattgatcttgaggagaggcgggtgtctgtacctgctccgtcgactcaggaacctttcttctctctacctgctgatgttgtgcctgcaatgcctgtcattgaggtaccagcactgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggcgatgtatacaggttcgggccgctgcgaagcgtaataccctactcctgtgtttttgtggatttgtgtatgaatgagctacaaagtgtgagccaacttctcccccgttctaagctctaaatctggaaaagaataaaaaaaaacccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagtttaacaacatgcatgtttgcccttccttgtgtaacaccttgcctgtaatggttaggatgaagcctggtatatatcgatcggggttaacgtgccatctctgggatgtaacacgctagctccagctggggacgagtgcttagaagctcacaccttgacgggatggggtaaggcgtgcgtcagaccgccagtcgccacctaacccgtgatctgaccggtctgtgactggtcacagaccggataaaggaacgcgccgtactgcgctgcatgcagcgtgacacgcttgaccagactgcaataaatgctgttaggtgagcacagctgtgctcacttatcccatatatgtggcgcagacttccttaagggggtcggggtgcctcggccctcggggccggggcaagcgcaacccgaccccccctcgggggaaatcaggaggagggcggacacctaaccctcgggcccgacgttcccgaaggtgccaggcccacgtgggcgattgtgtctgcctaaacctctagtcatgatactcccggtccca

SEQ ID NO: 64570 - DNA, 8730 bp, Oryza sativa
cccgggttcgccaagcggaggaagctgctcgggaggagcccgccgggctcgccaagccgaagaagctgcccaggaggagcccgcccgggctcgccaggctgaggcgacagctgctgctggcgcgtcacttgggcctactccctcgggcggccctcaggcgacatcctctgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctctaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcggcggcgcgaggaggcccttgaggcccgtgccatggcgctggaagaacacgccggcgccgtggagaggggcttgacggaccgcgaggccgccgctggtctccgagaggcgacgctgccggcgcatgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatctcgaatgcgtccgcgccgagagagccgcactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcaggcctctggaaaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaatttttgtgttagttttattttgctatatatgagatgaggatgatctgtgccgtggtctttttgcgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccctttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgagacggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagcgatccgatgcgcctggaaataatggcgcagtttcctcgaggccatcagaatagcgtaaagcatcttctgggcctgtgggtatcgggtcttggcgtcccggagggcctcactaacaaagtagacaggggcgttcttcgtccgagtggcccctcggggcgttcttcgtccgagtggcccctcggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatatccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccgccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcatggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctgggactctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcacggggagtacgccggctattacgccggcgctcgatgttgaggctggcatgcctgctgcccatgctgatcctccccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgaaatctcaagctctcgctctccctctgtatctggaaag

SEQ ID NO: 64571 - DNA, 3713 bp, Oryza sativa
taatcttgactaaatccaaacagataccaactcctcttaatcaacttacaaaacacctacacttttggtgtctctacaccaccaatcacacaaaaggaaattaatcatccacctactcgtatcctactgttagaatggaggccttacaccagagaatgggcattgccagattctgagacactgtcctttgagctccctgaatctgaaccagtaacaaaaatcaaataagacacaacccaaaaccttccgttcatcaagaagttggatgttcaaattataaagtgacagttcgatcgtaccactggatgatgaggacccactgctcgcggcctcagtatccttctcaatctccactgattggtaagttgctgttggcatttcatccccgatatctacatactcatccaactgctcggcctgtgtagtgatcttgtcaggatccttgctctcctgtaaacaacaaaacacattaaccattataagagctcatctcacacataagctaatagcaaccaagaacaaagcatgctgctcactattgccattgtcacatcaccgttgtccaccatcgtagcggtactgccattcaccagcatatcactatcattagccacggaagcatcaatgacatcggcattttcaccattaacaatggcagcccgtcgactcttgttgagcgccttcttgaagttgttgacgaatcgatcaagctcccactgtgtctcgacatccatctcatcaatatccagctcgatctcacccccaaccagctcaggattgccattcctcttccgcacaatctgcagcacattatgcatcttctcctctggcaagctctccaacccaaccctcaacaagttcttctcctccagcgtcatatccctcttgttcggctcccttgccttcggcttccgcattttcacattcgctgcccttggtttcacctgcaccggagctgtcgccggtggcaattccggtggcggcactggcatcggcggctcaaggagcttgagttcctgctcgaaccaagacatagatgccttgtacatcttctcaaaggacgccaggaggtcgccggcgaaggtgtggacctcgtgccccgcagggttgtatctcagcgcgttgctgaacgtgagccggacgtcggcggcgaagtcgtcgtgtgaggggtaccttccggcggcgaggttcgccctcaccgtgccgagatccatggggcacttgatgactgcgtggtagtcgtggagcccgaggcggtcgacctcgacgggggcgttgaaccagatgctccgcttgtccttccgcagcttcgccaggatctgctcgcaacgcttccgcatcgccgccctgagcttcgccggcggcgtggggaggtcccggcgaggcgagccatggcgcttcacctgaccctgctgccacgtgtcgatccgggcgatgagggcgcggacctggccaagctcgccggcgaggcggtcccgcagcgcgcgggcctcgcggtgagccattgcccccggccgcagcgccacgtagcttgacggcggcggcctcgtggccgagccgttggcgcgctgctggagagggtggttgggatcggaattgggggccacgggcgcgagcggggcacgggtctccccccactggtggtggtggtggtggtggttaaccccgccccggccggcgagcagggcggaggccatcaccgtcgccgtcgccggcgagggtttcgcgtgctgctgctgctgcgctggcgagagtgggtggatccgcacggggaaaggggagaagccgaggagatattttttttctctctctgtggcgggtggatgtgcccgaggcgagatcctgaccgttgatgtctattcggaggcagatcgaacggtggagatctgcgtagagttgcccgcgggcagtggggagtggacggctaggatgttggtaatggtgtgacgtggcaagatcttgctgcgtgatcgttatgacgtgattcgtgaacatataacggtagtgaaggtgcaactgggttattatttgagtgattagtactagtttaagtcttactacgtgattgtacatttgcacttagcttattactccatctgttctatattactcgttgctttgattttttttcgtagtcaactttttaaaatatgatagaaaaatatagcaacatttgaaacacaaaattagtttgattaaatctaatattgtatatattttgatgatatgtttaattggtgttgaaaatgctactattttttctctaaacttagttaaatataaagaaatttgattatgaaaaagaaataaaaaaacttataacataaaatggggtcgtatttttttacacacttagcttattacattgtgatacaactgtatgcatgtgccaatgctcccgtgtcttgctttcgaatctctctgtaaagcgtgcgcaccaaaagaaagcagcattatatggagggagccacgccatgtgcccctttgttctgcaagcatggtttgaactggtctcccaacctcctgatcaaaaggcctacatgtatgtagccatttttcttgcaacaattatatatacaaagtagagatcatagtaaaagtcatcgatatatctaacatatagatacataatataaaacgattaccattttattagctagcaagtacatagctgccatgagcagggaggcattagctactacttccttttctttctttctttcttttttttttttacgttggttagctcaaaattatatatgggaaaggacgtagtagtatgacacgtttcgttcttcgtttaaaaccacaacgagagcatcactgtatatatatgcggatcgaatatatttacgcgccgatctcggagcacgctgctgcttcggacgccggagcggcggcgaggtggagccgcttctcgccgtggacgatggcggcggaggcggcggagctcccgacgacgacgacgacgcaccgcttctccttggcctcggcgcggcgcaccaggaccaacgagctgcagctgctgccgaccatcacattgcgaggaggaggaggcggcgctggcgccacggcggcggcggccgcggcgacgccacggagcagcgcgtagctcgccgacagctcgcgcgccatgactatggccggcagcggcggcgcgtcgggctcctcctccgctatcgtgtccagcatcgccgggaacccgcggcggcggcggggcctgatgatcgacgacagcagcggcggcgcgacctcgacggagaaccgggcgacgagctgggccttcgccattgtcggcgtcagcgtcagcgtcaagcgtgcgctacgcacagcgatcggcagctcaagaatctgtggccatggaagcttcgtgctaagcttactggaaattaatcgtagtctgggtgctcgtatttatagacccgtacactgtcaatttggaattgcaatttaattttgagccatgcaatttgcaagtggatggttctctctggtgggaaactgacgagtagataaattttggaaagaaaatactagaaatgagacgattttggaggcagggataaatgagttgaaacttgaaagtgatcaggcgaccagagacactatcaacgtcactgtgataatattaatgtagtagtaatgcctagagaagtgttgctatactgtcccctgataaatgaagaattgtaaatgatgaatattcagcaggg

SEQ ID NO: 64572 - DNA, 9788 bp, Oryza sativa
tgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcgaccatgcgagtcagcactggctgagactcgctgtacggacaagggtatctggcgtctgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaattttgaaagaggaagaaaggatcagtaaccattttagaaacaaactattgaaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcaggcggcagggcagcgggaccgggcggcatccacgcgggcgcgcgcgagcaacggcccgcggggagcggcagcgagggatggggagacggagagcgaggggggggcgctcggggcggcgcgcgagcagcgtgcgggcgaggctgagcggggggggggggagagcgcgccgggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcag

SEQ ID NO: 64573 - DNA, 4190 bp, Oryza sativa
ttctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacacccttctcggccagacgggcctccaaggcggcgtaacggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcctagaccatactgtgccaggaagcctaggggtcctccctgacaccaccccggcaaatccacaagtctctcggcatcaaggctcccctgataagctagttactcagccaggggtgtcccattccacccatgtggtcgtacttgccttatgtttggatgaaattccaaggaatcggtccttaagtgcgagagtgggaaaccgtacacccggtatgttccccggtccgcggttttggaaattcatttagttcgcaagcaccgacccaggtgtcgggttttccaagtattttgtaaaacccaagttttacccaagttgttattcagatattaagtttgaaggcgtccgtcgatactcgcacagggtgcacgaatatcgagacgcaactagatggttacaagggttcatgatataacaattaacgaaggaagggtcaaatgcaacaaattaggtaggtccgccaatctgccttgcagacgagacaacagattaagtgcgatcctaacaatgcataatatttttcaagcaacataattaaatttcaaatacaggctcaagatgttcaaagg

SEQ ID NO: 64574 - DNA, 3322 bp, Oryza sativa
tcctacttcatgccatggatattccattatggactatagtggacagggccggtcctatgattttgagggccctaggcgaacccatcgcgatgggccctccaagctatatataaaatttattgatatatatagacgctaattttacttgcaaaatgaaaacaaatacatctatatattaaatttaacattcctggtaattatcaagaaataaaatcgaccaaaataacaatatatttgtaacttggaactaatataattatttattaacttaatgaagaatagaaccccgtcatatccattgcttcctatgaaaagatacttcttcgggtatttcttgatgcaaaatcataaagaacggtattaagatcaatagtgtccaagatatccttctcgattgagcacatagccaagccatttaaccttatttgcgacagttgatctcaaatagtttttcaacaacttcaattttgataaacttatttcagctgaagctaccatcataggtaaagttaagagaattcgataggcaactgaaacatttggatagaaatctgcatccataacaaacttcaaaatcttagggaaatcgaagaatctggcaaactcactttcatcacctttaattctgaataaaaatcattgatctcaacatcggatgaggtactagactactagtattaggtgttgccccccaccattatgccccccaccccaccatcatgggcccccggcggtcgcctcggctccatagggccagggccggccctgatagtggatgtggctatattcatataatttatcctataaacaagaaacaacatgtcgtgttgatttcgtgaacgacatttaaatgccactcttaaggtcttggcaagatgcgggctccgtggcggcgacgccgatctggcccggcaaggcctaggccgttggctgccgctgtccccctcgtcacaaccctcctcctgccccctgaagcccgtcgcatggctgtgtgccagtgtggaaggaggggatagagagagaagagagatgggaatctgacatgtgggcccaaggacatttcatacatttcacacgatttctccctcctcttaaaccaaaaattattattttagtgggtccagtgtccaccagcaaatatccaacttttgaaagtgtcttcaccccaaagtcactttggtgtcctgcagttaaaactgcaaagccacgatgtactgtagtaaaatttgcctttgatttttgagcccctcgtttctcttcaccacgatgttgatgaatgaggagtgctatacgcagccaagcaactttcacagagcaaaataactcgcggccgatcctaatccggagattcacttggattcagagtgatcggatggatgaagagcagaagaggatttagcgtgcgacactggattccatcggtcgaacaaatggcatgcaagacagggcaccatgactgggatgggcctaatggccggatttcatttcatgggccgcgaacttgtcccgacagaccagcccacgggtcccctgttcctactctctcccccctcccgtttttttttaaatggtccttttcaaaaaacttattgtgaaactatacagtacaagacactttaacaagaaataaaccgtgaactcagcacaaactgtctttgcgctgagattaaccagcctgagaggagtgtgtgagagaaatagaggagtggggaagggataacataagacaggaaggaaagggaagagaaaatgagaatgagatgacatgtgggtcccgcgtaaggccccatgttttttaattattttttttggttaaactgacacatgagctccacgatttttatcgaattgaattgccacgtaagcgtcatgcaaatgtcatatgggacgaagacctagtcaaaagagccacctcagctaaaaccgtaaacaataccgtcgatggacctcatttacaaatgttttaaaagttaatgggatttgcgtaatattgttcaaagtacgatttaaaaactaaaataaaagaggaggacctcgagctaacattttccggggcatttaactatttgccacttttaaatttggtatttaactatttgccacccctatctcaatgaaatgtggatccatatgtgtctatgacatatgggttcagaggcaaatagttaattgccacatctaaaagtggcaaatagttaaatatctcaacattttcctcatctaagggtgtgtttagttatttgagtgtaaagtttttggagtatacggacacacatttaaagtattaaatatagactaataacaaaacaaattacaaattccgcatgtaaactgcgagacgaatttattaagcctaattaatctatcattagcaaatgtttatgtagcatcacattgttaaatcatgacgtaattaggcttaaaagattcgtctcgcgatttacatgcaaactgtgcaattgattttttttcccacatttaataccccatatatatatatataaatatttgatgtgacgtttttggcctaaattttttctatctatttggttttagttccactaaaattgaaaatttggttgaaattggaacgatgtgacggaaaagttaaaaatttgtgtgtagaaaaattttaatgtgataaaaaagttgaaagtttgaaaaaaaagtttggaagtaaactcgcctaaacaacacagtcccagtctcacagtctgcctacattctccagtctccacttcccacctaagcggagaagcgcggggaaccgaaacccggtgatggcgcacccgcacccgcggccgctggaagacgacgacctcctcgccgagatacttctccgcctcccgccgcggccctcctccctcccgcgcgccgccgccgtctgcgcgcgctggcgccgcctcgtcaccgccgaccccgccttcctccgccgcttccgcgcccaccaccgccgcggcgcgcccctcctcggcttcttccacagccaccgggtgagcccctccttcgtctccaccatggatccccccgaccgcgtcccgcggccgtgggcgccggcgggcgcttctcgctgcggttcgacgacttccgctgcaggatcctcggctgccgcgacggcctcgtcctcgccgtcaacccagtgatgccgcggctgcgcggctgcttcctcgtgtgggaccccgtctccggcgaccagcgccgcgttgccttcccgccggagtgcgaccagggacagaccgaggtgcggaacggcgcggtgtttcgccttcccggcggcggcggcggattccgattccagatcgttctggtgggcacccgccat

SEQ ID NO: 64575 - DNA, 1443 bp, Oryza sativa
taatataaggtcctattcagattatagccaaaataaatcttactaaattttagcgttgtcaaaatattggcaagatacaatattatcaaaattgtagaagtatttcttatgtatttaccaaatttggcaacaaactaaatatagatatttttttagcaactgtgccaaaaaaatggtatggttgaaaatggcgtcaaactgaaccggtcctaactttttggaagatttactttgtttctacaggacaatatcgatacacgtatagatgtttttattcacatataatatctatattttactagttaattattcaatttttatcgattacaataattttatttcgtaccttacttctttcttatcaacgatcaacattactctacttaatttgtaatacttccaagtacgttaacataccgtgaaagttctcatcaaatacatttgacttgagggagtagaaagtactataatttgtatagtacaatcatatcgtacgtcctcggcaagaaagaaagaaaagcctttatcgtacatttgaattagtgatgctgatgcgagattaattacgtactaattagacgcgcgcagagcacacaatccgatcgggctatgcgtcgtgcaaaagcaaacgcggcatcatcgatcatatcgttctatatgcaaacgcattgctgtgttgttgtgtgcttcgaaggccgtgcatgctccacgcgactaattaacgatctgctcattgatcaccttgatcttgcttacgccatatagtacataatgtaactgtatatatagagctagcttagctagggtttcgatctgctaattgttttttttctcattaacaattgctgcgcacacgcaattatcttgagaacaaagcaacatcctgttttttctcgtttagatggatgcgttgcatcgtgccatgcgatcgatgcatggaattaaaataacccttttattaatgaattcaaattcatttaagtgatgtacgcagtgatcgatatatgtaagggagagtgatgatagataagggagagctgtgtagagatggtactctcccagttttgagtgatctccaatcaaaagtagcattgcatataggtcggttcttggcctgcagcatgcttggaatgcagaaatttgatagtgcaaaattaagaaggatgaaatccaattttagtcattatacggttgtttttcaacctcaattttcaaaaggaacagttttgatttactccctaaactttgagcgtagtccgatttcccatgaactacaacaacaaacattcgatatctgtgaactttaaaaccggacgaattatatctccttgctatctaatcaaccatataagaaagacaatttatataaaaagatctatctagacacacctatcattcattatatatatatatatatatatatatggatattcttttctcttt

SEQ ID NO: 64576 - DNA, 766 bp, Oryza sativa
agtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctctcgcctcgcggtcgcctcgctttctccctcgccaactcgcctaccctccccacccccgcgtcggcggcggcggcagcggcagcggcagcgacggagcctcgccggcggcaagcgtactcacccggtaaccctggctcctccccccctccttctccgtacctcgtatgcgtgttcttctgcgctcgtgcgtgcggtgtctgccgccacagaaaaccctaggtccgcctgcggcgtgtcagcgagctcgcccgtcaccgcttagatccgcgcgggattcggcggtttcgcttgctggagatgccttgacgagcggtttaacgagatagggaatgttctatttgtttttaccccgtagctgcaaggtttctgaatctcagatcccctcctgccatgtcggggttgaaggctagggtgttgcttcagagttgtcgtgaattagtcatatatgc

SEQ ID NO: 64577 - DNA, 1557 bp, Oryza sativa
acttttctatgagcgacttaaaaatcaatttcagaaaataaactatgatgaagaaaacattaaaattaactccaaaattaagttttaaaatctaaaatttggttgtagccttgtaggtgataacttaaaaaacatcgaaatccttccctatgacctgataacttgaaaaatgctggcttcctagttcctactcatgcacagcacaaccacagcctgaccacgagaaagacagaaaggaccttttcaagttttcttcacttcttcgaagtagccacaaggctagaaacatgaacatgccgtcactgacacctctcactttcaagtgattgcaactggggaaaataataaaaaagaagtcaataaatccgtactacatttgactgtgcttttggtaccaataattctgaaaagggagaagagattaggaggattcatgggaaccagcagctgcacatgcagctaaggtttgactggtgtgagtgtgtgcatgaattcatgatccaaatggtttgaatattatttccggatccggttcaattcgtcatttgcttggctggtgtcgctcatacgtagcacgctactagctggctattcgtttcaacaaaggcttggcaatattcaaattaattacaaataatttgtgccaagatgagaatatatatatggactgctacattgacaaaatcagcattgctatatatgtaggagtatatagtactagtctttctcatcatgaatactggaaaggaatttgtaatttgaacgcaagttttggtgaagcatacgtgggaggacgcaatcatgaacaaacaaattaaaccagacaacgcatgtgctgccccttgcataccgcgcacgtgccatactaattaaataaccacgagtctactcgctggattcatgtttgcattatatctaaaacattttttatttaaaaaacattttacgttccattgtcattttaagggatttatttgttattttcattccttggctccggaggtagtgaaaagtcgacctgaaattactttcaataaacggtctttataactaaatattttgggtttatactccgtggtccatagctaatataagtgacaaacatactattcgatcccgtccataataattatcgttttacacataattgaggttaaactttttagaactttgactatgtttaaaaatatttgctttacaaaaatagcagttacattacatgtatagattaatcttaaaatataaatattctttatatatctcataataaaaaataatagtaaagtttttttatttaaagcgataattattatgaaactatagggagtaccattttcttccagcatggaacatacaccaatttatttttgagaaacagaaaacctacaccacggcatcccgtggagacgggatctcctctactactcctctccctccaaatcatccggatcccctcctaatacctcactctccttccccaaatcacacggcactgtagccctccccgacacttctcatacctcactcttcttccccaaatcaggcggcactgcagcc

SEQ ID NO: 64578 - DNA, 3469 bp, Oryza sativa
gcatgactccactcatcagggtttaaattctggtatccataaatattacgtatatataagtgagatcttaaaataaatttggcgatattaggtatataccgttgattttccgtcttttcaagcatgtgttacggcccgatcatattcatatgtgtgtaagtgtggtattgcgggtgtagagatgttgtgcgttcgtacgtctaccatcacagtgaagtcgcaagaacacagacagggaaaaccggaaaaggatagaggaggcagcgagccagccacaacctatttttgtcacgagaagaagaaagcccagccctcattgaccgttcccaaaagctgaccgttgccttcctcccctcgctgaccagtcaaaccacctcctccacttgtcacttccactcatcacctcgaacctcgagccgtgggccccacatgtcattggaacagcgtgtgtctcctcttgtcgcatttggatagtcgtcgttggtttcttgccgccttgaccccaaccaccagcgtcgtatataaatcccccctgcacaggaaagctttcgtcacgaaacaaccttgcgttgagcttagctttagctgatcgaatcgacaagagacgtaaattaagcaagcggttgattaagtgtatctgttcggccgatccattatagggattttgttccatgaaaaggggtagcaactccaatgccgaaggcgaggcgggagtaaagttcaccttcatcgagacgcagttggtcacctctgacgcggcgggtttcaagtagttcgtgcagcgcctcaccgacaaaaacgcagcagtgccggcggctccgccacagaggccgcggccgtgctgtgcagacgggtggaggggaaccgtcggcgcgagcgcgtcggtggtgaagcggaaagccgtgccgccgccggtggcgccgtgggtggattagatgatgatgctgtacgagacgtgcgacctcgccaagatgttgcgcgtcgaagtcgtcggcgcgagcggcggaggacggtgccacggcggcggcggatacggtggttttccatgctgatcgacggccggcgatgagctcagtccatcttcagttttggatgctctctgcatgttgttccattcttttttaactgagattatctgtatattgctccatgccttgttgtaccctgttttatatgtttggttgcgaccaggccatgtaattccggttctaatcatgaaactgaaaaaaaaaacaaattgatagagccgatgaatcaaaggattttggagtcacaacagggtttatactttccgaaaaggccgaaattttggtaatttcagtgggcaccaacatttcatcgatttcgaaactttttcacaaaattatggaaaagaataggaataactatagttagccatatgggccgctcggcacggcacggcctaagcctggtcaaacccagaccaagatttgtcaggcctatacatatcttacatatggttgaaaagtctatttcacatccctgaagttcgtgctgtgccgaggcataggcccaggcacagcccaacaaccatgtcgtgccggcacgggcccgacatcgatcaggccatgtcatgcttgggccaggccaaaatcccgtgccttggcccgggcctcgaccttatggccaactataggaataacaatatccatgcaatacggactagcgattagtgtagattaacaaatcctccaaacattttattgagaaaactctaaatactagtaaatacgaaagggagatgggtcctctccctcatcacctccagctataatgtggagcctggaggtgaaggcaggttttacctttccgtatttaatattaaaaccatccttgaccggtttattgtataccgacctaaaaccgataaaaactaatagctttcagtcaacatcgtaaaaataccaactaaaattgacactactggtttcgtgaaaatcgatcaatttttgtgaaaaccgctcggtggagaaggatcagacagaaactgagaccgaagtctgaagataacttttttatcaaattttttcaagactaatgcttggtagcaggagcaggtggtcttctttcccgcatcctcttcgccacttatattgttcgactcttgctaacaagacaagaaaaaaatgtacttacaattataataaatgaaattgcacaaaggattatagtaatcggtagctgagccaagcacaggaaattctcttttccgtttctgtaataagcgacgggcttagatttccaacatatgtctgattattcattataagttgttttatcattaaaaacaattcaatcgcatttataacttatatatagataccaataattttaaataaggtaaacagttatacatacctataaaaatcactccatccgtttcaggttttaagacgtttttactttggtcaaaagtcaaactgttttaaatctggttaaatttgtagaaaaaaatagtatcattttataaatttattattatatttacctataaatttagtcaaataactaaaacggaggagtaacgacattaattaccgttgctcttaccggatcggtgcgaagccgccgagaacgcagagaagaataggataaggatacagtgaacctcctcctcgcacgaggcagggagtgagccttgaccgttcccagaaaggttgaccgttgtccgtcactgaccaccaacccagtcactcactggatacgaccagtcaaaccttgtcgctaatgctaaagcttcaacccaccagtcacacatccagcgaaaaacccacaccctcacctccacgtgggccccacctaacctggaccccacatgtcattcggatagtgcaggcatctgtgccgtatgtattgcattcgcgccgccgccgccgcgcgctctgtataaaaaccccatcggcacgggaagatttcgtcaccagcaaccttgagttgagagagcttttcgtcgattcgaatcgaatcgagaagaaaaggggaaagggtcgcaactgatcgagctgatctcatcggtcgatcggattcgattccatggagaggggttgcaatggcaatggcggcgtgaaggtgaccttcatcgagacgcagttcgtcacctccgacgccgccgggttcaagtcgctcgtgcagcgcctcaccggcaagacgcagccgttgcgaccgcgccgtcgctcgagagcccgcggccgtgccggcggggggtcgacgggtggaggggagccgaggcgacggtgggggtggggctgccggcggcgccggcgccgtggatggatgagattgagatgatgatgctgtacgagacttgcgacctcgccgatatgctgtgcgtcgatgtcgccgcgggcggaggagggtgccacggcggcggcggccggcgatgagctaagccgttagttttggatgctctctctctctctctctctctttcctgaaattctctgtatat

SEQ ID NO: 64579 - DNA, 847 bp, Oryza sativa
cttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggctttgcccacggacactacgaaatttgtgaaattggctgtgagacaccgaaggcaatattttataatttttgaggcaaaagaggtcagataattttttaaaagaccaatctacccctgcgcccagctgtccatctccctccccaacccgatttcccagtcctgaaccctaaccctaggcgacggcggtg

SEQ ID NO: 64580 - DNA, 16142 bp, Oryza sativa
ggaacattaataattggactgcaccccgatgaagttgatgatgatgatggtttggaggattctgatcagctgaaaacgttggatgacaaagtactattattccataacctgaggttcctaactagcttggcaatatatggttgtcgaaatcttgcgactatttcaattgaaagtttaaggcaactcgtttgtttgaagagtttggaattatacggctgcccaaaacttttctcttcagatgttccaccagagcttacatgtgaatatatgtcaggagcaaatcacagcgccctcccatctctcgaatgtctctatattgaggattgtggaataacggggaagtggctgtctctgatgttgcaacatgtgcaggccctacaggaactgagtttagaggactgccagcagataacaaggctatcgataggagaggaagaaaacagtcaaccaaatcttatgtcagctatggaggatccgtcattaggatatccagatcgagacgaacttctgcgccttccgttaaatctcatctcttctctgaaaaaggtatctattacatattgctatgatttaacattctacggcagcaaggtagatttcgctggatttacctcccttgaggagttagtgatttcacgatgccccaagctggtgtcgttcttggcgcataacgacggaaatgatgaacagtcgaatggaagatggctcctaccgctatcacttggaaaacttgagattaactatgttgattccctaaaaacgctgcagctctgctttccggggaacctcacccgcctgaaaaaactagtagtgttgggaaaccaaagtttaacatctctgcagctccattcctgcacagcactccaagagttgataattcgaagctgtgagtcgcttaattctctggaaggcttgcaattgctcggcaatctcaggttgctgtgtgcacacagatgcctcagcggccatgaagaagatggaatgtgtatccttccgcaatcacttgaggaaatttacatctgcgagtactctcaagagaggctgcagctctgctttccaggaagcctcacccgcctgaaaaaactagtagtgttgggaaaccaaagtttaacatctctgcagctccattcctgcacagcactccaagagttgataattcaaagctgtgagtcgcttaattctctggaaggcttgcaatggctcggcaacctcaggttgctgcaggcacacagatgcctcagtggttatggagaaaatggaaggtgtatccttccacaatcacttgaggaactttacatcagagagtattctcaagaaacgctgcagccctgctttccagggaacctcaccagcttgaaaaaactagaagtacagggaagccaaaagttaatatctctgcagctgtattcctgcacagcactccaagagttgatgattgaaagttgtgtgtcgcttaattctctggaaggcctgcaatggctcgtcaacctcaggttgctgcgggcacacagatgcctcagtggttatggagaaaatggaaggtgtatccttccacaatcacttgagggactttacatcagagagtattctcaagaaattctacagccctgcttccagacgaatctcacttgcttaaaaagattagaggtatcaggcactggaagtttcaaatctctggagttgcaatcatgcactgcactcgaacatttgaagattgaaggttgttcatcacttgccacattagagggcttgcgattcctccacaccctcaggcatttgaaagtacacagatgtcccagattgcctccatattttgagagtttgtcaggacagggctatgagctatgcccacgactggaaaggctcgagatcaattatccctcaatccttaccacgtcgttttgcaagaacctcacctctctacaatacctagagctttgcaatcacggattggaaatggaaagactaacggacgaggaagagagagcgcttcaactcctcacttccctgcaagagctccgatttaactgttgctacaatctcgtagatcttcccacagggctccacaaccttccctccctcaagaggttggagatctggaattgcgggagcatcgcgaggccgctggaaaagggtctcccaccttcgttggaagaactggctatcgtagattgcagtaatgagctagctcagcagtgcagattgctagcaagcaagcggaaggtcaaaattaatcagagatatgtgaattgattactcggtggctttttccacctgcccaactggcatgggctcgttcaggcgttcaagctgctgtaaattccattgccgcaatgacgaccttcagaaccgttacacaatacaaaggacatatgatggctagatcaactgtcacatacaaattctataattctatctactgaaaaggatgattgctgttcattttcgtgattacagaaggaactgtgtatatcgtgctatttttgcattcacattgtgttccaggttgtgctcggatcagccaatttcggtggttaattcactttgctgtgtcctctgtgcagtgtgcactcaagaattgttcgcacatgcaattcagttgagcatcgcactacgcaagtttttttttttttgttaacaaaggagtggttgacagcattgcaggttgctaaaacagtgtcaaaaatttgctaacaaaagaattctcttcagaaatagtatgaaaataaatgccacataagtaatctgagtaaaacagacagaatcactagagaagactaacgacaaactcttctttttctatttctgtggtgaaaaactcagcatataatctcatgtatgcattggaggtgcataccatttcgatcatgtatgcatttagctgaacattatcaagaagcaaatttattgcacgggcaaccataagctaaactaattctcaagcaatttaataatcacaaaacagtctgcaataccaagatatataaaacttttgccagcatggagcaacaacactgaaacactacagtcaagacagctcccagaaaagattatatgttgctacttcaattgccacagttacaatcacccataatgacacatcaaattacataagagtattaagagtatatgacagttgtaacaaaacaactgcattgagaactagaagaacagacagccacatgaaccatattcacttcttcagatcagaaagcctggtgaactaccagtctaccaattgctaccgtagtctccatttttcacttatatgtacataggacacctgcgctatcagaatagccacaaagccagttcactcgctacaaattaatcttgactaaatccaaacagataccaactcctcttaatcaacttacaaaacacctacacttttgttgtctctacaccaccaatcacacaaaaggaaattaatcatccacctactcgtatcctactgttagaatggaggccttacaccagagaatgggcattgccagattctgagacactgtcctttgagctccctgaatctgaaccagtaacaaaaatcaaataagacacaacccaaaaccttccgttcatcaagaagttggatgttcaaattataaagtgacagttcgatcgtaccactggatgatgaggacccactgctcgcggcctcagtatccttctcaatctccactgattggtaagttgctgttggcatttcatccccgacatctacacaggggcggacccagggctggtgccgggtatgcaccggcatacccagaaaattcggaaaagatttagtaggcagtatgcatcagtgggctgaaactaagcaaaagcccaagaagtaaaagtctagctgttgcacagcccaccagaagatgatgttcccctttggctagcactcatgcggtagggtttggagcaggcgttggcggcgctgcgacagcgtggcgcgctgtggcactgtatcattgatcggcagcctcatggcaagcacgacgcatggacggtttgagcgtcgtggcgctgcggccggacagcgagcaccggtggcagaggctgccggtcactgggctaggcgctgactaaatcacctggtccagttccactcattatctgtccatgtccaagtatactcaaacttcttcagttctttgtctctctgatttttttttcttaacagatggagacatagattgattgaaaattgaaaactataatgagctaacaagtgaaatcaatgagagtacaaacttcaaaaattgaatacatgtttttgtgatttgtacgctgagatcaagttgaatcaatcagattagaatacgaagaagaatatgggtattctttttctttctttagcaaagcaccattagattctgcttcatcaggccatgccctatgcttcacatttctaatggtgatgggaaaccttagaacagggagggaaagtaactgaacaaagtgagttgtgttattttgttcttcaattcaccctcaggatacaccaatactttcctaaaattaagactatatttgtgtcatcatgtgcatatagtgtttgatttgcctctcttgatagctagcatgggcaaacccaggacaaaaattctgggtccgccactgcatctacatactcatccaactgctcggcctgtgtagtgatcttgtcaggatccttgctctcctgtaaacaacaaaacacatctattatacaattaaaggaatagaaaaaggagcctccacgttcgctctcatggcctagaaattctcacattaatcgaagaaaaagaaaaacagagtccatatatagaaatacaatttagaaatagttgaaattcgaaattaaaaaataaggaatattagaagatgagactagagtccatatagaaatacactttagaaatagttgaaattcggaattaaaaaataaggaatattagaagaggagtatagagtccatatagaaatacaattaggaaataatagaaattcggaattaaaaataaggaatattagaagtagagtatagagtccatatagaaatacaattaagaaaaaaaatagaaattcggaattaaaaaataagaaatattagaagtagagtatagagtccatataggaatttaaaactaactaaaattcggaaaaaaaaaagaagccaccacgttcgctctcatgacctagaaattctcacattaatcggagaaaaagaaaaggcagagtctatatagaaatacaattcagaaatagctgaaattcagaattaaaaaaataaggaatattaaaagaggagactagagtctatatagaaatacaatttagaaatagctaaaattcggaattaaaaaataaggaatattagaagaggagactagagtccatatagaaatatgattcagaaatagctgaaattcggaattaaaaaataaggaatattagaacaggagactagagtccatatagaaatacaattaggaaataacaaaaattcggaattaaaaataaggaatattagaagtagagtatagagtccatatagaaatacaattaagaaataaccgaaattcggaattaaaaataagaaatattagaagtagagtatagagtccatatagaaatacaattaagaaaaaaaatagaaatttgaaattaaaaaataaggaatactataagtagagtatagagttcatattggaatttaaaaccaactaaaattcggaataaaaagtagcctccacgttcgctctcatggtctagaaattctcacattaatcagaaaaaaagaaaaagcagagtccatatagaaatacaatttagaaatagctgaaattcagaattaaaaaataaggaatattagaagaggagactagagtagttattatacattagtagttttgaaaagttattgcaaaatttaaaattatgttgtcattgtaatatattttaataatataatgagaaaatatatatgatattatataagagaaaatataatgatgctagccgcgtaatctacgcggaccaccatgctagttaaccattataagagctcatttcacacataagctaatagcaaccaagaacaaagcatgctgctcactattgccatcgtcacatcaccgttgtccaccatcgtagcggtactgccattcaccagcatatcactatcattagccacggaagcatcaatgacatcggcattttcaccattaacaatggcagcccgtcgactcttgttgagcgccttcttgaatttgttgacgaatcgatcaagctcccactgtgtctcgacatccatctcatcaatatccagctcgatctcacccccaaccagctcaggattgccattcctcttccgcacaatctgcaacacattatgcatcttctcctctggcaagctctccaacccaaccctcaacaagttcttctcctccagggtcatctccctcttgttcggctcccttgccttcgttttccgcattttcacattccctgcccttggtttcacctgcgccggagctttcgccggtggcaattccggggcggcactggcatcggcggctcaaggatcttgagttcctgctcgaaccaagacaccgacgctttgtacatcttctcaaaggacgcgaggaggtcgccggcgaaggtgtggacctcgtgtccagcagggttgtaccgcagcgcgttgctgaacgtgagccggatgtcggcggcgaagtcgtcgtgcgaggggtaccttccggcggcgaggttcgccctcaccgtgccgagatccatggggcacttgatgacggcgtggtagtcttggagtccgaggcggtcgacctccacgggggcgttgaaccagatgctccgcttgtccttccgcagcttcgccaggatctggtcgcaccgcttccgcatcgccgccctgagcttcgccggcggcggggggaggccccggcgaggcgagccatgggcgcttcggcggcttctgctgttgctgaccccacgagccaatgcgggagatgaggcgcggaccaggccgaggcccaactcgcctgcgactccgcgaggcccatgagagttcgtttgggctatcagtccattacggacaagaagcccgagggcgcggcccacatccttccgtcttccccgcctttccttccctgcctcgtcgaccgcgttatcccgtctcaagtctcaactcccaacctgcgatgcgccgtagaaatttgatactcgtgtcactcgtcgtcttcctttgcttcactaatcactccaatgacgcgacacgcatctctctcaaaaagaaaaggattggtatgtaactgtctacaagtgatgaattcatcactcacgcagttcactgcacatcgtcccagtacgcgcactatcttggcagcaaaaagttgtaccagaatgatcttgcgttcttggcaggacatgatcgatcaaaataatctcaagcactttggctacacacaatgaacgaaattttgcagctcggcagctcaccaaggatgggcgcaactcaaccacgactgaaatcggtgctgacacttttagcagcatctttgtgattcagccgtggtttctccggcgcgtctccttctgttcagagaaaaccgaatagttcgggttcggattcagttcgaagcaagcatggcttaaaatcagttcatgcacacacagctgcccccttggcatttgtgtgcactgacacgatgccgtctgtcctacgcgggttggtagtatgatgaaagggtttggaaaccgatctaaaaaaccgttcggatcatcgggtttttgactagccatgaaagtgaaattgtccgaaaaggataaaagagcgaacgacgtcgtcggtccagcacaaagctcagcgctcaatcacgtcagagaaaccgatcacttcgggtccgggttcggttctggagagctaactaaggacttacggagtggtatgttcaactgttcagagtatttaacttcacggccaatacgttgtcgtccaccagagtgcatgtgagcgtcacgacgcatcggataatttgaccattcgtaggttgctgttggcgagcacggcgaaacccgagacgcgggttcggtttcggttaatccgtttcgcggtcgcgcgcggccacgggcacacggccatggcgccatgccgctgtctccccctcgctggctgcgacgcttgactatttttattcttcatctccatttgattgatttaatctctcgttgcagcagcaggcaacgtgcaatcggttcggttttgctactgttcgggttcccctggccctctcccccctataaatacacgcctccaaagtccaatccaatccgccatgaacactcggtgctcgagccatttccaattccaagcttacatcgaatcaccatccacgacaaagaagacgcatacgctggtgatggagctcatggcctccctcatcaacatcttggcgctgatctccgaggcatgccgcagcgcggagaagctgccggcggcgctgatcactggcggcgtcgtggaggccgcggcggcgatcttcgtcgccttcttcaagccgcccggtggcgtatttcagcaccacggcaaggcaccattctacctgtattacggcattataggaggcgtggccatcttcggcttcgcggaggcgtgggccgggttctgggtctccggcgacctgaacggccggcgcgccgtcggaaagacgatactgtgggtgtcgattttgcctcttgtcttggtagctgcgctcggagggttcgtcttcatgagatagttgcaaacctatgttaatttcctctgtttgtacgagtgggtgtaatctcctgtacctctgtgtgtagtagttgtagcgtgtatgcactagtttttgctttgtaatttttagcctggtgtatttatgatatttcagttattatgtgatgtaacagtatgattgttaacttttacaaggttttatgtaattatacataaggttattttttgtgtgatactccctccgttttttaatagtgacgccgttgactttttctcacatgtttaaccattcgtcttattcaaaaaatttatgtaattataatttattttgttatgagttattttatcactcatagtacttcaagtatgatttatatcatatacatttgcataaaatttttgaataagacgaatcatcaaacatgtgagaaaaagccaatggcgtcatatattaaaaaacggaggtagtatgtgattatgcgcgttttccttgcatttctttagctacggatgttgtacaggtgtacctcttttatgagtattcctccaatcttctgcttatatccttctcgaaatcatggcagtaatcaaccaatcataatcttaaaagaatcatggtagacgcagagcaaccagttagtacatatttgaaagaacaggcccttgcattgcagggccgtatcctgtaggctgcggtgtttcaaagcaggaaaaagtacaccgaaggtccctcaacttgttatcgagttacaaaatcgtccctcaaccgcaaaaccataccggacgtccctcaactaacaaaactgttcactttaacggtggttttgaccccggttttatttgaggtggcggctgagtcagcgtgggacccacgtgggccccacatgtcagaatgccaggtcgtctctctctcctcttctctcccttcctcgtctctccctctcacttctctcctctctgcagggcggctggcgggtggggaggaggtccggcagccagcggcggcgcgtgcgacctcggggtcggaccgtcggagaggcccgggaggcggctgcggcggcggcggcgacgcttgagaagggagaggcggccggtggcgccggcgcgggaagaagctgtcttcggcgtcgtgcccgctctgccctccaccgcctgcttcgcccgccgctgccccgcgctcacacactcccgccggcgacgccgctgacggcgcgggcgcgagaactgcggccatggatgacgacggcggcgacatcctcgctccccccgttccgctccccgtcggcgccatcttcctctcccgcagcgcgcctgcccgccgctcgtctgctccgtcggccggccgctccccgcgcagtcggcggtggcgaaggtgaccgtgccggcgtcgaggtcgtagccgacgtggatgttctgctgcgccaggttcccaaggatggacaccggctgctgcttcgtcgtcgccacgattgccaggcacagcgtcccctcctacaccgtcacggacgcgttctccggcttcagcgccaccgccgcgcggccgccgccaccgccgaactccagcgtcaagtccggactcgcttgttcggtttgcttcctgctggatgtacacatgaggtcattcaagatcagtaactcatactctattctagcaagctggctgttggtgagaattctgaattctcattgcatcgcctaacgaagatagaagatcggagtgttatacatcaatcaatttcttagctgggaatgttactcctgcattgctctacaatttatgggtcatgtaatttgatctctcacagaatctatagcgaggtaagaaagcgaaaccggcgccacaaaatatcttgaaattctgcttgttcatacactgttcttctgattaaagaacaacttagcttgagattgttctgttcacttgcaatttgcaggagtaacaaagcttatttttgcattgcccgagtccacaatgatgcgggagctcgccgccgatgccaccgtcttgttgccgaccctgacgaagtcgaggaccacggtgtagtacgtgtccacgtccccggcgacgagcggcgtgctcgctgcgccgagctcggtgacgttggcgagggtgccgaagttgaacgccgacgatgagttgacggagtgcgggacgaggctgtaggagaatctccggccgagcgacgcctcgccgccgagctgcgtcacgagggagaccgcgtcgccgctgagcccgaccagcccgtcggccgggaacgagccggccgtcgtggtggagcagccgaacttgacgctgcacacgccgcctcgtggtcgtgggcctcgtgggtggcggccggcgggggagcccgcgagccgctcctacccctgccgccctccaccactgcccgcccgcaggtcctccccccactgctgccgcgtcgcccgtcgccgccaccaccgcagccgcgtcgccatcgaatcggggagaagtcagaaagacatgaggaaaggagagaagaggggaggagagagatgacctggcatcctgatatgtggggcccacgtgggtcccacgctgactcaaccgtcacgtcacacaaaaccaggatcaaaaccaccggagaatctaaagtgaacggttttattagctgagggacgtccggtatctggttttgtggttaagggacgattttgtaactcgatgataagttgagggaccttcggtgtactttttcctttcaaagcataatgaagaaatcaaacttgtcaggtctcagatggctcgcaagcagttctccggaaaaggaggagagaagaagatatggacatacggggttaatactaatgcattagcataagctgttcagttccgggttcggttgtgacatgtactgatttctttgttaatagttaatcagcggaaatcatgtctttttcttattggtgggtccccgactgtggatctttttgcgcgcctctcttggtttggattgcaaagaagcctaccgacccggtttcgggttcgggttcgggttcgttgctcagcgcttgtgttgctttgctcaggcatactgcatacatatgctttcagaatgtctctatcaatccgggttgaaaaaagtggtcttgttgagatgaaattgcttatcggcaccattcgggttcggttcaagtcgtcggtttcctgtactactgctagtcagaaaaccgagctacgtggccgatcgggttcgggtttccgagagcaaacaacgtagcgtgtgctcgtcattttgcaatcgctccacttgctgcgagctcggcgaacggttaatctggacgccatccctacgaaaacccgagacgcggtctggcgggggtcggtgcttcggttcggttcatggtatagatggcctttcggcccgcccggcacggcccggcccaggaacggcccaccagccatcgggccggcacggcccgatcggcacttcgtgccgggccgtgccgacccatgggctgcacctcccgcccaggcacggcccaccagccgtcgggccgtgccgggccggcccgaaggcgcgggtggcccatcgtgcctttttatataagtctatattccatccctcctctttgggccgtgaaatatatatagcgaaaataagtctatttgccgtccctcttctttgggctgtggcatatatatagtgaaaataagtctattttctgtccctcctctttgggttgacatatatatatatatagctaaaataagactattttacgtctctattctttcgaccatggcatataatatgtctatttttactccctattgtttatgtgtcgggcctagcctgaggcccatcgtgccgtgccggcccggcacggccgggccggcccggtagtcgggccgggccagcacgggcccaacccctaacgggccgtgccgtgcttgggccgggccaaaacgccgtgccgtgggccgggccatcgagcgtcgggccttttggccatctatagttcatggtgtgtgggctgtgttccctatgggaccattcgggtgatttaattagcacgaaaaacggagtagttaattagcacgttgattaattaagtattatttaattttctttttaaaaatggatcaatataaattttttaaagaactttcatacagaaatttttttaaataaacatactgtttgtcagtttaaaaaacgtacacgcggaaaacgagaaaggagtgttaagaatttgctcttgcaaacacagccatggatggacacgatggatcatggatcgctgcgacttgcccgcgaatgaatctccgtcgagggctcgaggcagtcctgggtttggctttgtgcgtcgggtttcgccggtgtattaaacaggcacaagcataaaactccaagtcaccgagcagctccgatttttttatttttagtttttattaaaatatttacaaaactaattttgtgttttaaaaatttacaaaactagtcacccatcgcccgtggcagatggcagttgcctcatgcctaacgggcggcaaagaagggcgtgccattttgcagatggccccccttgctgcccttaggttataaataccaaagaggccgcttccaaaatgccaagccgtcctcgccgcccttttgcaggcggcccccgcacagtagaaaatcgccctctataagggtggcaagggggccgcctgcaaaaatgtccctacggacggcaggagggtagcctgcaaaatggcaggccttcctttgccggccgttagacatgaggcaacgatcgtctgccacgtcattaaaatcgatctttaggagggatttatggaccagtaagtccaacgtgtgcaaagtattccacccgaaaaatccgtcgggaaaccgatagagtatatgcgtggccgttcgggtttatcattttgtatttcttccgcttgcgcgcgttggcactgcactgctcactacgctctcggcgagtgattactctggtcgcgcgacaacccgtaacgcgatctcgcggtcgcgggttcggtttcggttgagctgtggtgtggatcgctgcaacttttgcttgaaaaatgaaaaacatgttcgtccgcgattttctgtccgtcgcctctcactgatcgagagatgcaacacagtctgagcgatcgggttcggtttttgtgctctgctttcaccatgaagtcatcaccaggctcactgcgtctgcctcctcgcaccattcagcattcaccgagttgaaaaaaccacaaactaaggcgttccccctgatgatacagcacgcgagctacgcacgcacagacatacggtacagacatgccggcgcccgcatcgacgtcgagaagctgctcactcatcccgtgccggcgtcttgcaagtcgcggcggcggcgctctgcctgggcttacggcccaaattcggcctgcaggcccgattttgagttgtcaagtcagagcccaccgacttggaggcagtcggcccaagcatttgaaagcccagaaacatctgctccgagtgctcaccttccgtgtagcttcctagtagttcctacactaccaaactaccgcattatttatatccctcacaaaaaaaaaataaaaaggactacccgcattttatattgctcatctgccctcctcgaatacctcccatattattcccatctctgccttttgcttaccactgaccactgtcttctcgcgaggctcgccactggtccattgtcgcccaagctccaaaggcttctcttccgccggatctgatggaggaggtggaggtcggtttgctggagggagggatcgggtggctggtgcagaccatcctggagaacctggacaccgataagctgggtgagtggattcgtcaggttgggctcaccgatgacaccgagaagctcaggtcagagatcgagagggtggggtggtgacggctgccgtgaaggggagggcgatcgggaacaggtcgcttgcccgatcgctcagccgtctcagggagctgctctacgacgccgacgacgcgatcgacgagctcgactactacaggctccaacagcaggttcaaggaggtaaagcttgtgtatgcaagatgtatccatttttgtgtccaaggaggtgcattcattcccctttttctgttgtttcagatgcatggcaaggtggcactggaagtttagatgaacctgaagcagagcaagcagagagaccgagtatcaacgctgctattgcgattagcagtggtagcaaaaagcggtccaaggcatgggggcactttgatatcactgaagaagaaaatggaaagcctgtgaaggcaaggtgtattcactgtcacacggtggtcaagtgcggttctgaaaaagggacatcagttttgcataatcacctcaagagtggcagctgtaacaagaagcgtgaggcaactgatcagcagccaaacccgtcatcaaggtacggtatatgatttatgtaacgtactttcccccgcagcaagccagcaactgtgaaaccgttctgtttttttttaaaaaatatttttattttgcagtactgctgatactgcagcaaatagcactcttgttgaactcggcggttcaggttcagacatcagaaaaaagatgaggattaatggtgagtcaacacacaacgatgcaccttatgcacacccttggaaaaaggctgaatgttccacaaggatacagcaaataactcgtgagttacaagatgcacggggggctgtgagtgaaattcttaagctacatggaccgtgctctgttggaaattcaaaccatcgtacgagtacaaccacaactctctgcagaagaacgtcaagtcttaatccacacaaaatatatggaagagacgcagagaagaacaccatcatgaagattattacagatgacagttatgacggagtaactgtagtccctattgtgggcatcggaggagttgggaagacagctctcgctcaacttgtatacaacgaaccaacggtgaaacgtgactttgagcggatatgggtttgggtgtctgataactatgatgaattgaggatcacaatggagattctagattttgtctctcaagaaagacacgaagaatctccctgtagaaaagaaatacggaaaggagtaagtagctttgcaaagcttcaggagattttgaatgggtatatggacatccagtcgaaaaagtttttgcttgttttagatgacgtatgggacagcatggatgattacagatggaatattttgttggatccattgaaatcaaatcatccaaaaggtaatatgatccttgtgacaactagacttttgtctctcgcacagaggataggcacagtcaaaccaatcgagttaggtgctttgtcaaaagaggatttttggttgtattttaaaacatgtacatttggtg

SEQ ID NO: 64581 - DNA, 1781 bp, Oryza sativa
agaaggaaggaaggagtatttttcatgctcgtatttaccggctaccacatctattttaaaagagagaattcgatctatagcacagaaaaaaaccgatataaaaaacagcacacaaatttctctcttttagtcagaagcacgtgccactaattttttctttgatccgtaccactcctgtcaattgtttaggggcatgaaataattatttttgctcttcttttctaaccaaacatgaaaacttggactattcggctcggctcaatcccgatggatggtgagagtgagtgggtgtaggtgcggtgaccgagcgggtagtggctagcggtggtgacagagaagaaggaggaggaggaggtgcggccgatggaggtcgtgctcctaaaagaaagggcaataacgacggctgcttctaaggcgcaagtcacacacctcggaaaagggtaacaatagtgactacttgcgaggcacggtggggtgatgacattggttgcttgtgggttgttcgatcacgtgcaggggctacgaggtgcaatgacttggttgacaatgctcggggccgccgcatgatagagacttttacggatgaggtgtgcaccaatgaactagccagagccgccatggccgacaaaggcacgtcgtgaacgagtgctagggtttgggggagtgaatgcgagatgtcgaatgggaaagaacgaagaggcgacctagtcatgtatgaggaaaacaaagggtaaattagtcaaaggataaatttatctgctctaatctaatgtcgtttgctcaaaatgcgatggaagtggtacatatcgaagaaaaatcagtggcatgtgcttctagtcaaagggggaaacttatgctatttatgctattttttgtatcaggttgtttctctatagcaaccgttggaagaaagtgcatagtcgtaagcccacgcttaaatgagtggcttatactctcgctcacatcgtttgctcttccgctaataagtcgatgctaaaatttaaattttaaatcgtaattttgaagatggttggagttaatcaaggattacgacatgagcattcactatcatccgggtaaagccaatgtggtggcagatgcataaagcaggaagagctactgcaatgctttatgcaccgagggcatgtgtaaagaattgcaacaggagcttgaacacctcaacttggggcttgtagaatacgggtacgtggctgccctagaggcatgacctacgctcgtggatcaagtcagagccgctcaagtaaatgatcctgaaatagcagagctgaaaaagaacatgagggtcggaaaagcccgggatttccacgaagatgaacacggcacaatctggttgggagaaagattgtgcgtaccggacgacaaggaactaaaggatgtgatactcaccgaggctcatcagactcagtactccattcatccaggcagcaccaaaatgtaccaagacctcaaagaaaagttctggtgggtcaacatgagaagggaaatagctgaattcgtcgcactctgcgatgtttgccaacgagtgaaggcagagcaccaaaggccagcaggtttgctccagcctcttcagattccggaatggaaatgggaggagattggaatggactttataacaggactgccccggacatcatctggccatgattcaatctgggtagtcttggatcgactcactaaagttgctcatttcatcccagtgcataccatgtatacggggaagaaattggcggagttgtacctggcaaggatcatgtgtctgc

SEQ ID NO: 64582 - DNA, 5397 bp, Oryza sativa
ccaccgaaagcccgagagagagacagagagaaaaagagagagagagagagagagagagagggggggggggtagcacgatggcgccgcccatggtggtgaggaaggatagggttaagtagtcggctagggtttgagactttgagatgttaatatatatatcgccccatataaatgggctattgggccattaggggggaggttaaactattaaaggcatgatggatatatatgggctaaacgattttcgggtcgggcatggattatctgtaggcaaaatataaaacctatctgcgcccactaagttcgctggtatcggatcaggcgtgcccacagacaaaaaaaggtgcccatggccatgcccatcgagtcggatatccgtggatacccgaacccatgggcattactgccaaccataggagttagatgtgttctgactaaaatgttttgtccgtattgatatgttaacgaccaaatttggtaatatcagtatcggaaaagaagattagatcgaagcggagtcagaggcgaagatcgattcgagaacagagcatgaatcggctggagtccagatcggctacgatcaggatcggctgggtccaagttagactgggtaagccgatgcagccgattccgacagtatgacttggtgtgcgacatcgggttgaattgagatgcttcacggtgattgccacacatggatagagtcctgagaaggcaattgtatctattaattatgatattttatgtaattttcttagagatatgtttagggcaaaagtctgccgtaaagacttatggtatcttaaagtttgttagagataagagtcgtgttcgatatgaacatattttgtaattttcgggtataaatagaccccgaaccccatgtaatcaattaacacacacgttcaatacaattttggcgcatcgccacccttttgctttagttttatttcgacgagttcttgctttcgggttgagctgcatcggtttcaatcttcaataagaggtaaaacttgttatgacggcttgcgttctcgggataagtgcttccatctttatgatactctaatcttgtttatgtaattcgtcgagttatcacatatcttacataatctttggcaatatcgctatttaacctattatcggctaacatatgtcagtagaaggcagccgatttggttaaacatcgatgttgacttagattatgtaggatatccaccactctatgaaacttccagcggcttgattgtctagatattgttcttcttttcatacttaatgttgtatcagttaagtttgatctattaagtcgtgcttagaatatcaatctctagcctgcttttttgttgccgattaaggtagtatcggggtttcagccgatcttacctgatttaaccatatttattctataagcttcattgatatgttaaatctgtactttatgttaagatcttgtcgcatttaagtacattagacttttgtttgatatattctacttgttttaatatcttaatatagagtggtatcggagtattagccgacacatgctagatttatctgatcggctatgttataagcatatataattcaactattaatatatatttcgatctaagtgatttatattgtcttggcatggcgaccgatctatcccaattacttaatttaagtatatatcgatacaaggagtgtgtattgttaatatctacagccgatcgagtagatctagttttttcttatttgtttatgactgtcgatcgatatataaatgacatcggctcaaagataaatgatatgtcatcggcacttagccgatcggctatcgtttataggtttaaccacggtttctttgtctttatttcttgttgattgcaggatcaaatcaactggcatgctagtatacccggaggtgagttttggacctgcactggagttaagcagatctcccaggcctcgtgtttttcgtcaacatgatcatagcaatgttgatatgactagtaaggtaatatgggggtctagccaagaaattgtagtgtggggattagactttgatagtggctctgaatgaatgaaaggtaaccggcaactaacaatttgagaagttgattcagtctgggtggaaagagagggtagcaccgtttaggatgggtgtacgattttttccacataaatcggacgtccgattcgtagttgtctcgaaagaagatttaagatttgaagtagaccaaacacatcgctcaactctcgtctaaccaaacaccggatagttcaacgcacagccggactgtttaacacatgttttaattagacaattctttcacttgatggtttgacacaaaatcaaattatccagctcgtacacattgtattgtcaaaacggacgaaaaaaaactgtccaactcgaagaaacattgctattttgccacgtcaatagcgtggcaaaaggtttcacatgtaagttatcggagtgttctatcttaaattatttgaaacgcaactttttaaaagagattgtattggaattgatgggccaaatgaagagtgagaaaatacagataaggaaaatgaagatgactagtgacttcaatatcaataacaatggtactaatcgcacctcccaaatcatatataaccagcgacattcaaataagcaatatcacgcaacatacggaaccagtccgatgcaccaaaaagacaagacagtaattccactgagatgcatgaaccatccgtttatttacagaagaaagaatactccatatatacacaagggcaaccgaattgtcacgttgagcttaaatacctttggttccggacaccaatttgttcagaagcacctgagatgaacagaaaacactaccacatatacataagctggatgaatttcttcctactgaagcactaccgctttctttccgcacgaaaggaacaaaacagaaggaaataattcatctacagactgaccattctaaaaacttccccttaaactcgatgaaaaacatgtaaaagaaactgtattgagttcctcttatcgtgctcttgttccgcccttgtccttctggagctgctttgaataagctgcagccttcgcatctagggcagtttgcttcttccgcctcgattgccctagagctgctggatcaaccaatggtccagaccatgtttgtgaggaccccttctggatggggactactgtgctgaaggaagcatcctggtgctcatacataggctccatatgacgactggatcccaatgggttacccatagctccatcctgatgaggtggggggaacttctcacttttgctcttggcattggcatgcgttatcatgcgtcgcctctgctgttaatgaaaatttgaaaagttcaacgtacatgtttgtcttgaatggttaaagatagtgaagtgagatcagagagaacacagaacaacgctagtttacttctactgcattatcttctgcaatccctaccaattccatggacgcaaattaatagttctacagtgaagtctacttttatttccacacccacagaaatagtattgtgtaagaattttgtatacaaaggacttttgtaaacatgcttgaaattgaaagaccttgtaataaatgaggattatggagcgcgactgattctgttgatgtcagaggtgctacaattctggcccaaaaatcggaggggaacaaggtttccaaaaaagagtcaaccaggttttctagttctttttatataattttcaaatttaaagcagtataaattagatgcaatttttaaaggctgataaattgaatttaataataggggtttgggagcttagcacattgaaccagctgaactccaaaatccaaaatctgaccagtgggtattgttgtttttgcagaaaaccaactgacattattaggtttatcacatgataccatgttagcacacattaccatcagaaaaataatgattgttttaattggacttatatttcttcccagagaaatacaaatggtttgggatatatcgttagtactaaatatcactcgtagccaacccagttggtgtatgtgtaacaaatctacagtggataaggcagcaaattaaacaggaaatcttcaaatataaatagctggcttacatctaggtttgcttgaagctctgcattagcctctggagctggtcctgccctttgagatcgatcccgcgttcgagtcctttttaccccctctcctttggcctttgcagctgctcgtagcctggaataagaatatacagcaaaggcatatgacaccatgtatgatacagtagaaacaattagacagattagtgaaagacagttcaggctcatttggatgggttgggctttggcccatccaaagtgggccttagaaaagtgaaagaaaatcagctacatattgtatgtgcccgtgaggtagaatggatggacagttggacacatgccaatggatgtagcgaaagaattccaaactttctagctagcattcttagcaaaagaagattactgtccctgaacgtagtcccaaataggggtgggcattcggtctaaccgaaaaattcggttcggtttcttgatttttttgaaaattcggtctttgtaatctcaagaccgatcggtctccaacaaaacccaagaccgagcgaatcggtcttcggttagttcggttcggtctcggttatagaccgaactaaccgtaagagaaaagtttgaacaacaaaagcaaatcaaataatcaataattaggccgcagattgtcacagcaaatcgagcaaaatcacagcatatcacagcaaagaagcaaggctggaggcgacacccggcgatggaggcggcgcccggcgatggaagtggaggcggccggctggaggcagcacccggcgatggaggcggaggcgggcctgctggaggcagcgctcgccatggaggcggaggcgcactggctggaagcggcgtccggccatggagggcgaggtgggccggctggagttggaggcccggcgacggaggcggaggcgcgccgactggaggcggcgcccggccatggaggcagaggcggaggcgggaggcggcgcacggtgaaggagcgaaggagcgaagaggatggagacgggacggcgcagtgctctgatggggaagaaacggcgcacggtgtggtgtttgcctgtagggttttttattagtgggcttattgggccaactagatctattgggccttattcggttatttcggtcaattcggttaattgaggcccatgaccgaattaaccgaacaaatttcggtcttttaatggttgagaccgaattgctgaccgaatttttcggtctcggttttttcggtctcggtcttttcggttcggttcttcggttcggtctaattctgcccaccccta

SEQ ID NO: 64583 - DNA, 4080 bp, Oryza sativa
ggtcgggttgggcacgagcatagcgaatccatgctcgacccgagacctacgtgcccgcgcccgatgatgaggatgttaggtctcgatcttctgataggtattgataaacagtcgatttgggcggagtcacgacaaaactcgatccggcttctgaacaaacacgctattgagccctgcaatcacagcaccacgtctcctctggttatcaaccgtgccgaaacctagttgacctcgccgagaaggttaatccgtgcatgcgaatcgaagaactcaagtaagaacaagatagattgcaacacaattgcatatgaatgattaagcacttaaatttggggtttcacaaaccgatctagcggtcaaactgttcttggcagattaatctaagcaaaaccccactctaaacgatatggctactgaataaatatgattaaggacgtcctagagttgccctagggcgcacacccccttaggctaagcccacgatacaattaaaaggcccaaaatccaaatcagattcggactggatgaaatatgtggcttgttttgcatattcccggaagctcggtaggaattttgacatgggaccaaaaccatctgaaattaaattagacttcataagctttccaacaagtactaatgggccccgaaattccttctagatcagcggctaggtccgtttgaagttggtgctgtcaggaggtccgaatccgaatccaaaacgtgtagaacttcatctcttgtcttctatggaccaaaagtgacgtggtgaggtagaagtagacttggagaaggtcttggtttggtccccaatcaacttctttgatcatccatgtattcgttacgctcggtctcttttccttcacccaagtaagtacctctgcaaacaaaagcacacgaaactcattgtgtagcaacgtttgttcaaatatataacatgtaaatctaatagaacataaggcagtcatggttatatccgagctagttgtgtcctcatcactcgacccgtgcttttaaaaacagaagtataaatgcaaaagttgcacaacaaagccacatgtacacataatttctctgttcaacatttaaaaacatccacatcatgacatcaacataatcacttaattagggcagccataagttgcacaacaaaaccaacaatatctctgttcaacacttaaaaacataaccagggcagccatctaggctctagcatcaacacaagtcacaactcacctatgtaaggaaggaaaacatgtgcatttaaattctaaactacttacctagcatatcagctctagaccaaccttgcatgcacgtaagtgcttctgccatttttggtgtaagtctactacgatgtggactaatagtccttccactagtactaaaggttgacgttgaagccacggttgtcactagaattgtcatgatatcccttgcaatcttttgcatagttggatacttgatccatgcaaatttccaccaattgataatgtccaattcttgtctaggaggtaggtttggctcttccgtacaaatccaattctgtgtgtacatgggaggatgaaacatttccaactatggccatgtattcatgttcaccataaataggtttgtaaagagcatacaagaactaaagcttatatttaggatccaaaacatctaaccaataatttaaaacttagccttcatctcctctgatatgttttctaccaagggatctttagtagctttccattttctaattgccaaataaatgccacagatttttagaaagaaaagattagatgtgacataatttcttccagatagtagcactgttatatcataaaacatatgtaacctatcacaaagctctctagcaaacttctaatctgatgcagtaggacacatatcttcaaacaaggggcacatctagaaagagtttcaaagacaagttcatactcttctgcaatggaaagaataaggtaagtggaattctatctagttttacaatcaatagccattcttctaacatatggaatgttcatgttagacgcattttttttcaaattttctcatgtcttcttggtgtggctgtccaaaaccctacactagcacaaattcttccgatgccttgctccataacagccatgccatccttaacaatcaagtttaaactatatgttgcacaacgcatatgaagcaaagaaccttccaacataagaaagttaagaggcaactttccttgtattttctccatcaaattatcattggtggagcaattgtcaagtgtgattgttgataacttcctctcaatgtgatattccaacagaacgcatgaagtacctcacttatagcaataccggcatgtggggcaggcacataaatgaacttacaaaagagaaatggactcaataatcagtttgtcactagtaaattactctatacaacaaaataagattcaatacatcattagttagctacctcaaaagaaaactttttagcttccaatcatcatctatgtagtgtgtcgtgacagccatatatcctttcttttgatgatcagttgtccacatatcggttgtgatggcaattcggacatgcgattgttgaaaatacttgatcaatgcaagcctttacacctcatacatacccaaaatatccttcctaatagtattccttgacattaacttgaacaacggttgcaatacatcacagaacttgtgaaatccagcatgatcaacaatggaaagtgggtactcatgaagacatatcatcagtgcaagttttttcctcgcaagattttgatcaaagacatgtgtttccagcataactgaatgatgaggacatcctccactattacctgttggcaaagacgcaaaagtcgggcggcgactgtgtgagcctctgaataatcccaccttgcttagcttgggaggaggaagtcaccttaaaagggagagtcacccttcccttattggactagtcttttagggagattgggcctttccccgagtgggtgggcctaagaactgtgaggtccgggcaaccttaatttgttgggtctcggccaaccccacctgggccggattgttatcatttggtattagagctgggcccttgttaagggggtgttaagggggtgggaatgatgaggacatcctccgctattacccgttggcaaagacgcaaaaatcaggcggcgaccatatgagcctctgaataatcccaccttgattagcttgttaagggggtgttaaggggcggaataatcccaccttgattagcttgttaagggggtgttaaggggcggcgaccatgtgagcctctgaataatcccaccttgattagcttgttaagggggtgggaatgataaggacatcctctgctattacccgttggcaaagacgcaaaagtcaggcggcgaccatgtgagcctctgaataatcccaccttgcttaacttgggaggaggaagccaccttaaaagggagagccacccttcccctattggactagtcttttagggagattaggcatttccctgagtgggtgggcctaagaactgttggggtccgggcaaccttaatttgttgggcctcggccaaccccacctggaccggattgttatcactgaaccacctgttgagttatttgtaaatgtgagggtggattgtttaaggccttgtctagcttgtcgagactgacaacttttgaggtgattcttttaagtgttttcccatttctttgtctcaccagagagcaatttttgacaccaactacatttagctttccacacatttccgacctttacttgtccaaattcttgccaaatagcatattttagttttcttttgttccctactgcaacatcatcatctatctctatcacattagtatctttagagttagtgttgggtgttgtgactggtgctagggaaggagagggtgaaggcgtaggagaggtcacagcaacagcacctccagcaggtgatgagctagttcccggagttgacatttcttcagatctagcataagaaatatgcatacacatactaagaacaccaatatttcagatctggcataagatcgacatgctaca

SEQ ID NO: 64584 - DNA, 1949 bp, Oryza sativa
cggcgcggatgcggtttctccggcgagcttctctgcccccctctctccggctttctcgccacggagcgatgcatgtgattcgtttttctctgacaaaagttgttacgctctaacgtggctctcggaactaaagaagaatgcgcgaaccaggtgtagtcacgggccccacctccatttctcctccacacatgcattttgctaacgtggataaagattaccacacgccaactcaccgcactgtgaaatgtcctaatgagcatttcttctcacgcaccaactcgcatcacacgagcacaccattttatgcgggtgacgagaccggagttgtgggaggctagtactagcttggaccgaaacccgaggctcggagcacatggtttccatgtttacggatgcactgtaatctaggcatacaatccagacccctttccgcccgaatctgatccaatatctcctgaataggtctcgtttagaccgagtttagttctaaacttttttttaaaacttttaacttttccatcacatcaaaacttttctacacacacaaacttttaatttttccattacatcgttccaatttcaaccaaacttttaattttagcgtgaactaaacacactagtacacaaactgtgaaagaaactgcaactttactccctccattttaaaacataagtgaaactataagagaatttatttggatttcagatttactaatactatgatatatccaattctaccaaaaactcatattttgataaggggagtaaaccgaaatctcttttattttgatgaggggaaatacatcgttttaaattggtcaagaaacagggcatcaggattggatgattcattgatgtgttgtaaagaaggaaataagaaagagtcagttttcgagctcttttcggtctcggtggttctagagtccatcctttcggatgaccggctgtggtcgttagtggacgttgcttcctttggggacttgttaggagtacagcgtggttctgcctcccttccgctgtttggagtagtgtaacccgtcgtacgagtttttctttttcttccttgttttttttgtctctgttttcttctttccttggtatagaccggtttggctgattgcgtaacaagaactctatctatctattatctatcttctatctatctattatctatcttctatcttctattatatactaaaagtccattaaacttcctaaaaacgctcgcatgccgccacatggcgctctaaaaacgctatcaagctgccacatggcgctctaataaaatagagaaaatcttagaaattctgagaaaagaaaaaaactagccctcgattttcatttaagttggtggacccattagtttacaccgttagattagatccattatttaatagtaatctatctctcctaatttaccatgtaatacttacctaaatataatggccggaataagccaagaaggcatatacgtacgtacgagttaaatagaaaaagcatactgcatgtatacgtactaggtactactggaacttcctctgtattttttaaaaaacattgccaacgttaaatatttagtgaaactaccgaaagaaaacaacgattttaaactagatttttctattatacttcctctggattttttttattttctttatgatgatcaacgtcaaatatttaatgaaggtggtagcataagaaaaatatattacttcataaaacatacacaccccaaaatagatctataatataatataaaatatcaaataaacatatcatttcacaccacaattgttgagtatagatagattttatttgcatcagtgggtctacattgatagttcaagatgaaacaatgagtaattaaaatattacttgggacatattgtcagaaactcaaataaaaaatgtattgtttaaaaatatgttgcattttttctcgccaaaca

SEQ ID NO: 64585 - DNA, 4273 bp, Oryza sativa
cgtgcatatgtgccgtgcgtatatttatacgtgtagctttgcacttgcacgcccgcggtgatgcgtgcgtaaaggctgacgccataccggaaaggcatttccatgttagacatcagccgtccatctgctttgagattcgtgctaaatttggtacgcgcctaaccctgtattgtttttttttagcaactgtataataataacttgtgtctttttagtaagaaaaggagagtgggtgaattacatgtaatagctctaaattcttcagaagggagtgctgcagactgcagccagccaactagccaagcagggtttatttggagagattaagattcttaaaaacctgatatctaatttctgagaatctgaaaaaagctttaaaaaaaccctagttcgtagttgctaagtttattttctagattctacaactatagtttattaaaatctaaacaaaaagctaaactactttgtggagcttctgatttaaaaggaattgcactacaataagctcttcaaataggccctaggaatgttagtaaaaagccggattaaccacttacttgcccccttactagtcatcacggtatcctgcaagccaacacgccgcactttgatagttcgacgcccgccagcaaagcccggtctctcagtcccaatcaaggaacacgttaaaaatgaagaccacctccagtagtccagcgtctggatagcatatactccaagttccacggtaatctcgcaccgaatttccacgcgaaacgataaaaatggcagattattttttgggggtttccaatgtcaaacaacacgtggctgatttaatccatctttggaaagggaatcgtatcgccaaacatgaaagcgtaaggggaagaaaaaacttacattttattattccagccagtttcagaggaagtggcaaccgagtttctagtgcccagcagctactgtatatccaatgtgggtaaatctcaaaacatatactccctgccagatgaaccgaaaaaaagcgccggcacacgcttctggaccacggtctcatcatgtacaaattacacatcatgtaataaacacatgtacactaagtctcgacaagaaattaccatgtgaaaaacgcaacaggaaaaagacccgcaaccatccacatctcatcccaaacctaccttctcccaattgggagggtaaaaggtcgtgtcctgtgaatcaaaaccaaatttacctcatgccctcatgtgccctgtgctgatcgaacagcatcattcattactggttcaccgatcaggcaatcaagaccatcttggaggcaaactccacttacccaatttgagcacgctgaacatatgctgtatattctagcctaacaagtccttgaatagaatagggttgttccctgtcggcgtcacaccaacttgccgggccgctgcgtccttctgcaaggcatcttgaaggctagggcccttctttgcagcgaccacatttaccccgagtgatggttctgtggatccactggtcactccagtttgtacatcatccgaaaagattgacataagatctggtgttttcgaagtgctcgaagctggggtttcagaaaccacaggagaggctgatgctggtccgagaagaccttctaactgtgtgaaaggatcagctaatggaggacttgatgaaactggctctcccagatccagaagatcaggtggtggggcagaagggattacttgctctttggctggctgcggtgttgcattagcagtagctactttctcagttgaggaactctcctttgctgtctttcgcccagcctgggtcttcctatcagctttaccaaagagtgaagcagccaaccgttgcttttccgctgaaacttcagtggcctgctgtctcttggaaccatatgtggattcccgagcctgtgaacttgttgaccctcccacctcagaactaacgcctccattggttgcttgttgactagatgttgaacttgaaggcgtagatgaggaggaataggctggtctcccccatttcttctgaactccatcaagacgaagtttgagaccaaattcaccagaaagagaatcgcctgatggctgggatcttgacatttggtgatcttccttatagtagcttggttctggaactggaaccaggtcagtagttggggaaatactggcctgtgaagctgctggaggtagctcataggcctcgaatctaagagcatgggcagatgtctcttgttgatcctgggccttgtagttgccaacacttaccactcctgagcgttcactctcaggaatgtagggtgcagcaccattttcaatggcttgctgcacataaccatttagaaacgagaggtttctgtcgatctgcaacataaatttagtatccgtgaaaaggttgcccttttactcttacgcttggttcaatttataacttttgctttaaagttgtgtgcttatgtagaaatagtgcaacatattaaaaatatatgtaagtgccagattgtttctgtgctgtcaccaggattttatgcatatgaggaagcagataaaatcaagttttcatgcattaggctcggttccaagaaagggatagcagtacctcaatatcttcgcagcttgcatcggctggcattacattctcaacagcctgtttgtccaaacctagcaaagcctgtagctcatatgcacgctgctgcaagtctgttgaatgcgaagctgacaattcatctatcaacgattggcactgcaaaggatcggagatgatttataaagatttacctacaaacaatagagtacacgaattctacaggaagagagttttgccacttcatggtaagcaatagtgttgatgttttctattctggacctcccaatcatgtggacagtattaatatcaaatatgtctctgtgctttccagtcatatggaacatgattgctttacatcatccagtggtgaatgatgttttaaaaatcagaagtaaaggtttgcttctttacaacattatatcaaataacgaaattattcacagaaaaaggctgtcacagaattatgaaacacagagataatatagggtagatggcaagttaaccatagtcttgagttttccgagatgactgttccaagtttgtattaggatatttgctcataaactttttttatagctagtggtgctcaaactgaacagcacgagatgactgttccaagtttgtattagcatatttgctcataaacttaaataactagcattatagatgtaaattccaacaaaggaaaatgcaccaaattcggcttgggtatgaaatgcatgtgataactgataaacatataatcctagggaggagcataatttacagttagtgcaagtatagctttcatgtaactttagtctcatgaaaaataattccctctttcggtgcacaactgcacatgtgaagctatatgtaataaacaatggtttggcttgaaagctaatgacaatttgacatgaaaaatgataagtgagacaatccaaacagtgaagattttcatttacctcgggtagcatatcgatcttccttccaagagcgatttcaaacgcaaagatcttcaaaattgcggagattgcataagccttgaataggaacaccgaataacaaacagcaggacatgtcaataaatcaattagatgtacaaaaaagattttctcaaggataaggaagtagaacattaatcagagaaaacaaaagatctatacagttgatcaaggtgggtccagattataacagtatataatatataattggatatatatattataggctactataattgattggactaatggatcaaactacccacaaaatggattactgggttacccaacaacaatgtaccctgagacatttcaaattacaagttctgattttcatggcaattgatcatagtaattgcgcaagaaaatgtcgagtaatgatcaacttggatctatattataatatttcaacacagagcatgcacagtagcaatgggccacatgtaataacagtggaacaaaagctaaactacaagagcataccctgacagtgtcatcagttgggtgggcctctgccacatcatacagcttcccaataatatatgaagctgaatatttcccatctgctgttccatattctcccaaaacccagcatattatctgaaagtagaatgaatcaacataatctaccacagaaaacatggtacggagtatgatataagaagaaaacaggaaattaaaatcacctgcagaaacgaagaagg

SEQ ID NO: 64586 - DNA, 10408 bp, Oryza sativa
aatataaaggattttaagtttttcttacaatattgtccagtctccttattcaaaaaatgttagaattgttatttttttttgacttactttattatccaaagtattttaagcataacttttcattttttatatttgcacaaattttttaaataaggcgagtagtcaaacattgtaagcaaaaacttaaaatctcttatattatgagacagagggagtataatatagtagtgtaattacacggtaacaactatgcccaaatacattcacagaattagatattttttttggacggagagagtacaatataactttcgtataattttgaaactgtcaaatttactttaagattcatacaaatagaggaggaaaaaacacacgtactctatttgttcagattcatgatacatcctagattgtcatttttttaaggatggagggagtaagtacggggatttggtcccgactttcgcttcgcatgaataacatgttatcgtagtatttgaaagtttacattcgttaaatatttggaacaaaactggtagccgagcactctcgacggtcgctacgtactgaatcacccatccggccacatagaatcagtgcgtggcgcacgcacgatggcgagcggtgtgggcttccatcatcatcatcaactgagaaaaggtggcagtacagtacactgggctctgggatggcgagtcatgttccataaattactgctactgtatctggattatgcccgattgacgtccatccatcgatcataaagtcataaacccagcagagcatgcagcagcacaaactgcacaaggcagcggttgtgccgctagctataggcaacgagggtgtttagatccagttttagcatgccacctcgaatattatatatggtgtttcatgaggtatttaaacactaaaaaaaataattatagaattagtcagtaaactacgtgacaaatttattaagcttaattaatctgttattatcatatattaactgtagcaccatattatctaattatggggcaattagacttaaaagattagtcacaatctatatatttttagcctatatttaatacttcttataagtgttcaaacgtttgatatgatagggtaaaaaattttagggtgaaatgtaaatagcacctatagctatagctatagctcgtcgattggtatccatagaccatagaggtagtatctctctctgtacattttgtcgcagagagatcagagatcccttgcagattgcagctgctcgtcatccttcagcacatcgcccctcgcctcctcctcacgccgatcatcaataccctcactagcaggacaaagtagcggtcgcgcccgtatttttccaggctaatgcattcgtgtttcacttgcagttccaaatttactctacgccatgacaagcctttctctatctaccaggctgtgaacattagtttttcctgcagaaaattttggcagaatttaacttgtttcaagtgtcaaatcaactcaaatgtactcctgctcagatgattttacagtgctgtccccctggaccgaagccgtggtttttgccagctacagtaccaatcctgcagctgcaaggctgcaagagtagggcaatgaaggaaaaggttgaggtcgccttgcaccgaaatgggccgcgtagctgcgagaaaacggcacgggaaagcaaaagcttctgcgttttctgtggtttctggggatcgaaatggggaaagaaatggcgcggcagcaaactgtagcctggcagctcctgtagcctttcggcaccggtgaagcttctccactaccggaacggcactgttccgggatgctgggccagcagtggtagaatagaaagatacacatacactgatacgcatgtgcaacgctcgtttctatatttgtgtacatggattctccagttccatctctgtagattgatcggccctgtttgttggcaaaggctgtgtttagatccaaagtttggatccaaacttcaatccttttccatcacatcaatctgtcatacacacacaacttttcagtcacatcatctccaatttcaacaaaaatccaaactttacgctgaactaaacacagccaaaatgtttttctaacatgtgtggacttttgatgaggaggcacaggagaatggcactagcagtagtaacagacggatgatcactgttacagtgctgcccatgtcaaactggaatcctggatgagggcacaatgtgcaactggaatcccaagcaggtagggatccaaattattttattaatggactggctgtgattagcattcgtaatggtacgtggttctgcaatgcagtcacagtttttaccgaatacattgtagcaggggtagtgtgtttcaggtcttccagacgaggttcagttgagttcagtgcagcttgtttgcgacgtaaaggaggtggctgatgtttgttggggggtagttctgcaggagcttgagattggaagtgaaatcaccagccaataggcgttttcggacaagaatcagcattgcacagcagattctgagcaaggtctcctgcactcggcagataaagtttcaggcgacgaactggaaaaaccaagccttgcaggataaaccagggtgttttgtttgctacctgaggaccatcaggatcacttaatagtgtgtcccatatgtgaatagtgtcagcaaagttgaactcctgggttaacagtagcgtaatccaccggaatgcgtagaactgaggattaatctgcagaaacagaaaccatgcttgtgttaattttgctgcaggcacaaataaggatagcagtggcagtagtgtggatttcctgctacaatgtttcctagcatgatgacaaaactactgtatgaattattaggtccatgccagatcgaaatagatgcaatgtagtttgaacactacataaagcaaatctgtcagaggaccacactaaacacatcagaaattgacagtactcagtacaaagaacatacttacttctgttgttatttccaaataacgctgaagctctccatcatacttcgcaacaagttgcgacagttttgagagagtaccttgaatgccaacagcactgttgtctagtttctggcagaagttgtctctaaacccactaagtaactccatgaagcagaagaaagaatcagcttctgcaaagttctgtagggattccggatagcaaaataaaatcatggttagatagtcccacagaaactattgctataacgaacagcaactgactacagtctgctctaaatcatacagggcattaagcatatatatggtaaaacaattgcttactccatacagcatttttatcatctggatcattccgaaacacaaagaagagaggtgccaaaatttcattcatcccttgtacataacgtattccggcattcagctttgcaaagataatcagtatatttttcagagattcctggtaaggatgacctatgatcagtcaggtttctgagcagaactctgtttagacttagatagtggagttcacctgattggactttgcaaaagatgagtctccacagaaaaaatgcatgtcagggtgagtgcgcttcacatcacggtcaatttgctcgataatctctgaatactgcacgaaagatatatgtcaaagctgatataaattagtagtaacatcagaatgatgcaagctggtgaaaaatacaaacatagggtgcgcgtactagaacaaaaatctgatcctcctaatactaaaatgcaaacctattcttttaaccagcacgtatttgactaattatgtagtccccaaaataacaaactgaaacaaagaagagcacaatagtttagagattagcatcatgtcaagtggtttacaatattctagttatgcttggtcttttctatgatcaaatcacaaaagctccaaaatagttccaaaagaatgtaagcacatctgctactggcaccaatctagttctaatataagatctaagaagatgcaactagtcacaatgtgacaataatttgtagatgaacaaacaaacaacaacaacaacatatgtaaaaagatccatatccaaaggcaacagtgggcacctcaaagaactgattccatgcagttgtcttcccaaggctcaatgggtgctcttcttgtgtaacctctgatctatgaagtaacccattatatatactccctgcattctcactcccttggccttctaattcccgttgccgtgcaatttccatctacctaacagaattagaattcaggatctctattttgtagtgaggtctaacaagcaaaaagggatctcaggtactatactacaccgcacgtgtatcttaaaattacaatcaaaatagagaaagtcacaaatctgaatctgaaggggcatacagggttgctaaggaattcttctttaaaggctgcgtactgtgatctcttctttgccaactcctgctcccacagggcacgatcactcggcaaatagcccagcaacagctgcaaaactaacatagattttatcacacataaagcataactttttgaaggctggcatgctgatcacatcaaattaactaacagaaaaaaaacagcagccctgagtagatgaacaataggaccataaggccgattttaatcggacattacgtcataaaggataggggtaaaggattagactaaataatggacatgtgtaatcaacgatcagaaacataagacagtagaataattgaacaatgtctagactctagaacgcaacagaaagtaatctactgtcattacgctcatgaacctaacctccaaacctgtacggctgtacctacggaacgatccgagattaatgaaaagacgagcaaatcgagagcaccttccacacagtaggacggacggcggcgccgtcagggaccccctgagcagccagcatcctcagctcatcgagatctatcaccttcttggacagctgcgccaattccccaacccacaacgacccatcaaagctgaaaaacagtaagccaaatacgaatacacagagcctagtaacgcgatatcttcaggaaatctcaccgccgcgaggagacgggactgccgcgagatctcgaactccggcggagggggcgcccccggcggggatcgcggtgaggtcgccatggatttggaattttggatgacgtcagaatatctgaatttcttgggccctggaagatacgcatcgcgatccgttctggtccgtagatcttgtgggacccggtgtaatacgctcatggacggctcagatcgtaagcttacttttcatgcttaagtagggcccacttcacggtctcattaaagcggccaccagtttcatgtgggcttcctaataattgagaatgtgtactgggccgaaatttcggcccagctatgaatcccagtttagtcgtagctctgtcacaggcctaactgaagtgcaagcccaacaattatgtacagcatcagaaccaaactctgaacttttttcttttttatttcataattattactgtttttttccctcgaatacgcttatacacataagagctacgtatcattgcgttaagaagaagagaagtacaagtagacgggcattacaaacaccagatcataattaatttacagatagatctttgacgtacgatcagaggcaaagataagaagaggaccaaggtattgaacaaatgacaacatatgctctctcttcatatcaatcgcacactcaaaaaaaaaaatcaccaacttgtactgtgttgggaactactaaatcattttgacacctaacaaagcttgcgaatgatgctttcattggattgtgacgatagtgacaacaagattatagataccatctcgtgtttggcacataattaatctctgtcaatatcaagtattagtagtcggtgcaggaagctgaggcgaagtagataggaatgctctgcaagaaaatgataacgttagaggtgatcaactagacgagtaagtcagaaggtcaggcgtaagtgtacacgcatatataccaagtggagtattttacggtgcagatgacaaagtgacgtatatatgttcctagaacaaaatcgagtgcacaagtctgaaactctgaatttgactaggccaggaacaaattggtctttctcaacccgtcttaaaaaaaattggtctttctctggatgaactgtgctgttagttgcaatatcaagcgttgagatctttgttatgggtcagcttttcagagcattttccatgtgtgtatataatagtcttataatgggaaaattagctggtctgagacaaaaatcacacaaaaagggctgaccacggagtagttgttctggtcttgcagcttgcaggttaaggcccctagtcacccatgtgtttatcccagcatcataagtcccctccatgattctttttgtctgccttaattgcagaagtccttttcattacttgcaaattataatcggtaaatttacatttaatatagataagttttgatgctctggcatttgaacagaagatggaactagtgaatctgtgatgcggatattcagtgtgcgataattttgcagcagctcaactctgaagccgacagcgccggcagcaatagtgtcatgcatgaacacacatatgctgaagtgttaaacaggtcaatgattaatctggtcccaccccatcaatgtcattagcagtcatcacctcctgaactaagattactgcaatggtgacattggattgctgcaaggggcaaattaacctccttctcagtggcccagaaatggcgtgtctgaaaggtcaaactataccagaagaaaactagtgtacttaggaaatttgtttggtaaacgaagtgatcagatatctcaagcgatctaataaccatctatcttaaccgataagttgaatctttttttaggccatgatgtttggtataagcaattcttagggctcgagaaaaggtaagctcaacagaaagctaggtataactagcataggttctttcctccagattaatgcatagctaggtataactagcataggttctttcctccagattaatgcatggacctcttcttcatgtcatgcacagactacttaatttatccatggaattaaacatagttcgtagctaaccaaaatatgctctatagaataatcttggaactaacctttggcactccgaagaagcaaaaagtgctcaaaagtgcacatttaagaacagtgcatgtcaattcaactgcactatttatattctgtagaattctttagaattgctacacttgatgcaacagatcaagcatggtttaatccatccaaaaagagataagtctcacaaaaaccatgcaccctactcgccacgtccgccgttcatgcatgtggccgagacatcccataacccacaaccaacttgctactaattactcgattagtaactaatcgcggggccgtacaagggggactaaactaatcaggcgccacgtcggatgtgcttaccacgtcgcctcccccggatagagcccaaggtggtcgcctcgccgcggaggcgggggcgatgctgagctgtcactggctgttgcttcctttgggccgtggtgggcccatgcggatgaggacggggtggggcccacgggggcgccacgtcgacgttgtggggggaggcttatgtggcgcttgctcgttccaagagccggtttagctactcgacctctaggaggcgacgcgaccacgcacgcccacggcgcccgcgtttgccagccagatttttgcggtttgatcccttggttacttgtgaactctgtagaggggctcgtgcatttttgccttatgttagcgttttgtgtcggccacttgtgtaactagtggtactataaattaacttagctaccatccatgatctttgtgttttgattgtaaaagactttttggtgaatgtaagaaagagttttgaataattctatactttatactaattctgtcccaaatataaatatttttagctataaatctatataattgtgtgttcagatttatagctaaaacttgctataattgctcaatatacatacttttttttcctcatatgattacgttccataaataagtttgtgcagttgacgatggtcagcccgtcttaaaccaacctcacgtagtcacgtcctcaccacgcacagtgtagagaaggataaagggcttttgtgaaaataaaattctacccgggggcttccatcaaaaaagaacagccgttcaaaggaccgcagtttttggatttctatataaaccttcaaaaacccgcggcaattgccctcagatgcatagtactcgcacgccgcgacgcctctgctgaacatttcgctctcttccaagatattttttcctcccacgattccttcctcccatccctgtggggattcatcggctcatccgtactagcacaagatgtgcgagggtgtgcgggccgccggcgacgccgccgccgccgccgacgtcgacgtcatcacctcctccggccgccggaggatccccgcgcattccactgttcttgtaagcttctcctctttcatcagcaaattcatgaatccttttagctggagatagtttctgtggtcaaattctggttggcgtcgggcgtgttctgacgaggaaatctccgtttaattctttgtttgtttggtttgatcaccaggcgtcggcgtcgccggtgctggagagcatcctgcagcgccgcctgaagaaggagagggacgccgccgccggcggcggcaaggtccgcagggccgtcgtcctgatccgcggcgtcaccgacgacgccgcggccgccttcgtccgcctcctctacgccggcagcaggtaccgtgccctcgtccattccattcggccattcccctctaggatgggatttctgctggtagtctttgcttttcgagcatccgtttcttgcaaaagatgggcgattagttgaagaattaatggtcttcgaagactaattactcgtattaactcacgagggggaaagaaaaacatgtcacacgtgtaggccacgctgacaagaaactcgatctcttcttctatggtttagttgaaaattatatatttttagtttatttttttattagagggtacgttttttctgttgatcatggtagcagtaattggctactaataattgctacctaaactatgaaaacggtagatacgacgaaatgatgttgaaagtttttaagcgatgataaacagtgggtgaaaatatgcttaatcactattctgtatctgtagcagaacgagcaaaaccttcggagcgaatgctgtaggaaaaaaactgaaaaaaaaaatctggtgtccaaagtccttgctagataggcagtccaatcaaggcaggcccggctaaaccacggatattttcttcatctatcacacagcttacagatccaatgaaccattccaagaatctcgctaagtgattagacagatcgctttggcagcctccgtgataaaatcccctccaagttggccaatttgccgattttttgtgcctcatcaaactgtgcgagtcttgacaaggcaggtcaggtaaggtgacacaacacaaccccacacaaatgacacaaacagagcatcgaaacatcgccatctccagctccgagagccgtaaacaaatctcgtggagcagaatccatgccttgcctcggcgcgtcgacttggacggcacagacagagaaaaaaaaagagagaaaaagtagtagtaaagcgaagcaacgataagtactagaccactagagcagtaggagaagtcgagaagaggatgattttggctttctttttccgccgcttggtttggagtttggtgtggtagcgcctgcctagttggaaccctccccttgcaggcgagcaccaagcaggcagccgatctcgtcggcgccacaagaaaaatcgttgctgtcgctggtgcggcttgcagggccgggaccgctcgccgcctcagccatcatctcgtgttggtttttgttgaaaaaaaaaaagaactctctttttgtgtgtggagatgcagaggtagggacctgcccaaactgtcccagtgtcccgatccgtttgaaacgaatgaagactttcgtgcctttctcaacattagtaatagagtaaatttcacaaaagtagaagttttatggttcaagttgcagaaaatcacacacattttgacacttgacacttgacacttaagtacatatatttcggtagtttagtttcataaaaccacactatcgatgaatggattcacccgtgagatgatatggttgttccacccgtgagatgacgtggttgttccatctaagatgaggacgtgacatcatattaatttcgtgcgatggctggtaatagaatgccatgtcctcgtcttaggtgta

SEQ ID NO: 64587 - DNA, 23956 bp, Oryza sativa
cgtcaggaatggatagttccaaaaacccatcgatttaccacatgttccattattgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcgaccatcctcaagctgcttgccagcgaagatgaggcgctgctggtctggtggaataccctccttgtcctggatcttggccttcacattgtcgatcgtgtcagacgactcaacctccagggtgatggtcttgccggtgagggtcttcacgaagatctgcatacctccacgaaggcggaggaccaagtgcaaggtggactccttctggatgttatagtcagcaagggtgcggccgtcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccgacgaggaggaggaggccgtcgccgtcgccgtcgccgtcgtcccagcgccgccgccgccgcagccggcgagcaagaagggaaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcggtgcggccaaacgccggcgcctgcttgtcgacatgcgtccaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagctggcttgctcctggaagaactcctcatcagcaggatccgcttcatcttcttcagcaactgaggggggatatttatatagagcaagggtgagtacgggagtactcagcaagccatggagaaataagtgtttaatgctggcttcaaggaaaggctgttgttttgcaattgattttatttgaactcttttctgaaacaactaagtgagtgcttctcaaacgacacggttgagacagtgcgtttcgtccggtcggagtatgtgcaatgtatcaatctttaaaatagatcaagattggcacccggccaacagctttcaaacggccacccgggccaacaactttcaaacggtcacccgggcctagctgatcccatcagctgcagattttccaaacatcgatctcctttccacaacagcaatttcacaaacagtagtcaaataaaactacactaggaatcacctcacatccgcccataaccgtgggtacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgttcggatgaaattccaagggaacggtccttaagtgcaagagcgggaaaccgtacacccggtacgttccccggtccgcggttttggaaattcatttagttcgcaagcaccgaccccaggtgtcgggttttccaagccttttgtaaaacccaagttttacccaagatgtttatcatattttaagtttgaaggcgaccgtcgatactcgcacagagtgcacgaataccgaagcgtgactgggtggctataagggaacatggtataacaattaacaaaggaaggatcagatgcaacaaattaggtaggtctgccaatctgccttgcagacgggacaagcagatcaagtgcgatcctatcaatgcataatatttttcaagcaacataattaaattcaaatataggctcaagatgttcaaaggtggcttgccttgctcgagatcttgagcttgatcctcgaaatcctcgcactgcgggtcttcgggctccaaaactacgcgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggcggctagggcgcggcccgagagaaaaggggcggcttggccgagctaaatgggccggccggcccaaggcggcccaaggcacgcgcgcgcgggaggggaggagagagagggccggtggaccgggtccatcccgcgtggtcccgggtgggacccgcttgtcaacgactcggctcaccgtgcggagggagcacgcggcgtggcgctaggatgggggaaagacgcggtgcacgcgtgcggttcgcggaggacgcggatgcggcgggcccacgcgcagcctcacggctcgcggtggaccatgcgcacgggggaaaacggagggagcggctgccggtcgcggccgaggtggcgccgacgtggcgcctacgtggcagccatgcgggccggcgggaggtagacgacgacgccggccggaacggacggcggacgacagcggcgagcggcggagcgaaccacggcgatacaggcaaaagcgagcacaccgggtggttgcacgagacgaggggagacgagccaacggctcggattcgccggagggagcttgacggcggcgaattgcggcggcggcaaccggcggcgagggaaggggaaacggcgacgaggtcacgaggggccgattcctggcggcgagagcatctacggggctacgggaatccgtcccttgcgccggattgggcggagctgcgccgagcgaggccggcgacgagcggcgcttccgagctcgggcggcgacggcggtgagcacacggcgagcggcggcaacggtcggggcggcgccggctagctacggggaggctactcgtgctactacccgagtctaaggggaggagatggagcgaggagggagaacggggagatgcactaccatgcgggacgaggcgcagtgacgagaggccaacggcgcgggagtaatctctccggcctcgggccggggaagaggaaggagagggcgcgcccgaagtccccttctgcgtccacgaacgcaccggctctcccggtgcttggcgatgaacggcggaggcgggacagagcacggaaggcggcggcaaaggcgcggtggcggcaagcgaaacggggggggggaatcgatgggagggcgccttggtttataggacgacgatgtcggtttggaaaccgaccttgggcggtcaaggcgcgagctggagctcagcgctcgcggccaaaacggtgacagaggcggatgacgccggcggggaggggaaaaggaaaagagggagagaaaagagggcttgcctc

SEQ ID NO: 64588 - DNA, 691 bp, Oryza sativa
tattacattttttttaaaaaaaaatccatgctattaggcaattagagccgacgggaacccaaaattaaaccatgaaattggcttggagttgagccagaggatgagaggagtgctgctgctggactaaggtataagctttattcaagtttcaaagcacatgaattcatctctgtctcgggataggcgctacgactcgttcaagacgtggtccgggaagcttgagcggcaactcacccatctggctagcgccggggacggaggtccctgaggaggaggaggacggttgcgacggcgatgccatccgcagccaccacatcaagtccatgcctcaggttgatcgcttcttcgccgcactggagggccctaaactggacaaactccgggtaagtttcttgagctaattcttccggaactacacatcgatctatgtgctttgatttgctggaacactggagagagctcatggtgtgtgttgtgtcgcatcagtcatcggaggagctggtgcttctgtcggacaaaacgtggccattcctgctctgttcccggtgtcggcgttcggtatctgcctcggcatgagcagccaggagatcctgtggaagacagtggcgacgtcaacgccgatgagattccttcacatcactaccaaggtgaaccaggtgctctggtgcgctttctgtcgcgctcatgtgcg

SEQ ID NO: 64589 - DNA, 845 bp, Oryza sativa
ttgggcgtggccagcaacgaccaagaaattataaggagttgttcaatcataggcatgccatattgcggagtcacataaagagagcaattggtgttcttaagaaacggttccctattttaaaagttggaacgcatcattctattgaaaaccaagtgaagattccagttgcccagtggtgttctacaatcttatacggatgcttaatggggatgagggttggttcaatccccaaggaagcaacatatctccagaacagtttattgatgtccctgaaggtgacgacgaatatagtaatgatgtgatgtcccttaacagtcaagtagatgatggaaacacggttagagatatgatagccctaaatatgtggaatgactacagtcataacttgtcttaataaatgtgagtcttaactggtctcatgaaatattttgcttttgtatttgcatcatgatgtttttgcatgcttaaatttgataacggtttttttttattcgcagcaacaatatttggaagagggtccccaaagttcaatttaatccaagctgcagctgtccaaagaaagccatctccaaagatttcaagacatcaaaagaaaaaggcatcgccaaaaggtatgggctttttcttgtcatgttaaatgcacatatgggcttctcaagttcagtaggttgatagattaaaaacatgtaattatctgtagcttatgtgtggttctctattccaactgtacttgatcgttcaagagctagttggaatgcaggacttgaaaaagctttggttgacctactacatgatcacaacaacgactgctataggagtcagaatgggtggtccacagaagcatg

SEQ ID NO: 64590 - DNA, 538 bp, Oryza sativa
  unsure (1)..(538): unsure at all n locations
ctttgtttaggttttcgattgtttgcgtatagtggcggttatcggattttcgtcgatcgcgggttttctcgaagattcgtgaagcttcgtgaagaccttgagcaaggcaagtcaccctttgatcaattgctcctataattggaaagtcattattattttgtttgcaacttgcatcattagaatcactcacgtttaacttgcttggcctcggtttgcatgccaaaccgacggacctacccagtagtcgcactaattcctgtaggttgtaccaccctgattccttgtcgctccacccttgtggtacctcggtattcgtgctctctgagcgcgtataccaaatatcccacatacaccgttgtttgtcgaaaacttgggaaatgggtttgtgaagccttcaaaaacccgacattgtgtggtggttccccggggggtgggtggttttnttgagaaaaaaaaaaaatgaattgtgaaaactcacgatgcgggggttgtgcctatgtggcactgtcccgtattcgcatataaggaccgattcctg

SEQ ID NO: 64591 - DNA, 647 bp, Oryza sativa
aggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcat

SEQ ID NO: 64592 - DNA, 23898 bp, Oryza sativa
actgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaacatcccaaatcattcacatcacaaatacaaatcctaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagaggggaggggaggaaggaaatacgagggatagaaggaggatatgatcttatctaaatattttggtgaggaggaaatatcatctgggacttaaccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttcattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctctttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcatcatgtgaaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgccatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctagccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaacaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaactatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaagccttttataggcagcg

SEQ ID NO: 64593 - DNA, 7846 bp, Oryza sativa
ctaccaccgacagaggaatatgggaactcatccacgatggctgatgtctctttcatctggcccactaggcacctcccaacaaccataagcaactcagtgtgtttagattatcaaagcaattttatcactacaaccacctagagagtggaaaatttcggtttttgcactaaggttgcattaagtgcacaaatccctaaaacaatacatgttcgatattctactactagcagaggtattagcatacatcagcaaactttataaaacagtttcttctaaattcgattttccacctaactttacattaacagatgcaaaaaaaaaaagtcttgaactgagagggggactttataatggaataaacaaaataacataaaaatcagcaacagaatcaccacaaaaacaatggatgagaaaatctgccaaacgaagccaggaacttactgttgttcgccattgttggggttctgtttctctccttcacgattactactcgaattcgaattacaattggatggatttaacagaaactgcggggagaaatgcagcaggaagatgatgaggcaggccacgtagtggttcgagttcgagttgagtcccaggttcacgaaacagttcatgcagtcgtgcagccaaatcgccgcaacctcctagcaatttgatgtccaaccctttcacgatctcacgtcagcgccgagaattcgcgcgatcccatcaacttctcaggcaatccggtttaagtctggatcaactcccgcgtgatatcactgcgaaaaaatcaaaggaaaccaaccgtttattattcacccaaatttataaaccttcagttttagtcacacaaaaaccgcttcccagcacacgaaatccgccgcaaaatcgagagatttaagcgattcaagaaagccgatgattaaaactagaccaaaaatcaaccccctaagtcatcaggaagccaatctccgaatcccacaccagaagcgatcgaatcgagccaaggcaatcaacaaacctagggctccctatctttcccctcgcaaacccagtccaaaaatcgcacgcaagctatacgaaatcgcgccacacacccacctcgagatttcgattcgaggcgcacgcagtcgatcggagcaagagcaaaaaaaaacccgaagcagtcttgcggcgatcgatcgatcgatggatcggatggttttcgctggatttttggagattttcggagagggggatttggttttggggagaggaggagaacgagaccttccgctttcctggcgtttcgggagctttttgggcttttggaggtgacgggatcctgtcgagttgggggggggggggggggggggatttatagcttccttttcccgggggttacgtgcaccaccagggtcagcttaccggctacgtgggggccaccccaccaaacccgacatatcttcaccgttgatctggattggacggtccggatcgacgccacgtcgcccgaaacgttggtgaccgcacatctgacgatattttcagcgtacatttacaccctactatgaaatacacaaccgtaaatcgtacataatcatcgtgtacaatagggtctactaagtaatttttaagattgtacaccctccgtttcacaatgtaagtcattcaacggagggagtactctagtactgttttgtcttaaattattttttttctttttatatttaattaaagtataaacggacgcacacgatacatacacttcactttttactcactccaccacacacccacacacgcatgcacgtctttttatagccaggctagaactcgtaacagtattgtattatgcaaaaactgaacaatttcacgtgaaacatctgcaaatctcacgggaagccctcgagtttataaaaaagtttcataccgaataataatgtaatgtcatctgtgctcatccaaggtcatttgtgtgatacaataacacccaatggctccactagatggtactacaattggaggagcacaaactgcacagatgagacatgtcctgcacagatgagacatgtcattggacgttggaatttaactaggtatatcttcctccaattgtcccatgattaattttaaaaatacttaatacctttcgtcttccatggtgagttcattgatgatgcaacacacaatcagaggacggtcgttttattttcttgacctggtaaaggtgcatttataggtaacacgtttttttaatcctctccttaactataccccttttgcatatgagagccacttgcacatttatctaacaaggagcaactcgaaaaatcaaaatcaaaaggaacttaattcaccactctgactcattccattgacacgtcaccagttgcatttccacagcttatcattgcatgcaacacaaaaattgggaggaaaattatcacaaggaggaccatctcttctccgttctcacaaaccatgcattagcaccgtttcacagagaagagatccccttccgaaaaaaacaaactttagtttatctgatatttcaaaaagttatataatacgtagtactaactggcatgtatatcttgaaacccgtcgatccaaaaagaattctcaaatcgtaggaagaacatattcactggaaaggttgatatcgactggagcaaacagcatcacgatcacgactggagtacagtaacaagatggcaaattaatgattgtctaattgacgtactagtacagtttttttttttatttttcgtgaacgcgtaaaaactgttcaagtcactgtggatatgtttggaagatcataaaattttaaaaagctaccggtaaggatatgaaaaggttaagttcattttctaaattatataactatatattctcaaaatttaaataaaaatctagacggttgagaaagcttcgcaactgaaaaattttaaaagaagctaccggctaccggccctaccgctgtcagaagttgtccaaacagacctatatagtttcgtgcccgtttatcattggaccgcctatgaacccactgctagcctcgtgctcgtagattggcgacaactagctacgcatgcaaaaacgatttgagaaggaccgagaaagacgtgcgtgatggggccagataccgtggcctggcctggcctaaccggggccatcatttcatccaacgcacagaccattaggctctcgctatccgaaagaacagaaaattaaaacaaattcgccaccacaaacgatcgcgtcgctgcatctgctctctatctgtacacggagataagacacgagggaattatgcacaaaaaagtctctctctctctctctctctctctctctctctctctctcattttcggaggacgacgttaatctcgttaattaattcagaacacgtaatattcagaatatcaccagttgatattatcacataatttagacttttaacagagacgtgatctacagtgcattattcagaggatgcggcaaatatagagatgatcattatatcgttgaaacggatgagcgcgcgtagttaatctgtcaattattcgccgtcattttcccgagggaatatcgtgttcccgtggccatttcgtcttgttccgaggactaaggacaaagcttcacgcagtacgtgttggcgcttttctggccagctggacgatcatgccatcaacacagacactgaaagaacgattactaccttgctagtgacatgcatggcacgccaccttaattatatttctttccatggagctcggaccaactgcttgatgaaaccaaacacgagagctaatatgagtttcttatcattgctagaagtcgaaatcaaatcacgaggtccccaaacagtaggccattaatcttagctagtactagtagctactccctccgtcccataatattacaacctcgaattggatgtgatgttttatagtacaatgaatctggacatttatctgtctagattcgttgtacgatgaaatgtcccatccagttcaaggttttaatattatgggacggagagagtagttggcactttagatgattaataataataataagttcagctctgaatgatttatcacgtaaatgggaggataagaatcgaggctagctatacacgatgcttaatttcgtcgttgtaagttgtaagcgagaaagtgacagcttcctcagaagcaggaggccctccatggctggagcgaactgccagtgccacctgctcatttcgacgaatctcggcttttctcgctgcacatggaggaagaaactcatcaacccatctgttagccggtcggcactctggccggatcactccgtcggcgggatccctcacctattgtcacctcacccgtcgattggcaatttgtccgtggcatcaaggctacggagtagttcattagcgtataattaattaggtattagctatttttttaaaaaatagatcaatataattttctaagtaaatttcgtatataaatttttttaaaaaaacaccgtttagcaattaaaaaaacgcgtgcgtgaaaatacaagatcgacgacatagtacggccgccaatgcagcgagcaccagcgcctcctacgtgctgtaccagtttccaccaacctctgcctttctctgttgcgcgcagccgcgcgcgcggggtctcgcgccgtccttggcgacgagacgacggagggagcgcgcggcagcggcacgcgagagagtcgttgtgttgcgcgctcacgcgcgaggggatcgagtgatcgaccgacggatgcttcaccctgcgacgcccgagcgcgcgcgtgagcgagaccacgccaaacacgcgcgcagcccggccggtgggctgcaggaaaacgagtggatcacgcggacgcgcgcgcgcgaggcgcagttggtgtgtgtcccgaggagtacgtaggaactctactggtgtggcgctcggagtcggagaagctactactcggctggagtgcagttccagccaacacggacgtgtaccgagtaccgacggtgtaattttcacgggccccgtgatttctcccgttccaaaattaaagatattactacgaatttgaaacaaggaatttttacacttaggtaccacatatcacccattatttgcatttgacttaaataattatatatatttttaaaaaatgtaaacataaagaaaattatttttgtatcaaagggaaggcaccctccatttacattaagattgaaaacatcaattgggatgacataagcctatagacagacacgcaagactaaatttaattcataactagagaaaaaaaataataaaatcaagtagagaatagtatatgtacaaatcagataaaatttgtttttttatgcatatatcaaatttagatttgcatgattgcgtggagtcttataatatcataatatttcttgtcaaattttataaaaattttatataactatttagaccgcatgcatatacctagatgtcatggtatctagtggttgaaaatatttttcctacgaatcaggactagtattaggattattaacattttaaactaggcttatttattttgagatatatattataaatcgtttgacttttttatagtcaaacttatttaaattcgatcaaattatagtaaaatatagtagtgtttccaacacaaaacaaacatgttatcaaactacattcaattttaagtttaataaaactaatttcatattttagatgttaattttttttctataaatttgatcaacctttgttaagttcgataaagagtaaataagctagcgtgcaatcggaaggagtgcgggtcatggcgggccaggaagaagaaatcgaagcctcgtggccgatgctggcgccatacatgcaggacgcggtcagcgcaagatggatgtggagccgcccgtttcccatgtgttgaagctgcaaccaactgggagcaaaacatgcatgtgctatagctgatcctgcaggtccatttctcatgctgcaagagggcgtacgggtaccaggtttccctcccatcatcccatgtaccttgatggcttgatccgttgatcgtgtgcaaacctaacggacacttagcgtgagaagcatatttgacatatgagccggtaaagcattgttgtcacacgcacatgggaccgatcgacccctcgccacaactaactttgtccggtgccactatgctaatatggccggtttaagctattgactctaaagatcagggcaaagcgcttctacctcaaagaaacgagggacacatggctaaagcacgaaggttgcttttaatttggttgggagaaaaagaaggggtctagaagcatctgtctactggcacatcatctaaccaacacgctaaaagagcatgactagtgtaaagatgcatgcacaaggggaacacaaggaagagaaccagccagctgaccttggaaagctagttgattatacgcaaagcgatatcgtcaaagtaaaccagtttaaagtgcagtaggtgctacaatgtgcaagcaattctataaccagtttaaagtgcagtaggtgctacaatatgcaagcgattctataaccaatttaaactgcaataggtgctacaatatacatgcaattctaggtaaacgtgagatagctcaactgttgaagtggcatctgaggccatggcctcaaaaccaaacagataatcttaattgatcatgcaaatggaacccaccaatatccacctactagagtactaggtcgctgctcaccagataacgaatgaagacgattagcgagattgggttcaaaacaaatagccatgtaaatgtttttcttttttttaaaaaaaaacgtcgatagatacatggaaataatcaagaaattaacatgtttgcaatttatcgggtttggagcagagaagcacatgatagaaaacagaaattgaaacagaggaacacactcagaaaagttcaatgaacaatatcttcaaatatattttaccagcaattaaatccacaaaaagaactattaatactccagtcaaactggagagagcagggtaattgggaataggtagcttaagatctgaaaaaagaattacctccgagacatctaaatttcttctctctctggttcagactgctgttcgaaactggtccatagaaaaagcaagcagacagaatcacagaacacatggaacgggagctggcaacaagaaaaaggccaagcattacagtccctagtatatttcaactgagcagtattcaacaagtatcgtagggaagcaaaaaatgacaaacatatggtcacaaaggggatgaataatatgcgattgaaacaagtaatttctgcagcgctctctaatcaagtggaacaaaaataagtcatggtgcacagggctacaacaagattgtaaaacactgacgcttgtaacattcagaacatgcaattccaacatggcatcagcaccataccagaaacaagagctcagacgagaaagttggttgcatccaaagtcatacaagataccaaaattagcaaacagagttgacagtgacaaaataaacactaaagcgcttcttcattctactacaaatcaatcatactactaaattagagaaaccaatgactaatgcaggaaatgcagccgctgtatcctattgaactgaagttagattgaataacaggtcccaactaacttccaccaggatgtattgatctcacaagttcaaataatttaaatggcatatgctacccaagaataaaaagcactaataatacttttcaatagctgacagctcatagataaagcaagacaaatcaaagaaatatcattccacactgaatccagcaccgaagcatatcaaatagatgtgatggtcatccaat

SEQ ID NO: 64594 - DNA, 4687 bp, Oryza sativa
tccgatgatctcctctttaaatttctcgcgctgttgttgttgtgatttgtgaactgaattgaacgatgctttgttgttgttgttgaggaggagggttggagtggagctggatttatactggagggaggccagtgggggtggcgcgaaacaggtggccgcgctcgctggttttcccgcgataccgggtgcttccttcagccgcttgctcctcgctatctgtcccggctgggttggtgactcaccatcttggcgcccgtcccgtctcgtctttgtcccacacgcgcaagtgcgcaactggcagattcgtggggattcgtggggataatatgggtttatatggagtaaggtgacaaggacgcgcgccactagcgagctgatgcatcccacacagttctcttctctcggcgcctaatcctttttgggctctcgaatcttaacatggacgaatctaaggcccatgtgatcatacgaaggcccggcctggctgtgtgtcaagctaacgttatccggttgcacaccacctcttcctcctgtccctcgtgtttgtgtcacgttcgattctcccaagctgatcttgtgtcgccggaattgagcagggggggacgtgccgcgacggatcgaggcgatgcggcaggcggtcggcttgtgcaaggcccatcaacttcggccggccgcgctgctgtccccgcggccgttgctccggcgagcgtccccctgcctccctgcaggtggttacaagttacactacctcccactgcatcggttcttcgcgtgtgtgcttactgcttagtgctaactggatgcaattgtgcagcgggagcgggtggggagctcaggagggccagcgccgcgtcgcggttggtggtcaggaggagatgccaagaagaggagcagcagcaacagcaggaggaggaagagcggagcaatggcggtggtggtgatggggagcaagagcagagaacatttctcagcttggaggaggccgggctggtggagatgtccggcctcagcacacacgagcgattcctctgccgcctcaccgtaagtgtgcatctctactgatcgattgcaaagatattacagtggcgagcagattagcatatcaaagttgtgaagtttaggtgaggtgtttgtctcaacgagccgttgacgatgacgagtaaccatgtgattttttgtgacagatatcgtcgttgaatctcttgagagtgatttcggagcaagaaggcgtccccattgaggagctcaacgcaggccttgtttgcgactggttcgtcaaggacaagctcaagagggagcagaacgtgggctcagctgtcctgcagtgggacgaccctggtttctagctccatcatccgtttatggatgatggtgatttggtggtcttgccggcgtctccaccgagaaacagggttcatcaagtcaacatttttctcggttgatagagctcactgatcactttctttgaattaaagagggttcctttgtcttgcgacactcgttgtgcctaattgggctttttacatgtcagtacatgacgacctgtatcacttcctttgtatgccagagaccaaagccagaaacacagcttaattacgaagaatcagtttcaagaatatatggatcagaaattgctgtcggattgttttcaacttttcatttctagcattcagttgaacattttactcatcaattttcaaagtacttgcaaatcctagaaagccccaatacttcttgtcgatagtgtaaggctaggagcttgttcataaggtcatctgacttcttttggcaaacaataacttcacgcaggtgttttgagtcaaggagatacaccaaaaatgactttatgcgtgctacagaatgtagccaagtacatatgcccagatgtgccaaaaaaaattccgcaagtatggggagatattacaggcacgacagcaaatgccaagtagctaacaaaagtatttgtacgtccatcaaacagaattacagtggaccctggcccatgggtgaatcatcggccaacaaagatgcctacaaacacacataatcacagtacatatcttttgtttccttaggaaatgatttcgctggacttcttatcaaaagagtgagtgcaccagatgcaagtccaacgggctcaccaactccttcagcctctccatttccttctgcaatcacaataatgcaacttatatctctatgctcactattcaggcataaaaaaaatcaaaacaggaaaacaccaaatgtctgagatgtatgagttcatgtcatattgcatgctgtttcaggcataaaagaatcaaaacaggaaaagagttgatgtcatattacatgctgtttcaccaagtaggttgtcttaaaagaagatacttggatctacaacatatccattttgcagacagaacaatcattgacagttcgtaagtgaagcaatcataacaaatgaaacaggggggagagcagcatcccacaaaacagggaattaaatcataacaaaggcccagtaaagctgaatgaaaacaatatcatgcaacagcgcattgcacacaccctcaacttaacaagggccacaagcatgagttaagagatagtgcctcaaatttatcacttgatgtcatactatctactgcttcctcaagtatgttctccctgaatcagggacttgaatccacagaatatatattttgcagacatgatcatcgttgataacaactagaaaaggcacaaaactcagggcatggctctttgataggatacatgatgagcacaacaagacttccctatgactaaaaaattcaacagaatatcaaatgcatcagatttatctgttgatgtcatgttatccactgatttgtcaagtaggttctccctgaaacagggacttgagtccacagggcatccattttgcagacaatatcatcattcgcaaaaaacatgaacataagtttgaatacatctctatcaagtaataatgctcagtaaaaacttgtaacaaataggagtaccaacaagtaggttcagacctcagtaacagcccattaatctcattataatgtaggccccccaagtaggttctccctgactaacagggacttggagaaacctacatctcacattttgggcactgcatcataggtcacattctattaccatctaaaatatcttctcttacatacaagactatggctacaaaagcgagttacaattcaaaaaatcatgagctacttaatagtagacttcagtttaaaaagcccatataactcattacaatgtaggaccccaagtaggttcaaacctgaaaaacaggcccttgaagctacctacatctcacacattgggcaactcttcatagtctactaatgaaacaaaaaaaatacaacagatggcaactcaaatattgcttgaacaagcttgcactataattaagaatactgtaaagagggctttcaaatttatctcatacaattcatatagcgtgataacctcagaaaaagcaatcaaaaccgtactaaattacgcaccaaacaaaagcattgaacatgattgccgagattgtcttaaaccacgtttctcagcaaacagagacttaaaaaataataattaatgtggtgagacattttagaagcataaccaccagattactgttatctcccacgttaaactcaccagaaatcgatttttgcctccatgactgggcaaccatgagaaagaccattttcaaggagccaaaggtgaggaaaggcacccacatggcaaatactacctcaagatttcattcgatttttgcacatcctctatagctataataataaacaaattaatcaagagtcttacccatcatgaatcggtcttctctggcgaattagaggacggcggagaagacccagatgccgcgggaggagcatcgtgtgagcaacaaccaccggggccgtgatgatggtggtggtgatggtggtgcttcttgggctgcggctgccgcagcggcttgcgcatgtcgtaggcgtcctcgccgtcggcgtagtacttggcctcgacgtcgtggatctggtacccgagcgtggaggtgtagaggttgaaggccgcgcggttggagcggcggacgtggagggagacgtactcggcgccgaacacctggtccatggcagcctgcgcggcggacatgagcttggtggcgaggccgagcttgcggtgggagcggagcacggcgagggaggtgatgtggccgtggcaaggctccgaggggtcctcctccatcttcgcgagcacgtagccgacgatccggccgccgtaatcctccgccacgaacagcagctgcggccacgacagcatgtggtagaggtagtacttcatctggtagttctccggcaggcacatcaggttgcacgcctgcatcgccagcaggtcgtcgatcgtcgcctgccgtatgcacaccatcttcgccttcgccgccgccgccgccgactacttctccggcgtgatgtggtggtgggtgatcgcgatgcggacggtggtggtggcggcggcctctcctgcggatttaatagaggtgaggaggggaagagaccttgacctaaccctagaggaaaacgggccgtgtatatggaaagtgggctcgtgtattgatattaatgggccttgatgggccggcccattgctattgctacatcgagaagggcgcgcacaa

SEQ ID NO: 64595 - DNA, 2473 bp, Oryza sativa
ttctagcaatcatccctaataactaactgatgaatcaaggaaaaactaacgatagagaaaagcaagagaggccaatttctgacctcattttctttgcatgacttcttgtctgaccagcaagtctcatctatgagcctgtctcgaggcaagctcgggttaaagcaaacagcacagatggatgagaccacgacgagtttctgaacgctcgcagcagagcaagcctcgagcacatttctggtgcctttcacagcaggagccagcatctccttctgaacaatcgtgtttagcaaacataggatcagcagaagaactgcagattgcagagaagtgtgtgtgtaaatggagtatttacctccggatcgaccgtcttgtgttccggcacgggagtggccggatggaagaccccctcgcagccggcgaacgccgccgtcagcgagccgccgtcgagcacgtcggccttgaacaggcgcaggttctccggagcgttctccagctgcttcagaaacgcgttcttgggatcatctgaaaccaggaaaaggataaagaaacccacatacaagaagatgcagcacaagaggatactaggaaagaacagaaaaaataagaactcaagaagagacctgggtcgcggagggtggcgtggacggcgtagccacgggagaggaggagcttgacgagccacgagccggtgaacccgccggcgccggtcacgcacacggggcgccgcggcggcggaggcggaggcgtcatctccggttgccaccacctccgtatccactggaccactgctgcaagcctgcaactgtgcttcgatgtgtccattaagagcaagtttaatggtacagccaagtatgaatctaaatcaggctatattcaatttaatagtcaatttatacaataattatcaataaatatattctacataattaatgtctggtcccacctatcatacactcatgtatattagagtccgtgctgcagctggctataaatttgttggccgctactcttatctctcctcttttacctcctttatagccggcttatagtttgttattgtacctgctctaagcacttgtttaatcagcagactgcttttcccccacctttccgacgatgttcctcgtgttcagcacgtactttttttaacggttaaatgatgtattttttaaaaaatgtttatatgcgaaaattgctttaaaaaatcatattaatttatttttttaaaaaaataataaattaatcataaaaaaaattgtgtcgcttcattttgcgtgggtagaaaatgagttcccaacctcacctcccgaacatagccaaaactcgcgcgtagccgccacgacgagcatattactaagagcaagtttaataggatagccaaccactggctccaaattatctatagccaatttaatagccaatttatataatagttgcctataaacatatactatacaactaatacatgtttccacatatcagagcaagtttaatagtatagcccactactagatccaattcatttatagccaatctaataatcaattcatacaatagttgcttactatactattaatatatggtcccaccagtcatacacatattgcgtcttagagtccgcgctacagctggctacagatctgtagcccgctgctcttctctctcatctttttatctcattaaaatatgtttacagctggctaatagtctgctattgtacctgctctcatacacatgtatctttgagttcgtgctgcagctggctacaaatctgtagcatgttgctcctctctttcctcttatatctcctcaaaatatgtaactgacttataggctgctattgtacttactctaattgtacttgctctaagagtgagtacaataaggtgatataagcgggctatacaagttgccacattaaatttgtgcttgtgtggaagagagatgagaggagagaagtgggctatagatttgtagccagctatgtgaaagaggtgggtggattatacattaatgatttactccctccatctacaaaagttacacctatttcacattctagtttttccaaataagttgttcctatttgtagtctttatgcattaaagacttaaatgaagagataaattaaatgttttattagaacccaagaagtcatctaaatactcattggttgcatgcttgcattcactacttgattttgtaacatccaaggtgatttaattttttcttggtcttggtgtcgaaagtaatatgtgtaacttttgtggatggagggagtagtatgtttctacagctaactattgtatgagcgagttattaaattgactatagatgatgttttaaattttggagctagtagagggctatattattaaacttgatctaataattgaagggcggctggtagaagggcggctggtagtgtgctgagtgctgaacaaatcttatattctaatgctgacagtgcttg

SEQ ID NO: 64596 - DNA, 689 bp, Oryza sativa
tcaaaatgtataaaagttcagaggcatactaacaagaattatgtcaaaattatgctaacttcagcctaaacctgacataaatataacatgaaaatcatgtcaaaattataaaagtatgaacgggtacctggaaagacaatatccttttggtccaaaggtcattcttacatggtctgcattgttacacaatcgcatcataaacaaagtgcaacgtggctaaaaaaatgcacctatttaagtgtagaagaattgaatttcagaattgcacaaattaagattatgctagtaacaatagtaattcaaacttaccagcatcgttcttaaccatataagacgagtcataggccctgcactcatgaagatctccctattctgcgcgtccttgaatactccaaaagatttgaccttttcttcatttgagagctcctccatcgattccacaacagtgatgcagttccttattgagcaatcatcaaccttgcttgcctcctccctcttctttgcttcctcctcctcagattgtctttttctcatctccaagtaactttccatcatatcaacaacatcattcctcttattcctcttcggtgtcttttctactctctctctctctcagtagatttggtcttcttgacattcttttctccattagctcttgaggtgatagtaatatggcttccctgattttc

SEQ ID NO: 64597 - DNA, 11804 bp, Oryza sativa
ctaatctactggctctggcagttgcctgaaagattttcagcggatggccatcgatgatatcatgccgtcatctatagaaaacttgagtacgtaccggagatggatcttgaacactattcaattaattagatctttgagcttaaaattatttggaacatgatatgacctttagaggagaggtgaggtcgtggggagagagcttgagatgaatggactaggtgagttcctatattcctttaatagatttcaatagtgatggtgaacagtaaatccgtcgataccatgtgggttccccaaacagtatggtagatgaacttttgttttctcaattcaaagccatcagtttttaggtgaagtacgaaatgatggtaaacatgattcggagattttataatggaaatgattttgatttaatttttgaggctttatttttttatagaagcacaatacaaatgcagacgctcacaacgagtgtatacttatccctacgaatacattcacatacaccctacccctataaatattttcgaaacaccggatccctatgaaattctcttttctaaaattccgttgcaatgctagtgtgctgaaacctgaaatggtcggaggtaggattacacatggaccatggggcagcaacacatgctaatgacagcaatcttaaagctgcggtcactcacctagttagctggtggcctgacctgtactgtacatatctagcctccccccctgcaggtggtgccaaactgccaaatccagcctggtggcatcatgtatctattcaagtgctctcgtgctcatggatcttgggagataatagcctctgatcgacaagtatagcagcattgctgtacctggatttgtttgttaaggtaggtcgtcattgccatcctgttgaggagtgaagtgccgtcaggagttaagccagaaagttagctttgaatggttgagggctaatggaccggctaattagttgtggctaatatgacaaaaaaagtttagtgttgttcgtactcagttataattgatgctctattaaagactactctagctttggatcggcgtgtaaaccatcgacctaaatggatagcgacatatagaatcaaagtaaggtaaatatttttcagaacaacgtgtagcaaagtatgggcatttaattagtatattataactgtctacaagttatatttagtttaggtttctttttaaactatgcatataagttattggtggacaaagttttaaaactttaataaaatcttattctaaatatcaaatatttattttcagagggagtatataagttaagatagggattaaaaagaattatctatttgttttgaggacttcaaattgccatgttatttcaaaaaaggaaaagcaatattgttatattgaaagttttcgcatgaaacataccgtttagcagtttaaaaagtgtgccacaaaaactttatcttcatccaactctttgataaatgaacgggaccatagtctcgtgcaattattacgcaagaaatccgactagagctatgtttagttcgtgtgacaaatttttttaagtatacaaacacacatttgaagtattaaatgtagactaataacaaaataaattatagattccgcctgtaaactgggagacgaatttattaagcctaattaattcgtcattagtaaatgtttactgtaatattacattgtcaaatcatggcgtaattagactcaaaagattcgtctcgcaatttatatgtaaactgtgcaattggttttttttccacatttaatggtacctgcatgtgtccaaacatttgatgtgacgaaatttttgaaagtttgaagggaagtaaacactgcgtacctatactagttgctgagtatgaattgaatgcccctgccatgtgtgcagtgacgaaaaatattccattatctaaaaatatgtgcagtgacgaaattgaggtaacaaatttcaaatgaaattgaagcttagctctgaatctgatggacggccgcttgggcgtagcctcttagcaaatgctgggtatgggccaaatttttgtgcttcgtctggcagtttgggctggggctgttgggccgttgtgctccccaggcttctctggtcagattttctttttgaaagcacaatgcaaaagcggacactcatactgacgtgcgaatgctcacctcatatgagcgcatacaatacatcccatccctaaaagattagattaacatattttgagattgataaagtcatctcagatactttgttttcgagaggcacatagcctaccactgattgaaaatacaagcgctagcgtgagtgggagaccccctacgtttagattgctctttctttagattatattcctcctcctattttcttaaaaatgaaatgtcattaagtttttcttcaatcatttaattcaacctcctatgatttatttggtgtctccaaattttattttcaggttttaaccttctacctataacattgtagttggtgccacaccatgacatccaaattccaaaggcagaccacggcggatgcgatggccaccgaagaagaagagggaacaatcggatcgatgatggcatggagtacatggaactcaagaagtacatcatgatgttcaaaggcataaacccttattttcatatttatgtaaggatatattcaaaaataattttactataaccatagggcaaaagatatcttaaacctcgtacgaacacagtccggttaaccgtacctaagcagccgcctgggctcgacgacgaaaattcaattaaattttaatattgatgagtaaattaatggtgaaatttctataataaatagtactagttagttatattgaagtttcccgggctcaaaatttttttttggctccgccactgcatttagatatgtcttaatggctagataagttttgatttttttatatacttatgtaatttgtaattttttatattgctagaaaaaataccggtgcgttgtaatgagatgaaggctattttaatcgtattgttgttagatttttttctaaagtatatatagaatttttattttgatcgtattgatatctaattcggaatccttatttggatgatgatcatatcatgcacgttgttttcttatggtatggagagaattataaatatattaggaatccgactttcgcctcaagttagcatgcgaggtttttaaaaggatttcttatacgattccttatgtatttttaaaagcgaacgaacttaaaaacaaattcaaatacggatgacgtatcaaagtattggcgaaaacatcttttaatttttataatagtagagatatagatttatatttatacactgtagagtctcccctacagttcactttttttttaaaaaaaaaagcaaacaaacggagacatcgctgatgatatacgacgtggattcgacgtcgtcgttctttaaactggatgtcacggtgtccggcgaccggcggcccgggggtggtgtgatacagtcttatgcaatcgcgcaggaaaaatctgataactcttactagtaggctattagcgagtatgattaaggccgggtttagggtttagttcccaacttttttttcaaactttcaactttttcatcgcatcaaaattttcctacagatataaactttcaacttttcttttcaaactttcaattttagtcaaacttccaattttagcatggaaataaacacatctaaattgagacagctccacccaactccacttccagttttggtggagctgaaactgtttggctgaactccagctccaggaggggtggagctggagctggagctgtgccaaacaggccctgagtaccttttgtgcagtactgcagtgacgaaatgatagtaacaaaatacatgtatccaatatcaatttcatcattttaaaatattgcacagtcaaaatattatgtgcgaagtgagcacaacttaagtgattaggttccttgtgctataaccagtttatctaggtttacgtactagacttgacacggatactcgaatctactgctaattattattttagtgatagataatgtacccgttgaaagtgaggtgcctcaatttcaaaatatacaagtctagtgttttaaaggtgatcgtactcattgattgatataaggtgtacgtgtgtccattgatagggtgaggtaaatgtacgtgtattataagcgtatgtgtttgtatcatgttttattactgcatgcccacacaaggaggaaaaaatgatcaggccccagaaatcatcgatgagtttagagtctattactctcttgccgagggcttactctgattctgatggatggccgcctgggcggctgggccgggtgctgatagtcgagcagggatgcgggaggccagccggtcgtggaaaatgttgttgggtatatggtccaaatttctgtgcttcttctgttagtttaatttggagatgattgctcagcttgggctgaggctgttgggccgatttgctcccgggcttctatggtcaggttatctagaaaaacaagcgtactcacccttataaattcacacatttttattctactactataagcatcttcgagacactaaaccgatatattctaaaattgatggagtcaccgcctcactgtcgagggagataaaaaaataattagttataaatacgaacacccatactgagtcaaaaatctatacttagttatgttctaccacaggaatttaaccagctaagctataagttactaaacattcctcctatttgatacaaggaaaaagaaatgccgacattgtttttctcttttaaacctcttatatatttttttttcaaaaagatgtctccaaattttaatttttagatttaaactttctaactacaacactaggactgttaggggtgataaaattcccattcggtaggggtaggtccaaaatttgacatgcgcacccatcaaggtgggccgtgggtcccagagaaaatatagtgctgggatggagagctgttcctactaacgggtcacccacgggtttcagcggaatgtggcctacctaacttggctaccaagtttatataaaaagacccacctcgtccttcaacccagcaggatctaggtataaaaaaggagggtattaacgcaaaaccctagacacctcctagtcatcaatgcctatgtagtgagtcgcatagctagcatagtcctacactgtcgcttaggcacactgtctccctgactgatctggccgttggcacatcgttcccttctctctggccacctcccgacactgtatcttctctccctctcactgctagtgccccacaccgttcttcgctgcccacatcgtcgcccgtagttgttttatttctcccgttttcttcttccagaggagggcggcatgggaggaaataagggattggggccagagcttctgtttttcaacccaatctcaatttgccctgttgccaaccctagtgatgagatatagaaagatatttctatatcacggtgggaacaaaagttttatatgcaaagaaaagttttccctgaaactgtaatttaagtattaatgaaaagatatattatatctttgcaccatagaatggacaaaaattgctcacagagatcactatttatgttaagggtgaagtatgacgctggcatatccctaggctacccccatgcatcatcatcatcatcatcatcctcctctttgacccgctaaacgtcaagacatctcttgctgctcctctacgactatccaagtatccatcacacgtctctcctttccacctcgtcaaaaccgtcgacacgcgcgcgaccattcgatcactccacgacgacgacatccatccacagccagagcgcggcggatgcgatggccaccgaagaagaaaacttcgtcgatgatgatgccgacgtgaagtcgatgtcgtcctcgtcgtcgttgtcgtcgctctttgacctcgacctcactgcgttcggcgaccggtgggtggtgtcgggaggaaaggaggaggttgattttgctggtgccgatgatggtggtggcggggcggtgaacgtggcgtccgacgaggacgaagatggtcgcggcggcggcgtggcggcggcgctcgggccggctgctaggctccgcgagcttcttcttcgcaagctgaggaagccgaaggcggccggcggcggtggcgcggtgtcgccggagggacagagcggccgattcttggcgaaggtccgggcggactcgatgccgcggctggaggcgcgcgcgatcgccggcggcgaggaggagcggcgcgccgccactactactaacccgaaggaggccgcacggaagtacctgaacaagatcgcgacgagcctcgcgcgccgccgcggaggtccagacccagcagcaatggtggtcgctgccccgacgacgaccggcaagacgaagacgagccgctcctccatggcggcgccgccgccgccgcgccgcggtatagacggctcggcccagcacttgcaggacggcatcgagagcgccattgcgcactgcaagctctcgctgcgcacggcgacggcagagccgagctaaggaggagtgcaaatgttgagtcgttgatgcatgcatgaagcatgatgatgtgttcctcgcagtgagatttgataaaggctttgttcttggcatagacgagttgccaaataatcgcattcgtttttcattaaatccctttgagatgatcgcgtctaaatttttagataatagaatttattccgacctttgcttcaaataagctatagacaaataatcgcgtctaattattgtttaattagtcttatgccaattggttttttttatccttaaggggatttttcttaagaaccgatactaaatatgtcattttcattgagtatagtaagggaaaaatttgcatattagaaaaagaaacaacaataaaacaggatgagagagctaaggtattagctttgggaggtgctttgctgctcctaagggcatgtacaacggtttttattagtggtctctatattactatgcaagtaaatttgataacatggaagaaagataaaagagaaagtacaaacatggttgttatgcatgacaatggtttagagtcaactcttagcatttattagatcaaattttgttacatgatgttgaaagaaaggaaagaagagtaagaaaaaaaaatattttgatacattaatggtagagaccatattgtctctaactgttctatgacattagtctctagatagtatagagcttatacctatctctatctttgtacatggccagtatttggcctccttaatttttgggcccaaagctattgtggataattcccttttctagaacactctagttactgcttctagatttcctacactgttaataggatgagcgtgtagttcccctttatatggcaggcctgggctagggctcgtggctagtgttgttcaccatttatggactgtcgtctccttcatcttgatggcttaagttgttctcgtactgtccatgcaaataatatatccaagattctcctcatgtatttgcatttcattaggagatggaaggatgttttgtgggtgtgtcaagaaagcagataaatggtgtagttatttggttagtcgtagactacaagtctgccgaacatctacactttgttttgcaagaatatctaggtaaagagcttgcattttgttagagcccaaggattccaaatcatcatctcataatttgtgttgttagatctagctatgtaaaggggtggaggcaggcctagggcagctagggcttgagccctaggtctgcctccaaaatgaaatctaacaccttattaggtgagccttatcttagccctagtctttaccaatttttggctctagcacttcacgtgtatactccatggcttgtgtgctttcaagtaatttcatttcctttattggcagtgagatgcacccctatattgtattctatagggtcactagttggcctaggagttcgaccaatgatgctcgcatcaggtgagaaattgaggtcttgtatctatgtgttactttcgatggattggctgagagtcttatttttctttttggagattgcgtaaatttgtggtgttacatccttaaggtgtcttccgtgtatccaaattgagtcacacaagtgtattgtctcccctttgcctattgttattgtcgtagttgccaaaagtaggaatttatctatattttcgcatgggtttctatccctacccatatcttctctagcaccttctattcatgacaaagtcatctcacccacaacacccttgcaaacgtttccaggttgagcactcactactacaaaaggcatctttggtgacagccaagaagctattttgagatggctgggtgctctgccatcaactaaagctcacaagcagtaacagaactgcttgcgcgtaccgcttatgaggaccgctagcgaaaattgatttttacaagtgcatcccttaagcgaaccacctgtgaagatgttctctggtgtaaaaaaaatcacattcaaaccaattcagatgcaattcgacaatcacaaattcaagcatcaatttggatatgctggcctcaatgcaattccagatttccaaaatgacatatgagaaaagatagattgctaagaagtacctgatcccgtagaaaatagaaatcctcagatatgttctaatcccaacttccattgctgcctctccagccgccaagatccaaaacattcacaccgcaacaagaacaacagcggctgcctccaccaccagcaccaccacagcgtgctcaccattgaaacaagccacgtctcactgtcggctttgagcttcacaacagtggatcggcagcgaacgaagagcttcacagtggcagctcgacatagatgaaggactccacggtggtggctcgacgaggaggaaggaggctatctgactccgccacatctggactgaagaggaaggaggccaagggtcggcctccgccacggcagcggctagacgaggaggaaggaggaaggagacctgcctccttcagattttgagggcacggggaggcccacaccgatcccacggccatatctgctgcacgcatcgctatcaccgtggctgccatggccaccgagagggaggggaggggagggggggggggtgagagggtgtgaggaggataggatgaggagatggagtctatctgtgtacggtggagataagatggagtccatgccatccgtgtgaaattttagtataatgaaaaaaaatttgcagtcggtgctccttagcagcttccagctattttcgatggttacttaagaggtccgcttgcaaaacagtcagtgaaaattgattttcactgatggatggtgaccgcaatccctctcaagtatttttacaagcgtgtattcactaaactcgccagtaaaaataaaatggtgatgctatgaaaattgttttcgtagtagtgctcctagctcactatgtgccattggcatgcttgtttttctttcccagttggtcttgtattttccacccgtgagttctcccgatcccacccgtagcagccatttttctttcccacattgtcaggaacctccagaaattccttggagacttttaacgccataaggaggtagacaggctgcaacgttaggaccaatccgaccaacgttgttcgtttcgctattcccatgtttcttccgtaccagtaggctatacatccaactggtttatcaaaaaggggttgaaggccgcgttgtatagtcttgtgatggctagtggtataagttgaggtattttatagggaatgatgccctttgtcgagggatggtccgcttgattaatttatgtattcaaatagtcatgaattttttgttgacaagattggtaaatataagatatatcactccacgaacatttaagtttaaataccacctatttaagttgaaacaaacagattgtgcctactacatttttttttctttctttatataattttatgtgttgaattgtttgcatagtaataatttgtattgattgaaaaaaaattcaaatttgtatagattcaatttaaatgtgtagtaataagttgtgaagtaatatatcatagtatagatctatcttgtaatttttctaatgacattttacctttttagatgttatgaaaaacgaggcaccatgccttaagattgaatttagtttcccgttttgttgggctgattgatccatgccacccaatagaatagagcgacatagagatgggccatttggcatggtacatggattcgcgtccttttctgcaagatctctaacccaacccaactacagtactaagtagtttttccttgtttgcagccggtagattggcctaatgcaactctgcaagcccatttcacttcccacagaccacatgccgaaatgctggcaagctgcaaaatttccttcaattttgtaaataacgagattaccgggagcaatgcaagcaatggtggtgacaaattaggggttatgcctccgttaaaactgggcttcgtcaaaatatcatctcgtaaatatgatttctcaaaataccaaacccaactgatgtgttaacacttataaatgccttttcatcacttactaattgatttacttacttttgtcatcttttacaacatgaaccgaccgatatgctcttcattgggctatgttagagagtgcaagttgcaaactaattccccatgcatacaagacgaactaattcctcatgtatgcaaaacgaaactgctcattagcacataattagttaagtattagcttgaaaaatattaaaaatagattagacatgattttgtaaagtaatttttgtaactagaaacataatagtacatgagtttgttgacatcctccattggggaaaataacagattatccttaagtaggacagctagcagagtaacagatgagtgttgttgtggtaaaagtgttctaactcttggagtacttactgttgctgtagtcctaacttttcttgatagataatcatccattttgtttgcctctccttttatccctcttatatatgttggttacttctctttgtgttaaaatctgcaatggaagagaagaggccgaagactccagtgtagtgcataatgtgcaaagtgttgttgtttgtagcatggagagcagggattggttatctgaaatgaagattggatgttgtatttgaagtctggaacacaccttgtatgctactatgctagtattatacctgcaagttcagcttagagagaggaggtatattttgaagaggtagcttgaacagggccgtcccatgaattttggaggccccgtgcaaaaatattatccaaatactaaacataatctataaaataaaataataaaaactttggctacttgcagcacaaagagagaaatcctctctcattttacgcgcacatatttcccgcaatgctatagatggtgcgttttttatgaaatagatattgaaaagttgctttaaaaataatattaatccattttcaagtttgaaattattaatactcaattaattatacactaatggccgacgtatcttgtcaatttctcttttccatcctctcaaacgcacacccttataccccatgatatattttgcagcaatataaattggagtggaacaaaaagtgtatatgcgcgtaatcttcaattgaaaagcataattcttttattgtttcccgaaataaaattttcaatgatttgcagaagatggttgaaacttgaaag

SEQ ID NO: 64598 - DNA, 14037 bp, Oryza sativa
tcaccccgtcgtaacttgatgttccatcctcgcaggacctcgtttgccttcgagtgcccctagcttcggagcagtgcgacctacaacaccggtttcgcacggtacagttcagcccagatattagttcatttttgtttcagcttttgcacgaatatgtcactatgttttaactgcacgtttcctcatcgcaggacctcgtctgccttcgagcacgttcgcaggcacgaccggcgcttccgcgagctccgcaggggcgttcgccacctcttcgggcgcgttcgccagctcttcctctcacggagcgtcgatccctcgcccacacggtactttactttttattaccactgttaaatacttgtacgaaactgatggtccttgtccagcaggatttgcagccgggatcttcggtactggggcctcttcgtctcacgccggtaggactggtcctactagccagttctacgatgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaaattgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgattcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatagaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttataaaaaaatttagagcacagtataaaatcgccctcccccagggcggcaagggggccgcctgcaaaattccatgcccccctcaccgcccatttgcaggcggcccccccacagtacaaaatcgctctagcggagggcggcaagggggccgcctgcaaaattccatgcccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctcgccctcccagagggcggtaggcgactacttccgtcaatttttaaaatggaaaattatttttgtaaaacttttaataaaaaaaattataaataaaaaaattcgaggtaggcagccccaagaggggtatttttcatccaaacaaacgccgtcagtgggtgagcgaaactagcaagaaacgcgtgcgtaccgacaatgcaagaaaaaaatatctctttgatacggcaaaaatctgtatacgatcatgcacgacaatgtatacataacaccaaactcggtatgccatcattttgatttacagagatcggtacgtaatcatgcaacattggttttggaactccacatgcatacgcgaatgtgcatgtgattcttgatggccaatccaaagaaactaccaaagctgcacttggtcctgattaactgaagaagttaaaaggcttgttacctgtcaaaaataaaagaataataaaacgataaataataaatatatacttcctccgtttcgcaatgttaagtcattctagcattttccacatttatattgatgttaatgaatatatatgtctagattcattaacatcaatataaatgtgagaaatactagaatgacttacattgcgaaacggagggagtatcttataataatctcatttgcaggccactggtaaagttccatttgatattatagcgacaacaaaggattatagtgttaaaaggtgcggaatggcaaaacgaaagatgcacattgagttttacttttgagagtagccagctatatttccgaatatgtggtctgctatcatatacccatataggtgacaacaaactgtgaccgcaaaattttgcatatacagttaaaaacaacctttcaaaatgtcattagcaagagttattggttatgaacttacaggagcaagttatatggatactattcttctctaccataatacatggaagatataaattgactgaaatcgatatggagtaaaagcttgctgacagcgaacttcaattgacttatgctgcgccaaggaaactttcaaattgtactaattactaaacataagtggaagctagcaaaaccttgtgtaaactttgaaatgttcatgttttatttgggggaaaatatgcacatcagtacatgacatgcatgatatcatgatggaagacatggagaaaaatgagaaggcatatggtcagcaggcggtgaaagtgcaagaattacaaagagagtaaatgcttcaagcttgagattgcagacatatagagtttttcttttaaaaaaggttcataaagcaaccattaccagcaaaggattgctcctactgttgcagaccatgacttaaaaagttgaaataaagcatgaacttcctagtcttaatctatgtgaacctaaaatctcgcattataaggtaaatctgagatcctaaaagtgaactttctggctggaatttgtaagattaaggtggacaatgaagtaatgaaccatcaatgtagatgacactgtaggggcacaactacagtcattagaagagcagattttgctgaacatatataatgcatgaaacaatcacagaacattgattgtcataagtaagaagcactgcatatgacaaaagtaataatactgcagaaattagcacttgtatgaccaagcagtatgagcttcatgtgcccatgcagaagtaactttaatatggtacgctgggatactcacatcttcactaagaattgggaagccggcatttctgtaatttcagcttgttcactgttgccatttgaacctcttaaggtcactgagagcatcttagtatggttgaaaatacggaccaatcattttcatgcatagagaatgaatgagcctttgttttgatgcttgaaagccataatgtctgtttagaagcaaatcacagtgccctggcctggaactccttccgatcacaatatttctagttgcataattgatcctagaaagaaggagaaaaaggcatcatcacaaggtcaatcaaacttagggaaaattctccaagccctattactattttgtatagccacaaaccattcagtaataaatatcattgacagcatgctggattaagtctgatggcacttcttaattagtgtgactttttgtacatagaactgcgagatgatttatattaacaatatgaggtatacgactggaatattgattcaaacagcagactgagcgtagtgtatttacatcaaaggatcagttacataccttgaaagttaaaattgtcactcatcccttcatagtgttaggaaacaggaacatcaagaaaataaacaatgacgaactgaccattcctgataggtttacaatgaggcaaaaattagcagttgcttaattgctttaggcgatgtcatattagctcatgtaagtacaaaagagctgcattccagaaacacactgcaacaaacaaaaaggcatacgtacatgtgcttgtgtttcaaaatggtactcttaagacaccaactcagacgcaagttctgtttcccaaatcaaaactcttagaaaacgagcataaagaaaaggatcaatctagcatttgccgtgcccccaaatcaaataaaccctagaacataatctccaacaaatactgcaaagaaacctgccatatcaaccatatagcttgagctgttcgcctcccgcggccatacagcctactgcgatcctttgtcttcagccttcagtggcaacgtccgcatcgttgagcaggtgccctaatgggagatgatgaatgagataggggagaaagagaagtgatataatggctgagcaccccatctcgcctaaagttgcaacctcgcactcgccttgaccacgcctccacaatagctactaatgctgccactgacagtggatcatgcatgaaccatgttggcaagttcaaatgccccaaactgcttagagatggggttttttgaacctttgatccatttacatgggtattttgaaaccaggtgcttagacactggggtttatgaaacacaagcatatgtacatggggttctctgatatttactctttatttttcaatggaatggatgggcacaagatttacttctgcatcagtgagatcctaatcagtagtgagtagtaagtatgcccaaatctaatatccgtgaaatacagcagaagtaaattagcaagcagcagcatcagtaacagcagccatgaacagttagcagtagccaggaggagaagcatggctgcgaggaacggctcccaaactcacctgagaagagaacggagaggagattcaaattgagcgagcgaggagggcgcaaataaaaaaacccagccatgattgtggcgccgtgctccttctccttcgttcttctccccgacctccgccatccccacaccccactgctccgaccaccatcttctaccggatctggcggcccctgtgcaagaacctgcatcgagtggggagaagagggagagaagaagtggcctgtggcggcggcggcttacgtccatcgcggaagaggcgacgatggcggcggcggtggctggaggaggcgaggatgcggcggcggcgggcgcgaggctgcgggagaggccagcgagggggctatggcttggtgcgggtgagcgaaatctgcgccgtccgttcccgatccgacgatccacgggtgcgaaagggccgccacagcgtgaaacgtggacggtcagatcggccctatagagagatcgaacggacattgttattgggaaccagtatgtaattaacgaaaacgcaagggttctgctgcaaaaattgctgacgcggcgcgattaatttacagcgatcgcattagagtggttaatattttctctcttctttttttttttcacccggcctctctccctcgccttcctctcctcctcgccttcctcccattcctctcgattccggcgtccaatagccaggcgcgccggccgccggtacccgcggcggcggcggcggcggtgcctccccttccttcgcggcgtcttcctcctttgcgccggcatccttcgtcgcgcacgcagggaaatcaacgcctctcccgggtggttagtaatctttttctcgtcttcctcccaagcctcttgctaggttagggtttaatcccatgttgtttcagattgcgccgagaggggtagggagaagggagggagatccggccaccctgcaaggcatcgtcaccgccgtgatctggtaagaatctctctcgcctcgctgcaatggatccttagttttggcctgttgttcaagcagagctggtcttgtttgcgttcttggtttttttttttttttgggtgagggtgggggtggggggcggaggaggtgggggttggggttggcggtggcgcggcgggaaggtgggggttcaaattggtgtcactttcttgatcatcgagttgtcgtgtggcatcgctttaaaaagtttcttgtattttaattctcttgttcaaaaaatctgctagtcatgcgattaaccatctgtacatggtacagtaataaccaccgatgaaaataacatcaaatgaggagaaatctctgctttagcagttacttgtcactactgatgaagataatatcaattaagaaattatctgctttagcagtttagttagtactcctagtactactagtataaatatgaatttcagaattgcagtaatatgaatagttcaaatgtatcatgtttctttctaggaaacaagaaccatgtgttacctgtttgcacttcttgctttactgtcttcattagcacagtctatgattgccccaatatacaagtgagttggagtcactttgccttcttttttttcctcaaacaaaaatgcctctgtcaaaatcaggaaaatatgaaaccatgactacaaaatcacttggctgactaatttttctgtggttattttcttttcaaaaggtactacagaactgctctagtttgcttggattagctcccattttttttctgaacataacgttttgtctcttgtatcgaacaaatatctgagattgactttggttcattataaattgtcatacaacgacacttctgtacttatgatataagcaacgatcttttgtactttcaccaccattttacgatccaaacttaattaatcttttgtactttatcgtgctatacttaattgcaaggaaatcatagaatcttctattttggcatcctatgatgctttgataggtaattatgttgtcaactcactattcactgatggtctacaccaaaatcgctatatattttctgcaggaagcactatatacaactacatagtgaatctgaggccattgtttggtgcatgccttcatcggaagttctgccttttttttttaacttgagttgtatggactacttatgaacgtggaacttctctatccttttgtaataaaacactataattcagatggttggagtgtaatgcttgtgataaagcaaaatgcttttactcttatttggagtttacagactgagttgcctgtaaatttgtaaaaaataggttggaaaattggtatgaaaaatctgactatctgagagtactagatgatgcttatttgtttttattaacctgacatttctgctatgcctgattttggtgtgcttctgtatgtggaactcctgcaatgcgttcgcaggtcactctcttttaaattttgattactaccaaaatgctatgagtaaaatgtccattctttgctttttcccatgcttatttcaatatatgttattcacttgactcaaccaaatgttagactattgtataatattagaaaaatatgagggggctaattatagaacatgcaaaattagtagttatgggttggtggtcagttggtggcagaaccactaccaccactatttctgttatagtaggattattttttaatttttgtaatttgctggttcaggaagaagcaatccctgctattcttgtgatattcagtttgtatccaagcaaaccaattgaatggaggggattgggtgggtgggaggggatcaacctaatcacccccatgggtgaattttccctgagaaattcctatcagataactgaacaaagcctgagagaggaaaggaagagaagggagaagccattttcaccaactgctctagtgcttgatagagtctgtagaccaactgctccagtgctcagtagagtctgtagaggcaaacattcagatgaatactagagataaaatatatattcatatggagatatctaataaaacaactgaatttcagaattgcagtaatatgaatagttgaaatgtatcatgttcctttctaggaaacgagaaccatgtgttacctatttgcacttctttctttactgtcttcaactcttcattagcagcggctatgactgtagacttagtgtcttaattaagtatatacctgaaattatatgcatttgagagagttcagtacttgagttggttaagttctactcttgtcctgaatgaattaaatatttgactagtttcttctagtttccatgtaccagttgctactctaatgtctttgggattgactagttatggtcactaatcagcaattggtagtagtaacaatcagccggcttgcccaaatatacaagtgagttggggtcactttgccccttttttttttccacaaacaaaaatgtcactgtcaaaatcaggacaaaaatgaaaccatgactacacaatcacttggttgactaatttttctgtggtgatatatatattttttttcaaaaggtattacaaaacttctctattttgcttggattagctccttttttttttctggacataacgtttttgtctcttatatcgaacaaacctctgagattgactttggttcattataaatggtcatacaacgacacttctgtacttattatgatataagcaatgatcttttgtactttcaccaccatttaggagccaatcttaattaatccttttgtactttatcacactaatatacttacttgcaaggaaatcacagaatatgctattttggcatcctgtgatgctttgatagctaattatgatcactatattatgttgtcaactcacagttcactgatggtctacaccaaaatcactatatattttctgcaggaagctctatggccattgtttggtgcatgccttcatcgaaagttttgcctgatttttttttagaaacttgagttgtatggactacttatgagcttggaacttctctatccttttgtaatacaacactataattaagatggttggaggataatgcttgtaataaagctaaatgcttgtactcttatttggagtttacagactgaattgcttgtaaatttgtaaaaaaataggttggaatttggtatgaaaaatatgacagtactagacgatgcttatttgtttttattaacctgacatttctactatgtctgattttggtgtgctttctgtttgtggaactcctgcaatgcgttctcaggtcactctctttttttttttggattattctgttaaactttgtaatttgctgtcattcctatgttcaggaagaagcaatccctgctattcttctgatactaacctcacgctttactgcgggagtttagtacgataacaataaatagaaataatatgtaagacagctagattgacacaagtttatgatatacgataattcaaatagtatatggaatgatgattcaatgtaatagtaaggtgatgtagttttatgagagaagaaaagaaaagagataatttagaccataggttaattatcgaatggctaaaaacaattgagatgatatggctcaatgagagaatttggattatagattaatcatctaagggttaaaaataattgagatatagcttaataagagaagagagaaataacattaactaagtgggagatactgaaatttatgtgaattatgtgagatgatttaacatgtttgtattttaaagctctaaagtttaataaatatatagttgtataaatatagcatacatgatgattaagatgtaataattgttagtagatgatgatataacatctttgtattggccggttaagaaggtgggtttggctcaagaggaggcaaccggtattgctcggttgaatgggcgacaagggcaatgattacgacgatgagtatgaattgattagtaaaaattgtgattccaactaatcctttggatatatgccctggtacactatatatagagatcaaggctgagtgattcacgtctgataaaatcagtcccaattctttgagcatgctctatccccttctcgctcctcttattgtgacttttctcctaccttactctgagttttatcgtaaattgatgtaatcgatgcttgtttctgtcgacatcctctttcctgcgagccaaagatagcggtaaagattaaataacatgccattgtttgtttatcatattgctcatttcgttttaaaagaattaaaaaccattccgtgttgacctacatctctttttttcgtatttggtgattactttttttttcttaaaattgctttgattgattattgttatgtaaacttcctcttcatgagaaccgaagatgggtaaagattgaagaatctttgttgtttgacatttgcttgtttatcttggtttttaagcattagaatcccttatgtgtagatgttttttttaaagaaattgctttgatagttgattcttgtttatgttgcagcccgccgatattcgcttggaattgtttcttcatcgtcctgcacgtgtcacttgtgcagttgtaaggcgaacaaactatcttacacctccaacctgccaggtagaggtaagaacaagtccatcttgagaaataatttgttttttggttcttttaatcatggcagagttcttgtgctgcagacagcaccattttttgttgaattggttgaattttttttctctgttggtatctagtttgatctaaggcagatgtcttcttgtttattccagggaaattagtaaatcacatcacgatgtgggaattactattttgggatctgctaggcagggaaaaaaagaaaatgaaaaagagaagagaactactcaagatcagaggcaacctaactgctgaggtatgtttcattcttatacaatgccctcgaaactttgcttttagtagagagtagtaacaattctgaatttacacgagtcataaatgtacgggtaaacctgctcttgtaaatttatgctaagagaaaaatgctattatgccatttatgatgctacatcaatcacattaacacaattagttctagttggtagtggtctgtgggccaacaggcaaaccacggtagatacatgtgcatggcagtggcacccctaaaacttaaagaaaatagtattgcgccgtggattatccatgtatgttactctctctattcccaattaatcattatataatttttataaggttattttcaaattatattcattccctagttattatttgtgcatgggagtgaatagacattagtgcatgcatccatgtacacaactctttacaaccaatattcaatgtctttgctttgttagtggctaggaaatagcgggatggtgcatgcataagtttgttataaatgtagtacgggagagttattgtttcttcttaatcctagtgcacttatatagtgtgatatcaattggaaacggagggagtatcaacatagggctgtaggaataggtcatttgacaaccatgctttggtggcggctcattttttttttctcttttctctatttgtttatagttcaatttattcttagcagtagttctaatgcattaatggtctgatttttggattatgatcccagttcaagactaatccagccgcacctaaaaaattaaaagaaaaagcccttttactctatttttggattatgatcccagttcaagactaatccagtagttctaatgcattaatggtctgatttttggagtatctattttcatgctaccagtgttcttccctaaggtttgacttacagaagactgcgaattaatgttgaatttctactgatgacatgctgcaaatgtaagggaaagtagttgtatatggagcttatgttaagtcgaagcggttatctattttttatgcagagaaccgatttcttgaggaaaatgcattcgcatgtgatttgtgatctacaagaggaaggccagagattggatttttatgttgaagaaaaagagcttataagtgaagtgagcgtgccagggtcagaaagcactctaaggataagcactgaagtttgcagagctgttcttttcaagataatcaaaaggttccaatccatgcactctgctggattcagtctaggtgggtttgaacacaaaattctgtttgtcacgtcagattttgaggtgaaaattggtggtattagtagagtgaaagatttcaccaagacaagaggatcgaaggattacaagagcatcggaaaaattgcccgggaagtgatattctcatcagtgacaaatttgccggttgatatcgagcaactacttgaccttttgaccgacaatcctatggagcaaacagcccttttgggcatgcactactctttattggacccattgactcaagtatctgagttcctttggtggcacaagcgcctcattcacctcaaagacataaatccagaaaagtttcaaagaatcatggaaaacatcccaactggtaacaattggatgagtcgggcggtggagaataagtacataagaaaggtttcactgggcattcctaagaggagaaagggattagtacataccaccgaggaagtgaagcctgaaacaacagcggcaagtcaaggtactggtattgagggagtaaaaccaaaaactgcagttggccaggataccaatattgaggacccaaaacctgaaactgcaacaccaaaatgcaagtactcggaagattcatgggggcagagtttgttgtgtaggaactcaatagaacacctggacagatgggcagcattgagaaggatcaaaaaaaagaaatcaggtggcaagataagaacggtaaaagttcaattcgaggaaatgggcagatgctatatcataatacaagcattctctaagttctttggagagttgcaaaaagccttggcagaagagaatgaactgccacagaagaagcagtgaagttttggtgtcgaaaaggtgatgttcactgtagcaatgatgttgtgcaaaaacgaggttccctggatacttgttagcagaagatgatgaggttcattgaaaatattaattgcattgaataagcaatgatgttccgttgatactgtgcttaacagaaaggtgatgaggttaattggaaatagtgcttaacagaaaggtgatgaggttaattggaaatagtagttgtattggtatattggctgagaaatgatgtagtgcaaaaatgaggttccgttgatacttgatactatgcttataagaagatgatgaggttcattggatatagcagttgtatagcagttgtattggatatacatcaacggttacgtgactactacttcttacactgaagagagaatgtgattgattgttgatacagccacgtcgtataggacaaccagaatcccagattacggtgtgtattgtgaacatgctctactcgtacaatacaaacacccacaccaatatttgatatattccatcactgccctggcaaacattctactgccgcattgtctctctctctctcttgccgccggcgggctcgcctccccctcgccgccgcctgctgtcagccgccggcccggggacggaaggagaggcggtgagtcctcgtgggctgccgccgccgctgccggatcaccggcaccggcacgcgggcgacccgatctgcggcacgacacgtcgttggccgcgggagttttggtgagcagctggcaccaatacgacgggaccaaacatctcttacaatttggggatctcgcgcgctgccccgatttgccttcaaaatgtttccctcttctcttcgtttctttctgtttctattttgtccctggtgttttaatgttttaataatctgattttctttgttgcgttgataccagttgaagatttctctggcctcacctaacaatttggacaaaaaaaaaaagagtgatcacattatctctaattccatagtgctggtgtggcagtacccttttgcaaacaaattcctttgccgcaatgtcaaagcttgccattctaggccgcaggtatgtttttattttctactacttcctccgtttcataacgtaagtcattctagcattt

SEQ ID NO: 64599 - DNA, 11921 bp, Oryza sativa
  unsure (1)..(11921): unsure at all n locations
atgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgtaagactgtaacgcacagaaagaaatgtacgattgcaaggtttgtctaagaggattacctaacaacaacagtcaattccttgtgtacctactaagaacattatttaacctgtatagttttttttttaataactgaagtcgccagaaacagttcctgatagttaataatttaaacaataatttcacaatacatagcaggggtggcaagcatagtatgactcatccaatatcaatgggcacaagatgcagttcgttatgtcaactaactgaaaatggaacatggttaaatttctcgtagttttgtttgcgaggactgcagtattaagataatatctgtaaactctagaactggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgatttttagcttggaaacaactttggaagtgatgtggtggcagaacacaccaatggaagagctatatctgcacaggctataaagaccatattgtttgtgctttgctgcactcaattggcttggcattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacagtgatcacaacgaaaagatgcaaatcttagcgtacattaccaccggtagcagcaacagcgagaacagtttcaagttcaaaaattaattgtatgagatgcatatatactacttcatacaataattttttaaactgatttttaggtgctctttaaaactgatattcaaaaccttgatcagaaccaaatggctcgttagaacataatgccctatttgaatgggagagactgatttcacagaaatataagtgcctcctattcaagcagcccctaagtctatagggtgggtggggagaggagcaacgatgttggttagatggcttaattgctgttcccggattttttttttaaaaaaaaagacacgttgaacgaatactctcgacctcctttttctactggagtactttgagtcaccaacatatagatccttcttacttccaaaatataaacatttttagaatagtgtcaagttattttttttaactttaactattagtagaaaaaagatcaatcatgtaaaattgatgttactaaatttatcattaaacaaactatcataatatgcaactcttttttatttaaaacattatatatatatatattattgatcaaaatagcatctcgaaaactgtgtcgaagtttaaaaatatttatattttggaacgaatagagtatgtatccacatgttagtgatcctaaaatcacttgatttaaatcaaaggatctcagtctaggataaatcagggtacctacgtttgctactaatcaaagacccacacaagacacgttctccctccgttccgaaaaaaataaatctagtaatggatgtatacgaatctaaacatgaacaaaggtatctccagattatagttatagatatgtcacatccagtgctaaattgtttttttataggacagagggtgtaagcattgagcatgctatgtatatattcctactcctttggtcccaatataaatacacttaatgcataatataaatgcacttagtatatgatgtgatatattctaatacacatactccctctatccaaaaaaaaggcaaaccctggatttccgtgttcaactttgactgtccgtcttatatgaaatttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagacatgacaacaccaacaatgaccccgaccaaaagcaacctcagtacgctctgctcagtgcttggggtcctagctgctcctatttggtgcgtgaagcaattctcactctttcttcgtctactaggagaggcgaagtagccaactaaccgcggcgatgtcggcggttgagaggaagacggcgtgcgtgaccggcggcagcgggtatatcgcttcggcgctcatcaagatgctgctgcagaagggatacgctgtcaagacgacagtcagaaaccccggtgagattcttcttacttctcaccccaacaatggtctgtagatcgtcttcagttcattgattttgtgtgtatgcggtgacgatagatccgggcagtaacagcatgctgtgtgcatagaagattttgcggtgttctgtttggtagaagataaatgctgatgtttgatttgtttcaagttgatatgaccgaagaaaactatttcgggaattcacaagaacaccattggtttggcctctgaaactgcagcgcattgtgattttgagttccagatgatatggagaagaactctcatttcaaggagttgcaagcactaggccccttgaagatcttccgcgccgacttggaagaggaaggcagtttcgacgaggcagttgccggctgcgattacgccttcctcgtcgccgctccgatgaacctcaagtctcagaatcctgaggtaaatgcatgcagacacgtagcacatctcccaccaaactcagtgccattgtggggccaagtgccactcgatgttgtccacttgtcctaggtagtaattgccacttgtcaagtctctgatcgctgccaggccactgttgattagatatcaattatgtcacattaattactattccttcctccaaaataagtttgttttttacctatctcacacaaaccaatatttacctacaagcctataatatactcactttattaaatcccaatataattatttctatttttatttattctcaatacatatatactatcatattttcaagaactctaatgtaatgattagttaaaaataaatttattttgggataaatgggagaggcttatcatactttcacatgatgtaatgattactttaaaaataaatttattttgggataaatagaaaagtctaaaactgaatttattataggacggaaggaataatatttcctcccataaaaatcttgtctctgaaataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttggaagccggcgtccaaggcactctgaacgttctgaggtcgtgcgtgaaagccggcacggttaagcgcgtgatcctcacatcgtcggcggccgccgtctccggccagccgctgcaaggagacggcaacggcagcagccatgtcctggacgagtcgtcctggtccgacctcgactacctcagatcaaccaacgggatatctcctgctcaggtacacacaaacttacaaaattttacatgttcagtcagagttgatagtacagtcgcttgcgtgagagcacagcggtggtgtttgcgctgcaggcttacgcgatcgccaaggttctctcggagaaggaagcgagcaagctggcggaggagaacggcatcagcttagtggcggtgtgcccggtcgccaccgtcggcgcgtcgccggcgccggtggccaacgagagcgtcgccaacgtcctctccttgctgtccggtgagtacgtaagcaccggcagtattgtttggagatcatggatggaaactctttccctccgcacggaaaacggaacagttcattaacacatgattaattaagtattagttaacttttttaaaaaaatagattaatttaatttttttaagcaactttcatatagaaagttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtatggagggagtatctggttcggactcacgtgtccgattcgatttcaggcaacgaggagatcaacaccctgagaatgattgaccagtactccggcgggctgaagctggttcacgtcgacgacctctgccgcgccgagatattcctcgccgagaaagcgtcgccgtcgccgtcggggaggtacatctgctgcgccctcaacaccaccatgcggcagatcgcccgttccctggccgccaaatacccgcaccacaacgttgacatcgatgcgtaagacaaaatcatgaactggtctcaaagattatgcgtgtccactgcgagctgactccgacggtggcggcggaacatgcagactcggcggcggcctccctgagaagccgacgatcctcctctcgtcggagaagctgaccagtgaagggttcgagttcatgtacaagacggtggatgagatgtacgatgatgccttcgtggagtacggcatggcactcgggattctgcactactgacgccgacgacaatgctgttactacccagcttcgcaaccaaacggctcttgcaaaaataagtatgtgtaaaacagcagtgaatttgttcccatccgcttttatgaaaaacgtgcctattgacacgtcaaactgttcaataaaattgtgctcctttcaacattttctcaatttctacccctcaattttcacatgcacaattaccaaacgattaaacaatatgttttttacaagataaaagtatagaaaagttgttttaaaaaaccatatcaattcatttttcaagtttttcagttaaatagtatttaattaatcatgcgctaatccgtcactccgttttatgtgtcgggaggaaaggattcacaaccctcactaaagaacacaacctaattgtggctctatgattttcttttttgaaacaagcaagagatctgtcatttcattaagtagcaaagaaaatattctggtggaacaacgaagcctcacaaggtctttcaaggtccccagttcagcatctgaagatcaggtcgtgttaggccgtgtttagttccaaaataattcttcaaactttcaacttttccatcacatcaaaacttttctacacacacaaacttctaatttttccatcacatcatttcaatttcaaccaaacttctaattttgatgtgaactaaacacaaccttagtgtgggaaagttattacagagatgcgaagacaacttcttcctccttttctaaatatttgacgccgtttgatttttttaaacatgtttgatcattcgtcttattcaaaaaaaatatgtaattattattttttttctatcatttaattcattgttaaatatactttcatgtataaatatagttttacatatttcacaaatttctttgaataagatgaatgatcaagtatgtgctaaaaagtcaatggtgtaaacatagggagtactaataacatgaactaacttgctagcttttttttttatgctagctctctcagctcaactttgcgggcatcgcaggaattactttttggtatgattaatcacacacacaaacgagaagtccaattcgcaggcatgcagcgttgggttacttttcaatggcgcgtgtgctgttcctctctcgcttttgtttgcatagagaaagaaacggatcctatcattttcaacgatgttaaatcgtcacaggcttcagcgtcagatgtactacctctatcctaaaaaaaaaagttcaattctaagaatgaacctgtacacacgtcatctgggaagataagatgatccttttttcttggagcaaaagctttaccttttgaaaacacgatcgaccgcattaaaaatgtgaagcgtgagatgttcatcgatcgacataatcgatcagtgcaggtcattatctaaggaaggaaaatcaatcagaagagcaggtatggtgcatgcatcacgaaaagcatttcttgttctgcctctctgtctggcgactggcgtcgtcgcttgtaaaatagtgttggctaagtcaaatgtattatgttcctgctctccgggatttgtcctggcaagtgccacaacagcgcaatcagcaaaagaaacctcatcatcagtgtgctgctcggattctacctgggagtaaacccaagtcaccttctctgtcacaggagaggtattaactgaccggagagagagagagagacgatgtcgtcggaggttgagaggaagacggtgtgcgtcaccggcggcaacgggtacgttgcttcattgctcgtcaagatgctcctggagaaaggatacgctgttcagacaagcgtcagagatcccagtgagattctactccctttctttcttgttacatgtttttccagtgttcagttttaactgaaaatcgaagaacatgtcatcagttcataatttgtttcagaggagtatttgcacgttcagttttgggattgattgtgtcagtacaattttggtttggcctctgaaactgcttttgtaactctgaatttcagataacccggagaaggtctcccatttcaaggacatggaaaaactcggccccctgaaggtctttcgcgccaacttggaggatgaaggcagcttcgacgaggccgtcgccggctgccactacgccttcctcgtcgccgctccggtgtacgacaagagccacaagtccgacgatctcgaggtgaccactgctgcaacctgcaagctcgattagtatctgtagtcagttagttagttactgaattctgaacttggccatggcagaaagagatagtccaaggcggcgtcgagggcacactgaacgtgatgaggtcgtgcgcgagagccggcacggtgaagcgcgtgatcctgacgtcgtcgacggccgccgtctccagcctgcggccgctggaaggcgccggccatgtcctcgacgagtcgtcctggtccgacatcgagtacctcagatccatggagaagctgtcgccgacgcaggtacacatatatacacacgagctgttccatgtcactgaaccacagcaatgtctcgtagaacatgagttcggcgccattgttgctgcatgcactgcaggcgtactcgatctccaaggttctttcggagaaggaggcgaccaagttcgcggaggagaacggtctcagcctggtgaccctctgcccggtcgtcgccgtcggagcatcgccggcggtgagggtcgataccagcgtcccggcctgcctctcgttgataaccggtgaggaactatctagcgatcaccgaatgaatgaaacaagaagcaatccaagaactcgacttctgaacgtttttgggtcgctgcatcgatgatctgtgaattttttttttcaggcgacgaggagatgatgaacatcctcaagggcatcgagaaggcgtccgggtggtcgatgccgatggtccacatcgaggacgtgtgccgcgccgagatcttcgtcgccgaggaggagtcggcgtcggggaggtacatctgcggcagcctcaacaccacggtcaccgagatcgccggcttcctggcggccaagtacccccagtacaacgtcagatgcgattggtaattaagaaattaagctttatgcattcgtgcatttggttatctgaatctgatcatgcgttgctatgtacgcagcatcgaagagcatcaccccgagaagccgaccatctcgctctcgtcggcgaagctcatcggcgaagggttcgagttcaagtacaagaacctggacgagatgtacgacgacctcgtcgcgtacggcaaggccctggggttgatccccaactgatggtgatgatgggcggcgtaattccactgctttggcgattacgaccaaacgtgtgttgctttcaaaaatactattgtgtctagcattctattgctacattgctagtagtactagtaccaagttccaatacatttggcggtttggctgtacttcgttctgttcatgtaagaggaggattgagaatttgagatcctcttagggggtaagctgtctaattctccggaaaggattagctgaaatcctctaatagtttttgcaataccaacgtactttcccggtttnnnnnnnnnnnnnnnnnnnnnnnnnnnnnaaaaaaaaggttgtgtttagtttcttggccaaattttttttagtatacggatatacatttgaagtattaaacgtagactaataacaaaacaaattacagattccacatataaactgcgagacgaatttattaagcctaatgtgtccatcattagtaaatatttactgtagcatcacattgttaaatcatggcgtaattagactcaaaaaattcgtctcataatttacatgcaaactgtgtaattggtttttttccacaaataatactccatgcacgtgtccaaacattcgatgtgacctttttagcaaaaaaaaaaaatctaaacacggactaagccacatgactttgagtcactaacatgtgggccctctttactatggatccatgtgaatccgtaatgggaatgttgtggtctggcacgcgttgaaaaaaaaaaaactctctgaacagcgtttctacctgctgcgacactgctgctgctgtcaggtgcagccgagcaggttgagaaggccaaggccacaaatcgatcggtcaattgctcacgctacacgacggcatgcggatgcgggcaatgcgagcatgcaaaaaccacagacgtcacacgctgcctggctctgtcacgtactggccacctcgtgtttcacctgggcacggtggccggcctgatcttttgtgcagtgcgtggacgagatttttgagcgcgacgggcacgtaaccaggcaccggggcgatggatgcgcggcaagccggcaacgacaatatccttggcatcaacctccgccggtcgtcaacgtgggactagggatggcaattgtgcccgtttgcccgtttacccgcgggtaaaaaccctattagggttgggtttgttctccattttatacccatgggtatcttattgggtcaaaagctatgcccgatgagtaaatgggcatgggtatgggtaatcactacccatgcccgctttgcccgtttacccacgaaatctaacttatatgtaggctaggagcaaaatccactagaatacataagcccagttctttgatttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcaatgggcataggtaaccatccttacccgtcatgtagtaatgggtatacccacgagcacaaataatctcacgggcatgggtataggtaggcactacccgtgcccgtcgcgcccgattgccatccctacgtgggacaaggcgaacggtggaaattagtgcagagaaatcagtcaacggatcgcgcatgcgacctcccgctcactcccggcgcgtggtcgcgcattcccgatcccctccctcgcgggctcgcggcccaccgcggcctgctagctttctagcgcgcgcgatgggctgcccctgcctgctcggcatcagccccaattaggaaaaagtggatttttt

SEQ ID NO: 64600 - DNA, 35206 bp, Oryza sativa
ccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggcagaagtttttaccggttctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatcttcgtagtcgccatctctctctcacacggtgggggttagagacggtggggggagcggagaagagaaaagaaaggagcgccggccatggctcggcggcgcgaaggtcccgggcgatgccaacgcagtcacatgcggtcgcgtgagagagagaagagaggagaagctagggtttcggcggccgcccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatattaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttctccgggaggtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctctccgccgccgccgccgccgccgccggcgggggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctccttcaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttgatctaaacttcaattctttttcatcacgtcaacctgtcatacacatactttttcagccacatcatctctaatttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgccgcccccgcccttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgcctcctcctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgtttcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggta

SEQ ID NO: 64601 - DNA, 668 bp, Oryza sativa
aatggagaaatattagtgtaacatagttgcgaggcagcttgccataaatctcaacaaaatatatccaacagatgcatatttctgcatactgcactgtttctagtgttttgaatatttcaatgctctaaaaaattactcacatactttttgatattccgtctttaattatgcattggctaccattgcatagaaactgcaaaacattagtgcaatgtagttgccgggcagcctgctgttaatcttgaaaaactcaatattaaaactccaatagaactcttgtttttatgtgcaccgagacaggagaggggcatgcatagtgtgctagaaagttggatgtaacaaaaatttaattacatctcctgtgttctgcactaattttctctgcttcgcagcttttgttcttaattttgacacctgaggcagttgttagaaatttgtaatttgcaatggacttagctctgagcaatcttattattactgtctagtgtgttctcaagatagatagccactgatgactaatgtattcaaattcatttgtctctattctgtagcatccgggtgatggaatttcccctgcacagaatgcaattctgcatgtgcagcgtaaaattgtaccgacctccaacaccaaggagggtcctgcgatatgtaggctgattgtttcaccg

SEQ ID NO: 64602 - DNA, 1129 bp, Oryza sativa
  unsure (1)..(1129): unsure at all n locations
ataagtcatgcttaaagttccttaacggtaaaataggtcacagcaaaataaacgatatttacaaaaatgttttgaatacgacgaatggtcaaacgtcatgtcaaaagtcaaaggtgtcttctattaaaaaacggagggagtatgtgtttaccttgctttgtttgacaatttggctgggaaccaaatttggttacccatgagtgtgacattccacaagatctgttcttgccttcttggttttcggtgccatatgtgtcacccctttttctgagaataagtaatttaaagttggtgtcagaagtgttttatagtcaccactagagtaggaaaattgttgatggttgaagatatgtcatgatgcattggtattgtaacatggtaaacaagtatgattgggaagaaaatagcttgtatactactatatacaagttttatgattttccttaccattgtggtctttactttgtagggcatgcaggttgttggtgatccaatttcattgcctgatatcccaggaatggcgcatagaggaatgggtggatttcctgggtttgtttcttgtcttggcttgaatatgtttatctgttgatcaacagcaatgaaaacatcatgtttttgattgtattgcaggcctggtcagccatctatcgtatcaaccataactgcagatgtcatggtcccaaaattagttttaccttctctatgtggggaagatggaggctgtttaaacagaattcgtgaggtttgtattcggctagtgcattttgtagcatatccagtaaatggttggatgtatcatctgacataattaaggccatgtgcagttttcaggggctaagataactgtcgncagnaaatcccgnaantgggtanantngnccanantggngggnaaaccnaactgctattttgatatccggcacaccagaccagatgcatgcagcccgaagtcttattcaagcatttgtcctaagtgaaccactanccccctgatnttnnnnnntncctgggnggnnngggggggnagctggnngagnnnctnntgatnatnattgtntctgcaatcaaactagtgaccttatgtgttcatatttatgaatatgcgtgccctgtttgcagacttgcatat

SEQ ID NO: 64603 - DNA, 972 bp, Oryza sativa
catggctggcgccgccgcctctattcctgtttctctgtatggagttgcaacggtgtcatttttattttattttttgatgttttttcacactcaggatcacgatacaaccaaccacaaaaaaatttaaactcgaactaccacttaactaagtctgaaaatatctagcataccacttagtctactttgcaccttcactaaaattagaccataactcctttagtaaaactctttgatcaacatgttaaacataatgcactataccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggataaaatatgtgacatgcagaattttctaaaactctaccgaaacggacaaaatatgtcatctattaaaataggcgtaactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttggaaaattccacgtgccacatattttgtccgtttgagtttattttttacatggttggttcctgtgagttcctaagtgtgaaaaaaatatcaaaaaaataaaataaaaataaaaaagttgcacatctctctcctctgcactagttcggagagaggagaggagaggaaaaattctacatgtcatatattacgtccatttgagttcaatttttctatggttggtttttgtgtgtccctaagcgtgaaaaaaatatcaaacaaataaaacaaaaataaaaaatttcgggggggggggcgcc

SEQ ID NO: 64604 - DNA, 1130 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatg

SEQ ID NO: 64605 - DNA, 9260 bp, Oryza sativa
aagcatttactctctttgtaattcttgcactttcaccgcctgctgaccatatgccttctcatttttctccatgtcttccatcatgatatcatgcatgtcatgtactgatgtgcatattttcccccaaataaaacatgaacatttcaaagtttacacaaggttttgctagcttccacttatgtttagtaattagtacaatttgaaagtttccttggcgcagcataagtcaattgaagttcgctgtcagcaagcttttactccatatcgatttcagtcaatttatatcttccatgtattatggtagagaagaatagtatccatataacttgctcctgtaagttcataaccaataactcttgctaatgacattttgaaaggttgtttttaactgtatatgcaaaattttgcggtcacagtttgttgtcacctatatgggtatatgatagcagaccacatattcggaaatatagctggctactctcaaaagtaaaactcaatgtgcatctttcgttttgccattccgcaccttttaacactataatcctttgttgtcgctataatatcaaatggaactttaccagtggcctgcaaatgagattattataagatactccctccgtttcgcaatgtaagtcattctagtatttctcacatttatattgatgttaatgaatctagacatatatattcattaacatcaatataaatgtggaaaatgctagaatgacttaacattgcgaaacggaggaagtatatatttattatttatcgttttattattcttttatttttgacaggtaacaagccttttaacttcttcagttaatcaggaccaagtgcagctttggtagtttctttggattggccatcaagaatcacatgcacattcgcgtatgcatgtggagttccaaaaccaatgttgcatgattacgtaccgatctctgtaaatcaaaatgatggcataccgagtttggtgttatgtatacattgtcgtgcatgatcgtatacagatttttgccgtatcaaagagatatttttttcttgcattgtcggtacgcacgcgtttcttgctagtttcgctcacccactgacggcgtttgtttggatgaaaaatacccctcttggggctgcctacctcgaatttttttatttataattttttttattaaaagttttacaaaaataattttccattttaaaaattgacggaagtagtcgcctaccgccctctgggagggcgagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctgggggagggcgattttatactgtgctctaaatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttctattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgaatcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaattttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcatcgtagaactggctagtaggaccagtcctaccggcgtgagacgaagaggccccagtaccgaagatcccggctgcaaatcctgctggacaaggaccatcagtttcgtacaagtatttaacagtggtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgtgctcgaaggcagacgaggtcctgcgatgaggaaacgtgcagttaaaacatagtgacatattcgtgcaaaagctgaaacaaaaatgaactaatatctgggctgaactgtaccgtgcgaaaccggtgttgtaggtcgcactgctccgaagctaggggcactcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatctggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcagcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccaatcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaagaccatcggcaggatggtgagccagtaagcctggtcgcgtgtgcacaaggacgaaattcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcatgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttttgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacctgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcaacacactctttgttcgatcatcaaccgatgtaaatgtatgtaggtcatagtatgtattattattcctctgggcaatggtggctaacaaacgaggcaaattatcataagaagcttcaaatgtgccatatctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgttgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttaacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctcctcttctgctgccctcccctctctctctttcgttttttttggatttttagtgaatataatgaaatttcacagaggagggactgggctttataggggggaggcaaaaatcgccctcccccgcacagtataaaatcgccctagcggaggacggcaagggggccgcctgcaaatttcgttgacggccgtctgtcacgtcattttcgccgccctctgagagggcgatttttaaaaatcgccctcccagagggtggtaggggactacttccgtcaattttcaaaatggaaaattatttttgtaaaacttttaataaaaaaaattataaataaaaaaaattctgcctacctccagccaacccccctcctcccagggataaaaattgagcggacacggaccgataatgcttgtaccatattcgttttcattttttttatcggatatgaaaacgaatacggatagttcgaatacggaaacaaatacggattatctcgaatatgaataagaatcgaatataatcggacatgaatacggaaacaattttttctcgaaacacgaaaaccaactcaacttctaatagaaacaaatatcaacatatataattagctcattttatatatgaagtataatttataaatattttttagaatttaaataatattaatagtacactagtgttaagagataaactactattaaaatatataaatgttatagagttaaaaagaaatggggtatgtctcatggcttatgtggatatccaaatagcattgttcaccggatatccgaattattatctacagaagcggtaccacccattaggcggggttgg

SEQ ID NO: 64606 - DNA, 757 bp, Oryza sativa
cccacccgccgccttccctgaaaaaaaaaataattaaccgcacgtggtaaatacggatatactcatcatacacaatcgattaatgttgttcttgtaataacaaagacgaataaaaacttgacctaaaatatcttatattttagtacagagagagtcgtgagcgatttaccggcggtgatggtggaggcgacgccgatgaagacgaagaggaaggtgaagaggagctcgccggcgacggcgcggaggcagccgggctcccacgcctcgccgcggtggccgagctccagcttcgtcatcggcagcaacggcatagaccgatcaccgatcgatcaatctgatatagtatttgacaacaatataaatccaaatatatatggctagctagcagcaaagttaggcgatagatcgaacgatatgccgaaatggttggtctctgatcgacaataagatgaatagatgatcgatcgagacaagccactaaagctagctagctaagctaagcgatcggtggaaagttgggaaccattttttccatggacaaaaaggaaaaaggctaacaagctttatatatagtgagagcattgagaggagatgatcagatatgtttttcatacaagtcaagaaagctcataatggcgagcttgaaatttctgcatcgacgcactggattactgcaaaggaggagctgtacatgcacgtacacgcatcgatcagctgcggcctgcacgaacatgtgcacactgtcacaccaaattgt

SEQ ID NO: 64607 - DNA, 592 bp, Oryza sativa
gagtcacacgtcgacatcgtctcgtcaaccgaaactgaatctcctgaatgcataggggagacgaagctgctgcagggtacagtgacaggtgccagtgcagcagtcggcacaatgctaggcactttaggaggaagaacagactccttctgtgtggcgctctcatggcgggatatggccggagccggcttggcggaagccgatttcaccgccgaggcccgattcgtgcccacattgcggccactggccaaagatcccttcttcactggtgcagctgaggcagctaaattcaacttttgcaggaggatgggacaagagaaatcaatttataatttatttcaatctgttcatttgggatttcacagaccacaagcatgaaaaggaataaaaatttaaaaacattagcagcacgcaagtatcatattaccaattgaagattccaaagcaagcaaacgtacaaaacacttcacaaataccaagaaagcttgatttttgaacttttgaaggtgccaataaactttatgcctgttgaccatggatgctcccaagaaatcattaatcaattaccatgaaaagaggcctaaaatcagcaagg

SEQ ID NO: 64608 - DNA, 2079 bp, Oryza sativa
ccgccattggtggtggtgagctttgcttctcctccgctgttctctcagctctgctgctgaattactactttctctgaattgagaaaaatggacggtcacaagcttctctgaactcgcgtagcagtgtcaccgtccatcgcagaaaactcagttggatgtacgcgcagcagcagggattcaccggccccatctttacgctaattcttatacatatcagccaaaattttaatttttaatttttaatttagagctgattttaggtttttttaatcaaagtttattttccagcttttacttttagagtaataaaaacatgtatattttttttagataatagaaatgtgttacatctccggcctctgcccgtaggcacgtgaatagaaaagagcttaaaaaaaggcgagatgggacaaacccccaacttctgccaataatatgatctactaaaatcatgtttttttaaaatcatatagattctatcacgaaattctgtagttactacaccatccaaactggagtaaaaattccttggctaccaattccaagtgtgtagcaccattgcgcgtagtatcctgttattccggtgaaagcatcatacaccaagagtggagccaattggaacacatgaagataacctgcatgatgttaggcatttttttatggttaaaaaccatatcattacggcaacgccaaattgaccaacatagagcactagctccaaataaaatcattttttttgtgggtctaggcactccccttagccagttaccaaaaatatcttttgcattgtggggagggggaatattgaaggcaaagaagacacatcgccaagcaaaacgtgcaacatgacagtcaaagaaaagatgttggatgatctcttgtgtattacaaaaacaatattgcttgtttcccctctattttctctttatgaggtcatctttcatcaagattactttttttgaagaaaccacataaatacttttatttttagtagtacctttacctcccataagatcctcttgtggattcttacattggaattgatgatcgcattatacatggatttgaccgaaaaatagccatttttatgtagcgaccaaataaagcaatctttttcatttgacagggttatattagctagtcgagaaatcaaatcattccactcaactaactttggtcctacaattgatcatcggaatgaaacatttaacggtgttgtgctcataacctctgccaaagtagaatgtctctttcgaaccacattgtacagagaaggatattgatatttgagtggttgcaagcctaaccatgtgtcttcccaaaatcttatttccatcccattaccaggtttaaaagatccatactgaaaaaattgatcttttcctttcattaagccagcccaaatttggaatgttcctggtttgtgtgacatgtgggagaggggtttaccttttaagtacttgttgcgtaaaaggttttgccatatgccatcaccattaagaagcttgaatagccatttgctcaacatacatctattcatgatatcaagatttaggatacccagtccaccttgatcttttggccggcatatataatcccattttgttaacctatatttctttttctggctatcacttctccataaaaagctcgatcggtagtaatccagtctttgaagtacacctcgaggtatttcaaaaaaaggataacatgaacatgggaaggctcgaaagaatcgagtaagaagaaccaatctcccaccataggagtatgtatataaagttttattcataaattaatttccattcgagaatatgccgtttggcttattccaccaaacaaccaaacgatggggctgcacgttttccgaccaaaaccagctgaaaaccatgagatttcgaggttctgatgcggaacgaatttaaatgtatgataaaaccactctgtaccgagttaggggataattcgtttgggttgaagggtctgatgtttaaaatatctggctttatagtttatgggtgtaattagtactgttacagtaatttagagagataattcacacttttgggctgcaggaat

SEQ ID NO: 64609 - DNA, 584 bp, Oryza sativa
tttcattctgctccagtggaagaatgctagtagcacagtgaataatccacggggaaagaagaaccttgttttatcctcatggggggatgagtcagtgcttactgaagattatgttaatcctcattatacaactgattgctatcagtcatacagcgaaaggaccaaccaaaatctggtaagtttcatgccccaaaccaaaaattttgcgctcttttttaaaatataactctggcggactaaagattttctgttgctacctcagaaacgcttaaatgaagatgtgattgattttgatctgttggaagacttgatatgctatattgatgagaactgcccccctggcgctgttcttgtttttcttcctgtaagttcagggtgtcacgccagcttaatgcttcatttcttaataaacaccttgcaatattgatgattgatcaccatttttcgtctgtgatgctgctcagggagtcgcagagattgatatgttgattgatagattatctgcttctgttagatttggaagggaatcatctgattggattcttcctttgcattcactgcttgcacccactgatcaaaggaag

SEQ ID NO: 64610 - DNA, 20292 bp, Oryza sativa
caatttgaaaataatagtactactaacctttccagagtcctaaaaaaattcagttgagtttgcttccacttgatggtgtattgtggacggatcgaaatcgcagagcccaatcttttgcatgtattaaacaatatatactacttcgtatacttaattaatctttgcaaaagaggcaccaacatgccaggtatgcaaatgccattttctaattcctctgcatactttagaagccaaaagcacccaaattttgtattaagatgttgctctagttcaaacacctgtctcacagcatctttctgaatacgcctttgacagcaatataaaattatctaccaaactatgcttgccaattggttacagctctgcttgaatcctagatctggactactacaatttattttttcttttgtgtctgtgtgtgaataatggatactttttcttgctacaaaccattccctactctttgttttaaactgtcactgatccattagaagctttatatttatgagttgtgatgcatgcagctcattattgacaccaggtgcttgtcttttgttagcaacatcaacactaattgcgggctaatgaaaaaaatcgaaacacaagaagattggaagaataaaacagccaaggtcagacagatcaaaacacaaatatgttccattccacactcaagacatcctaggaagttgcttggaactcatcagtcctcacaagtcataggcatgcacaatgtccttaattccactcatacataattatctggtaaatttagtattatctagttaatttcctattttgccacttctagtatgtgaccaaattcattatatacttataaagaagagtatttgcccaaattgcagggccattgcacttttactgtctgccaatgtggccaaagttcagacttcacagacataccttgaggacggctgaccttaaaatttacagcaagcactaattaaattatagtccatcagttagccggtaacaaccgagggtttgtacggaatccatcgtaaaaagaattggcaaagacaatttctgactgccaatggtgcatggcatctactgctgggggcacagtactaatcccctgttaatgattgcctcgggaagcgtgattaaacaaaagggaggctgtcttatcagcataacaacacaacaaatcagcaagtgaccaatggcagcctagttttatctctgccatgtgggattgtgccatccatccttgcagacagggagtacgactaatcccaaaagataatcacgcttattagcgtccggtcaagatctaaccaccaccaccccccctccaccctctgcaactcgattgcatcttgtaccttcattggactctcacatttggcccccactagccagaccatatcacaagagattaaccaacaaaaaaaaatcttgattttgatttgctcagatcaaaatgtgattcacaagaaattaaccaacaaaaggtgttttctttttgcaaaacacatacatacatacactcacctcacaaatacacacatatacaacatatccttataaatatctctaaaaactgaaccagcgtatcttaaaattagcaaagtcatcgtaaacgttttacggtcgacggatacaccgcttaccattaaaatgtggttcaaagtttgtaacttcattgcaatatagcttggcaacaacttatctgaatttctctaggaacatgaccgtaacccatttggaacaaagaaattttggtgttctcgttggaaaacaatccacattgcttgctaatctcgccgcattgggtgcaaaagaagccgatgctgaatcagacgacgtcttccttttcggccggcccgtgtttacaactcatcacaggctgcttattgttaggaacacactatactatatctcaaacagtgttacgttatgtcaaagtgttattttagcagggcagctttagtagtgagtgaaggagtaagtttccagccgtgcaggcactagtgctccactggtgatgatgtggagaaaagaaagctgctttttaccggtgtctgtccttcactgtctgtcagtcacaaacttcttggtaacatgggctccaatcattgaataaccgaggagtagtagaaagttttcagtactgctgctgtatactgtgattactgtagtagtattgggcagtaactgcaatgcaagagaggcagggagatgctgtgacagagggagagaggtaggtgcatagggttaaataagggaggactcacttggactcgcttctggcagccacgacttctttcaaacaatttaggcttttttattataaaattatatagctgtaaaaatctagaaaataaatttggaaacaaagactaaaaacctggttttctaaattctcaccaactaattatttactagcggcttctcgaaatctcaaactcccctaaataagacctagccaggaaccgaaaaccatcgtcttttttagattttcatcagctggatactacttactagccgactagccgcttcttataatctcgagctaggatgcagtgctgaggatagatagagagataggccgatagacaagtggctttcagagtaattggacagagatatcattgggaattgtttcgccgcaggaggcaatggcgttgtagatgtgtagaggctgagctcagtagcggtagagtagggcctctcgttgctgttggatgccgggtgcatcatcgatcgacaccaatcaatcatgcaacctgccctggcctcctcctgcagcaaatgccattcactttcacattcaacattcacattctcccagtaaaataccaacagatgcaatgcaagagcaggtgagttttcagagtggcaatggagcgaactgatcggatcatgcaaaggtgtagtacagtccaactctgagcggtcaacactctacgattgcagatgatcacagtgagtaggagtacatgtatgaagaagtactcctatgatgcattgcctgctacgagtagtaaaaagccgtatgagtaaatgttgcaagtggaattctgggagatttagattcagacattcatcagattcaggtaggagtacatgtagtagtaccagtaaagcttctgccactaggggtctgttttaagagcttaaaattctgagaagcagttgctagaagctagctggtgagaatctagagacctagcttttgacttctaattcattttctagattctacaactacagattcttaaaatctgggtaagaagctgaactgtttggaggagcttctgacaactgaagattctaagagaagctgcagctgttagaaacacctctaaacaggcccggtcacctataccgaagaactctactacgaacatcatgtgtttcgtgttaggacgatgtacgtacggctggtctccaagtcctcgtcaggatcgaaggaaaaacttaaggaatctagtagtagtagcacttgctggcgtggagcatctctgaatgtgtctgaacgattcctgtactgctggattctcccgccacgagaccaaagtccaaacacgagtctcatcattagcttagcactagtacccccgtgcaatgcatgtactgcgtgtgtgctgtgttttagtaatacgcttgaaacctagggcaggcacaccaccgcggattgccgtgcacgcgcgagcgccgcgcgttgtcccacgccacgccacggcgcgcgcgcgcgcgcggcagatcggcaacggcacggcgcccgcgcccgcgcccgtgcgccccggttgaattgactggacgcccgcgcgcgcactggcgcgacacagcgcgacgcgtcgcggcgccttccaagtgggcgtcggcgtcgccgccggcgccggggaggaacgtccatggcgcgagcgcgagcgcggcgcggccggtcaaaatcttctctctgctggtcgagccgtcgtctcgtctggtcagagtcacacatcgctgctgtcccttgggactctcgacacgccacgcagcgcttcctgccactgctgctgctgatgctgatgctgatgctgccgaggtgaagaaaaatccatggcggaacacgcgcgagcagtggcaactcgctcgagaccgtggtactcttggatgtgcagtgcagggcacacagtcgaggctgctgcctgtcacctgtgttgttgttgttgtggtggttcatcgatgacaaaccgcaaggattcggaacggacggacgcaagcaacgcagcgagctcgtgctctgtcgctggctgcgtgtgctgtagcttctggcacggacgggctcgtgtgtgtacagcgccgtgttgatgctcttggcagggtgggcagtacacacgccgtgaggtcagactcgttcagtgaggtcgacaagaaactgcaacagtgaagagtcaagctggtggtcaatgatcagttctagacaacttagtactacctccatcctaaattatagtagatactccatctgtttcaaattataagtcattttgactttagtcgtctcaagtttaatcaagtttgtaaaatacaatagtaacattttcaacccaaaacaaatatattgtgaaaaatatattcaattatagatttgataaaactaatttggtattgtaagtgttactgtatttgtatacaaacttgaacttggaatagtttgactttgaccaaagtcaaaacgacttataatatgtaatggaaatagtgcatagttaaaagttgctatattttaggatgaatgtagtactaagttacatgtaaattccacgctcatttcacccgaggatctgatgatctttgctaacagctgcagtgcaaatacgttgaagactccaagaccattgcgacaaggcagatttttcagattctgtcccatcaggggaaaaaaagttcagaggacatgaaaaaattgtaccataaattaaggatggtttgaacaatactttgaacttcgaagtaacacgatgaacatgaaggaaacagcatccttttttgactgaactcttaaaaggaccactgaaccgctgttttgaggaggcgctacacaagctaactcttcgttgtgtggaacatcaaagacgaccttagagctcactattgctagcaccaccggttgtctttccattgacggcgataagctccgtgtcaaagattagtgttgctccacctattggttacgaaaccgtatgtcagtattataggtaaatgggaaaaaacttatcacatgccctgttggcaatgtaaaatgtaggtgtgaaacatggtaaaatagccatgtcaaagttgagaatctacacatggataattctttcacaagaaaccatcaagcaaacaaacaaatattcagaccatacctggaatcttcggtggggagcctctctccccataacccatctttgcaggtatctttagcttcctcttttcaccgacacacatacctagtaacccttggtcccaacctatagataaaaacaacaatgtaggttgttggatatgcgaaggccattgatatgaactgcacagtccatttcctatttttgataacatccttggtcattcaagctacctcagtatggactatggataaatatggagaagttcagtattccagggaaaaggaataaccttttatcacttggccgtttccaagagtaaattcaaaggggtcacctctgtcatagctagaatcaaacactgatccatcagtgagtgacccctgcagcattatcaaccatttcaactcaatgatggaaatgtggaaataaactatgcaggaaagtaccacaatttttttttctttaacagttgtaaaagaggtcttttaacaaacatgacagggaaaccaggtaaaacacacaataaaagacagaatctacactgttcattcagcaatgtagtttatcactctatccacaaaactatttaatctgatccgttaaataaaacatgagtatgtacagatccatagtccaatggacgatgccttccattatatgcagtacaacacgatagagaaaaacaaaacttagttctagtccttaacatccaagttagtgtagttagctgcaatcactcgttctttgagtttcaaccactcaatcaggttttattttaaatgttggaagtttctaggattcatgtgggaatcgaaatgtttcaagttacttttcatattattaacaaagatatggaatacttacacgataatgcactttgattttgtctcctttgtgagcttgcagggtgcatgactctggcttgtactgaaaggaggatagccaaagaaaacttatgctatgcaatgcagtgaaatgcagaaatgcttaattttaaacgtaaaaacagaacaatcctaactttgcaatgattgtctttttcctgtaggaactgagcgttgaaatcaaaatatgcaaaaaacattcaataacaacaaccgtcccccccccccccccccaagcacacactttcatttgtgatgtactatctgctttgagccggtccattcagcacatgaatagatcaggtgaacataagcaatttaaaattcttatctttgttgtaaagaacaggttcaaatattcaagtgaaacaaagttcattcaacagccctttcatggaattggaaaagaccctaaccagtaaccatccatttcgcacatttcagatccgcacaacacaatctattctaccatatcgtccaagctcaacaacaccaatccatatcaaattcgtcacgcctggtacaaatcgagcttgtttgaacggattagcagatatacatcgaatcgacgaactcagcagtatcagatccactacaccccgaagcaagaatcgcaagaacaaccagaaaaaaccggttaccttcacaccgatctgaagctccgtgacatctccggacttcttggccgaagctgaaagccaaatcgagcaaacgatgtataagccaaacatatcaagaacaagaagagtagaaaaacaacagatctttacaagtcggctgagctatgagaggagatggggatggggaacggggttgtgcggataccggtcaggatgagggccgccgcgacaacgacggcggcggcgacggcgaagcggacgagccgccgctgctgctgacgcttccccattcgcttctccagtacacgatactaccagttgacgacttgacgtaggcttcgccgtatttgcacacggaatggttcgcgtgggcctacgactgcggaggcccatttttagtttgggcccggcccaaaattcaggctactacagtattttttgggctttggaatacttctaaatattgggccgtaaaatcttctctctctctctctctctcttttttgagaattttggacacaattcttttctacgcgtgcacagctcaaaacggggcctgactccttctgtgtttgctagaaaaaacttataagttttattactacacatgagtcatatataattgagagctcagaaataaagtcagaagtcgcaattggtcatgttaatttctcagtattcgaaagagtgttcatttagattaattctccggcccctggatatcagatcagccatgcacaagctgagaccgcatgctcacaaattaactaattcagctaccatatcataacgtcggccaatcaactgctacatgcgtttgcaatattggagtcagacacatcgtttattgagagagcataattaagggcaaatggagcagcagtatattgataaaatgttaataagttgtttattatctcagcagttgcaggtctacgagatatatatggccggtcaacacccgcaagctcgatcgttgagtgatgcatatacttatgttataggtgctgtccacgtacgcataaacatattttttattatattgtatttgcgtgaaaactatatttgcattgactgtctgttagtaccataacatcaccttaatccattaattagtagctagtattattaaagtttgccttctattgaggataaggaaaacacgcaatgaagtgaagaaagctgagtgtgcacttacttgccatccaagttaccaaccgaatatcaaacttaccgtggacttggcgtcaattaattaacagcgaccattattatgcaaagttatcctcgcctcatttttaatgtagttataattttttattcaatatttgaccatccaacttatttaatttttttataattagtatttttatttattattattagctaataaaactagaataatattttatgcatgatttattgttattgttattttttatatattttttaactgacggttaaatattagacaaaaaatcacatgtgcacttaaaataaaataaataggggggggtataaagtatctacttgaccgcctccagcccgagacctccgcgtaaaaccattgtccggccggcctccgcgtagtcttccctagcttcggtgtcccaacgtcgccgtccttcaccattaatgcttcaacgctctgtctttggtgactcctgtcaccacgtcagccatctcatcactactctatccctcttatcttcgggtgtgtttagttcacgctaaaattaaaagtttaattgaaattggaacgatgtgatggaaaaattagaagtttatttgtatatgaaagttttgatgtgataaaaaagttgaaagttttttttaaaaaagttgagaactaaaccgggtcttctttggctgtgccgctgcggtgccaatatatgtaccattgttattctctatcttcagtggctccacgcaaaactcccacaccctcatgatgtgtaatttcgttgagctccaaaactttagtatttttcgaatgttttaaaattggaaattaattctgaccaaattttaattaaactcataaaagaaaattaaaaaaaatcatgaaaataacggatgaaatagtgtcgtgctgggtggtgatttgtgtaccatagctaccttgccccacagccatcgatccaacatcgttacggtcatttctctaagctaaggaacacctcctattcccctaccccttaactcttcttctttccctacctaaccatttaatttaccaagattaaattgcaaggttaaaaatctatgtgatcccctaaccccaatcccctcctcttcacctacccaaaaaaaaagtgttgagtgatgatgtataatatcaggaaatatttctatcaaaacttttgagggaatgtcccatcctttcttgcatgtcatgcaaacatttatgaaaaaaataggaaaagttagatcaatactctccaaacatgcaaacttaaattcaacctctacaaattataataaaaaggacaaatatcaaactctagctagtatgtgtatattcacaccaaactttttttatttgtgtccttgtagaaattaaatttgaatttgcatgtttgtaaagtgatgtcacatatggatcgaattttcgaaatttctttatagttatctagataatatgtaagaaacaagagaaacatccactccgtgagtttaaaatccattcccatataacatctcaatatctcgacagttttgcatatatattattacacaccattgcaaacttgcactccaatcacacaggtgacaattaacaaaacatatatagatatataatagtacgtagtaagtagcacacagactgagtgtagccagcacactgcatgcacccagcacacagggttacacaatctagctacacaacacaggtggtagtacaagtttacaacaatacactctctctagtctctaatacctcgctaattactatagctatagtacttcatctccttgaagaagaaaaaccagtacttcttctaggacgtacggccatccatgaaaaatacatgacgtttaatttacacaaacactgtacaaccatgaacattattacatatttagcatcacatccgatcgatcgaagaactaaactgacgaactaattaaagttgtgtagatcgaactgtagataattttcgttcttggacacacgcattcattcatatagcatagctttcagagattcagagatgcagctgatgaacacacggacgagacgataatatggagcaaaacagagagcatgagtagagtgtcatcatcagtctttgtccagcccgaacttacggtcgatgtagccgccgacggcgtggaacgctgggccgaagaacccgccgccgccgccgccgctgttgcttcctgatccggatccagcgccgccgctcctcctcctgtcgccctcgctctcgtacttcggcgacggcgagtacgacgacgacgatgagccgtggccgggcggcgtgtggtggtagatgaccttcacctcctccgcgcggatgaacaccggcgccgccccggacccgccgtcctgcggcggcggcggaaccggccagccggttccgccgccgccgaagttgttgtggggaataggtgcggctccgcttatgatgatgctgctgccgccgccgtagggagagttgctgccgccgtagccgccgtctttaccgtaggacaatgatccgccgtaggaagtgttgccgccgccatagccgccgccgccgccgtagtaggagcctgaacctgcaacgactcccgtgctgctgccgtagtaattgttggggttgccgctgttaccgccatagctgtccttgttgtaattgctgctgttgccgccgccatggctgtccttgctgtggttgttccggtctttctcgtcgtccttgtgcttgtggctgctggtgatcttgtgcttgttcttgtctttgtcgtcgtcgctgccattgttgttgttgttgcttgtgtagctctggtaatccttcgtcttggtctccttcttgtcgccggcgccgcgcggcggcgacgacgaccgcctgccgccgccgccgccgcctcctgatccggcgccgtaggaagaggtgtcgtagtacgggctgttccacgacgacatcgtctcgatctctagcttgatccccaacttaatcactcaagatcgagctagggttcgtctagatatatatccctggatgataataagttcatgtatcagcatgtatgctttggttgaaatgaaaagtgctcgattagatgcctaggaatatacacatcgatcaactagaattttcagtaacaaactaactcttgatgatgatatgagctgtatgtatcagtatcaactagctcgaacagtgattaaagagtgaaaagaatgagaaatttaaacactcatatatgcatgctaagcatgaacgcataccagatcgacaggggaagcagatagctagctagtgtgataatcggcaagatggctctacagtgtgtggccaagtatatgttcacaacttatagaagcccctgcagagacgtcaacgccctagatagaaaagtcttcgtcttcttccccaaaaatacaccttttttaattatcacagacaaccttccaaccacagttaagattaatatacgtaaccctatggcttataattgctgattagtgattcggattgaaatccatggaccaaaaataattaaactacgagtagctaccccacttatagtacgtcgtcaacctgtaaacttgcgtattcaaacacttcagctaaatcaactgatacctgcacacttcgatccattatacactgcgtatatttcgtggccagtgtaccgaattcgcaatcagagaaagagagaggttagaacttagaacaagactgtgtcagaggaaatatctctgaaattgcgcgcatgcatatgccgacgttagcattcatacaaattgcaatagcgataaaattgattaatcctagtttgactgaatatcatccagaattgaatcacattttcataaagatttttcgtgggccggaacgccggccgaatcctatatacttatatagttcatccccactaaatatagttaatgctatttctctcttctctcgttaagccacatcactctaattatttctagcttttaaataaaagatctatgatccaaattgtctcttctttcttctctctttaaaaacatacaatcttaattatttttaggctcaaaattatttcaaattgttttagttttgataattaaattacatcttatttgcacatattatgtaacttaatttttcgcagcaacgcgacggggtattcatttagttctattaagaatcaagagagcaaattaatatcatagtgatatacaggtctagatatatattgattgatctctctcccccagttagcaactaccggccgaatggcaggcagtacagcgacatttgcagtttaatttacatgcacgtacatttgcgccaatgtggtaaatacaatatgattaatctctcaacaacattcaaattgttacattgtaagcatggtcatttttcgattgggctggaaacctggaaggcagcaaaaattaaactccccatcttaacaaacttgaaccggatattagtaaaaaaaaaagttacagaaacgtttgtggtttaattaaatgaattgtggtcattcttcgtctgattggaccggatggtctacagcaaaatttaattacataggtagatagataagttgtaatcagattagtattaattcaactgtgatgtatgcacctagctcatgatcgagtcatgtcatattggacggatttctacggctcaaaggcatacgtaatttctgttactgatatgtggtactccctccggttgtaaaaattaaaattgacgccgtcgatcgacttttaacatgatattcaaacgtaactatttgatttttatgaccagtaaaataaatagtaattaccataaatagtaattacctttttttaacaagatgcatgatcaaaacgtaatgactaaagttaactgtgtcaaatatgtatgaacagaagaaacacttactaaatacagtagtatggaagcatattgagtagctagccagcagcacactgaacatacacacagcatacagatagctagagtacaacacaaaaaacagtctccggctagtacaattatacaacacaatactagctagctagctacccacatgtgtatatactatatagtacattagcaacttcatttttccttgaagcaggaaagccggtactactggtttacacttcttcggcagttgaaaaaaaaataacaaaactatagaatcacgagcactcattaccacaaattatttggcggccttccgtgattatttcttctgaataataacttaacttaactgaaccaacgaacgcttgtagaatttgagtacgtacgaattaagtatgtgccaacatgcatgcatgcgtgcacatgcagagttgcagtagatatcgatggagtcgatcgagatgcagaacggagaggagacatcgacgaattgaattgaagcaatttaggaatctatcaggctcagtcgaatccgaacctacggtccatatagccgccgacggcttggaacgtcggaccgaagagcccgtttcgtcctcctccgccgccgccgttgtctctcctctcgccggagttctcgttctgcgacgacgacgaccctggctgcgtcatgtagatgacgttgaggtacgtcggcgccgaccctgagccaccctcctgccgcggcggcgccggcgcaccccagccggaattagagccatagccataggaggcaggggcgctgccgccgccgcctccggctacgatggcgccgccgttaccataggaagagccgccgtagccgccgccgttgccgtaggtagagccgccgtagccgccgccgttgccgtaggaagggccgccgtagccgccgccgttgttgtaggggttgtagccgctgggggcgctgctgctgtagccctcgttgttgccgtagccgccgtagttgctgtagctccggtctctctcgccgccgtcgtcgtcgtacttgtagctgctgctgctgctgctgctcttcttcttgttgctcttctttcccctgcgcctgttccggtcgccgtggtcgtcgtcgtcgtcgctgccgctgccgctgcggttgtcgtcgtcgctggtgtacctcgggtactcctcggacgtcgtccacggcgagcggccgttgccgctgccggctcgtccgtaccggtcgtctcctcctcctccggcgaacgacgagctgtcagagccagcgtagtactggctgctgctgctgctgcttttgccgctggatttcttccaccaggacatcgcctctcgacttcttgattgaacttaacttaaattaattatggtcccagctactgatcgagctagctagcatgtaattaacgatttactgattagcagcaagatatgatgcagtaaataaactcgaatgagaaattttttttgaataactcaagctgaattagcatgcatgcatactaacccgacagtagatgatcagatgataggccagataagcgcagatactcacaagagagatgcctctaaaaacttgatcttatagaagctcaaagacatcgatcagatcaaagtctcgtcaacttcaatataaaatagggcactttttaatttaatcatcacctaatgagacctaaacttcccaccaacagcagttacgcgtggatatatcagagataaaatgagacccaaggcggctgtgccctgattatgatccaaatctagggttccaaaattattagactacgagtccacttgcgaagtatggcatcacatctgacgtgtagacttgcatatgcaaaacacttgagctaaaccaaccaatccctacacgcttaattgcactgcgcactgcgtagatttttggtggtcagggcaacgaattttcgcaatcagaaaagcgaaacgaattaaagagttaactaatacaaatttagaagtagactttgtcacaggaaacatctatgaaagttcatatatatgaaataatgaaaacgttatgcatgcgacaaagagtttaacttagtctgactgaatactgtatatatccagaattgaatttgaatcacatcttttgataaagatatatatgtcgctatagcttgagagataatccccagttagcagtagcaattagcaattactagacggaaggcagtacagcgacacacacacacacacacatacatatatacataatatatatatatatatatatatatatatatatatatatatatacatacatatatatatatatatatatatatatatatatatatatatatatatatgcagttttaatttacatgcacgttcactgttgtgtcaatctggtaaaagtgattaatctcagctagctggatccaagtaattaattgttacatatgcaaggtcatttttcaacagggtataaaaaacggtggcatttggctgttaattttggccggaaacctggaaggtagcagacactatccttaattaacaaacttgatctagctgcaagtagtaaaaaaaaatgcagatatgtactgtagtcaatgagttgtagtcaatatcttagtctgattaattaattggaatggcccatatatatgggacaattacgttcttccttttttttaaaaaaaaagaaatttcggtcatgattttaatttaccactggttttttaattttatgattttcctatcatttttaactaataatttcacacatgcccttgcattttatcatgacttttgcccctttttttaatatgaattcaatttttaaatgaaaatgtgaggacaagctagcataagcttgaaatgaattttaacaccattaagtcattttaatgaaatgacaggaacaagcttcagtcaaaaaatgagagcaaagttacaaagttggaaaagtgggtaaaatcataattggaagtctcaacagaggtaaccataaatgcctattaaatatacactgattgtctagaacgaaaacactatgtaagatgtaattagttttagcattaatatatagtttgtggttttttttatcacatgtatatagtttgtggttgatgtaatgtgatgataatcatactagcttaaattaggttgtataaaaaaatttcaagcgctgcttgcacttggcctcatcaatcatatctaacattggacgaaataatactataaccgttgtccttggtaaaactacaaatcactggacggcatattcaagcagagacaaaatttggcatatagcaaggtgtgctttaacagcataggatcggactaaaagtccatttatgatcagaacttatgaagaaaattaaaaattgcaggcttggctgcgctcggccctgcagtcccccattttatgatctggagtaacttttagtgtatatttaaattagaagaaattacacttgaatttaattacaaactgattaattacaatatgatgcaatcacacatacatacattaactgagcacaaacatacgtatatatatatacgcatgccgtacacacatacttatgcacacagtgtcacatatatatctcacacagtacatgaatatatacagagtacagtacatgaaacaaaccgacactgcagtcggaaaaaaagaaagaaaaaataaataaaaataaagccaattaaccacaaacacatacatacacgttgcggccgtatgcagatgcaaagaagaaatacttattagaagcgagcaattaataattacgtatacgcacgtaaatacggtcgtacgtatactagagctcgcagacggtacgtacgtacgtatactgatagtctgatgtacgtatatatgcatgtgataatagtacaagtttcgtgttaattacgcgcgtcaccgattaattagtataattaattaattagtcgctgctgtggaagccgaaccttctgtcgaagaaatggccgacggcctcgaacgccgggcggaagaacccgccgctgcgccgcctctcgccgctgccgccgccgccgccgtagccgtcgccgccgtcgtacggcccatgcggccccccgtacacgtggacctcgcgagtgttgatgtacagcggcgacctcgcgccgttctggggagtccagtacccggccggcacgccgccgccgccgccgtacggcacggatccaccaccggtgtaacctccgccgccgccaccgccgtagtacggagtaccgacgccggcgccgtagagggtgacgctgccggcgttgtagccgccgttgtaaccgtaaccaccaccaccaccgtagttagcgccggcgttggccttggtgctgccgccgtagccgccgccggatgctgcgtagccgacgacggcggcggtggcggcgtcgtcgttcctgccgctggtcttcttcaggcgcgacggcggcggcggctggcgcttcgccgacgtcttgtcgccggcggcggccgcttcatactgctgctgctgctgctgctgctgccgtcctcctgatccgtaggtgtcagtggaggaattggagtagctgctgccgctgaaggatctaccgctgctgttccacatacctatccagcggtcgatcgaacaaattaagctaataaaattgcacgtacatgtcaagaatattcagagattcgatcgttgcgttgttttatatatagtatatatatttggtggctgcagctaatacatgtaattagtatgtgatatattgcattcagctgacggtatacatgaacggatttgcaaacgaattaaagaaccaattatcatatactcctataacggatacttcagatatattcagaagtattcttgaattattgatcagctagagtttaatgaactgtgtctgacgaatttgattatgtcgatctggttagctagtggttgatggatgaactgtgcctgatatggtagttcttcaagcttgcatggatgaacataatccgctagaacagtaaaaagtgaaaaagaaacataaaacaaagtaaaaggaggatcatagataagatacctttaatttgtggaggagatgacacttaattggatccggtataaggcaccctctgcagttgccaaggggcgttctatatagagctagtacactcaagtcaaccacacttcgagtctccggttttgcaataaaaaaaagaagacacttgtcgtcttagctatagagaaaaagcttcaaattatctgcgtcatatttgaatgccacccacaatgattaccatattttgtgttaatgtaaccgggggcgaatttactgttggggctccaattgaacaggtaacaatgtgttagagcaagcaggaacaacagtttgcagtagaggagcaagtaagaaagaaactgaccaactggtttgctacgatgaagccggccaagcttcatagcttcagattttatccaatcaggtctggtagcatatagggtataggcgatagtaaaatatgaatatcaataatttaggctttaggtataaacttacaactaatttattctttattattaacactacaaatcattttactttcatttttggtgtttcagtactaatttgaaattttatgagcgttaaatttgtgttatggattgcgacctaagagccccaactcgattttcattctacattcgccactgaatataactaaagttaaaattaattaacacatattaattctgccaatgaatgattgatcttcttaattatatgatcatttaacagttaatattcgccactaacaatgatcaagtaatgatagattcatgatttgtgcgtgtgtgtactgacactgttcacccagctagctaattaattactctcaccagaaaaaaaaattaaccctcgtggtaattaatctctgcaccaagcgagaacctttgatcagaaattaatgaaaccaacaacggtcagatcaagctaggtctcatactgtacttagaaagtagaaaatgtgtcacgatctagtatacgcaaggctgacttctagggatatacgtgtgcttgcgagttgcaagcagccaagaggacgtatgaactgtatcatttcatgaaacagccaatccctaactagtcactgcattaattaattaaataattacagacagtagtctgcactagtgcagagagctcagatcaattgcgattatactccctcagtactcattaaaaaaatcgtttagaacaacgtttaagtcaaaccttaaaaatataaattatgaataactcttaagttgttgagtttgaaaatataaaaaatatataaatagatttgtcttgaaaaataatttcataaaaatataaatatatcattttttttaataaatatttttatataaataaaaagtcaaaattatattttggagaccgtatcactatccaaaacaatttcctttaccggagggatcgagtacagcgagagctgtggacttctcagacacgcatgcattaaaccgtgtgcacgtacgcaatttcggcagcctctctctctctctctctctgtagagtaagctaaacagtgacactgaaagagccatcaaaattaaatccatgccacatcagtctgatctggattactttagaggttagagctacattttcacaaccatatatttcatgatcgatcagatcgaccggtctagctaatgaacgcccatagctcacttaagtacctaacctggcttaatttgtagctttaattaattaacgtgcacttgcatgtactgtctgaatttaacaattaatgtggtaaatgatttcaattggcatgcaggcagctcgaatggtgtgtatgataataaaatgttgacaggaacagatactatagtgttaattaacccatgatcttgagcgtgaagttagtagcaaatcctggcttgtctctacaacctcttgcatctagctaacttggttcacacgtcaaaccaagtcgatagatccatgctcgattgacccttgacttgaaccaaattttattcagaaaagtagatgaaattacctgctagcgattgctacgtgccaaaatgacaattttagtatagtagcgacatttatattattatcgcaacctttctataaaattaaacgtaatctctccgttctttcattcgttaaaccctggtcaaagttggattatcgtcatgatacgttaagctaagtagatgaccataaccatttcattaaaacccaactaattgatattattgatctctccgatataagcaagtttaaaacgtttctaaactgtacgattacttgtttctttatttctagctagaaagttcgatggatcaactacctaatattgggatattcatggccactgtatattatattcaga

SEQ ID NO: 64611 - DNA, 12927 bp, Oryza sativa
ttacattgtgaaacggagggagtaggctatatcaaaaaacactcccaagacaactgtatggagtgtaggatcataacatgcgtgattgtgtgcaatatattttggcatgacaattttttttgaggggaaatatgggaataacaaagtctttgatgacaaaattaattatttactatcgctttttatccactttcaatcattttcttcaggctcactcaataccaccaattaaaagtctgaaaaatatcctcaatctaaaaacttcgaccaagtcctagtagttaatcttggaatataaatccaaatcagaacttcagaagtataccttggcttcaagtggctcgcgacgaggtggcaccgtggcaccggccaccgggagcttggcgccacgacttgtaaccccgtgagggccgccgtcttcccccctcagccggctgccgtggcgtccgccgctacttctccaaatgcttcagccgagagcgattccccctaggctggcaaacttcctgtcgatgccgtctgctccctcgcgtggcagcacccgcgttgacgccacccgacgcgggctcgccggccatggccatggccgcagccactcgctctcctcccgccgcgcggcgccgctcccgtgccgccggcggccgccgccgcacgggattgggtcaaatcaggccgcatgtacgggagactcctggtccaatgggctagtgggccgtactgagttattgaggcccataaatacgaggccccagacggctcaaggcctaccaggtcggcacataaaacgagaaagtcattagtttaagattagtcaagttttaattactagtatgaattagaaaattaaatttatttgtggttttagaaaaacctttgtatagaaagttttctcataaaacatatccttaagcagtttcgaaacgtaatagtgaaaatcgagatagaatctacatcttaatcggaaaataacagggttcacgcgggctttttgaatgaggcgagatgttaatcagatgatcactacgctccttgcttttctgcgcgatatgattctgaaccacttaagtacagtagtactagcatttagcacgacttcacggatctttagctaggtcaaacgaagtttaataaagctatcgtcactttaccagcagttttcaacagcacgactatgatagggatgtgttgtggacttatcactttgatgaattatggtttccttttcttggggtcgagggcaacagtatccctcacttatgtttccattcatctctcttttgaccattgccatgaagatgctttaccctggctatcacgacggagagtacaccatgcatgttatatgcagtcacgaatcatccatgattccatggacagccaatcttctttgcagtttgcattaccatgcaactcacccatatggattcatctagctagtcaatcatgggatattactgtactacctccgtctcagaaagatcatagtttcacgttatttatgttcaacgtttcaccgttcgtattatttaaaaaattaaaatttttaaataagatagtcaaacgttagagacgagaatccacggctgcatttaaactggtacggagggacggaggtggcaggaagtaggaacgcacttgcagtcttcctatgcggcggggcactactagttcctagattccgtatatggctatgtttagttcagcgtaaagtttatattttggttaaaattagagatgatatgactgaaaagttatgtgtgtatgacaggttgatgtgatggaaaagtactgaagtttggatccaaaatttagattaagcacagcctatgtatggtgctcgtgagtcgtgagacactgaggccggccggcgtacgtgctccctgcacagcggccgtgaacaattttccaaggagatgcaaggaaaaaaagaatcaacagttatggaagcagcaaccaccaacattttctaccgtcccgtcatcttcttctccgtgctcctttgtttccaataccgtgccgccggcgttgcatcggacacgctcagcaatggccgcaacctcactgatggcgacacgctcgtgtcagccaatggctccttcactctggggttcttctcacccggcttgccaagcaggagatacctcgcgatatggttctccgagtcggcggacgccgtctgggtggccaaccgcgacagcccactgaacgacaccgccggcgtagtggttatcgatggcacgggcgggctcgtcctgctcgacggcgccgccggccaggccgcctggtcgtcgaacacgactggctcgtctccatcggtggcggtgcagctgctcgagtctgggaacctcgtcgtgcgcgaccagggcagcggcgacgtgctgtggcagtcgttcgacaacccgtcgaacaccctgatcgccggcatgaggctcggcaggaacccacggaccggcgccgagtggtccctcacgtcgtggcgcgcgcccgacgacccggcgacggggggctgccgccgcgtgatggacacgagagggctagcggactgcgtctcgtggtgcggcgccggcaagaagtaccgcacggggccatggaacgggctgtggttcagcggtgtcccggagatggcatcgtactcgtccatgttcgcgaaccaggtggtggtcaagcccgacgagatcgcctacgtcttcaccgccgccaccgccgcggcccccttctcccgcctcgtgctgagtgaggccggcgtgatccagcgcctcgtgtgggatcccagcagcaaggggtggaacacgttcgcgcaggcgccgcgcgacgtatgcgacgactacgccaagtgcggcgcgttcgggctgtgcaacgtgaacaccgcgtcgacgctcttctgcagctgcatggcggggttcagcccgatgttcccctcccagtggtccatgagggagacctccggtggttgccggaggaacgcgccgctggagtgcggcaacgggagcaccacggacgggttcgtgccggtgcgcggcgtgaagctccccgacacggacaacgccacggtggacacgggcgccacgcttgacgagtgcagggcgaggtgcttcgccaactgttcctgcgtcgcctacgccgccgcggacatccgaggcgccggcggcggcagcggatgcgtgatgtggacgggtgacgtcattgacgttcggtatgtcgacaaagggcaggatctctatttgaggctggcaaagcctgaactaggtacaacactgaaactaatgtgttcgagctaatgtgttcttgaggaggtaccataaggtaccactttttctattgtaaatttggtaccttttggtaactaggtactataaggtaccaaattttacactaaatttttgatacctcatgataccttcttaaggaccgtagaattgctcaatgtgtttggcaatggttaattacatatatatttccttcgctgtaaaatatcctagtactcggttaaacatcgcctagtactcgattagagtctataatatttgtgatgtctgattgagtactacgttactatattttagcgtggaggaagtactaattattttggtgaaatatttcttttcgcagttaacaataagaagaggactgtgataaaagttctgctcccagttacagcagcatgtttgcttctgctgatgagcatgttccttgtgtggttacgcaagtgcagaggtagataccgagccacctcacttctcagttctcacagcttatctaattaagaataatactactattaatattaaaatacacgatattgatattcctgtcaggcaaacgtcagaataaggttgtccagaaaaggatgctaggatacttgagtgcattaaatgaacttggtgatgaaaatttagaactcccgtttgtcagttttggagacattgctgctgcaacaaataatttttctgacgacaacatgctcggacaaggtggcttcggaaaggtttataaggtagcccacaaaaactgtattgaaaactacagtaggacaaaactatcgcacaatattcttcaattttagagcatattttttaggagtattacagaagaagtgccacaattagtactccctccgtccaaaaatataagagattttgggtgtcacatctacccaaaatcccttataccataggacggagggagtagtttactactgaaaagtgaaaacagtgataccatatgaaaatcccaattatggatgatgaactttatttttaaaaaagggagaaccgacaagaaacatggtgttaaataattaagaagaatgtgtgagcgtgttaagaatcgaataaggaaccttggggtcgaaaccacgtcccttatattgcggtaaaaagtgcatctcgagatgaactttcttaataaaaaaattaattgattaaattgtgtagggcatgctgggtgataacaaagaagtggcaattaaaaggcttagcaagggttctggacaaggagtagaagagttcagaaatgaagttgttctaattgccaaattgcagcacaggaacctcgttaaacttcttggctgttgcatacatggagatgagaagctgctaatttatgaatacttgccaaacaaaagcttggaagctttcattttcggtactgttcaaaaacataccatgcgatccaataaacttcactccatgcttactgatagagaaattttattgttcttgaaaaagtatctcaagatacctaaattttacactaaaatttttggtaccttgagatatttagtatctgaaggtaccaaaatttacaataaacaatgtgatacttaccagtactttctcaaagatgataaaattatccttactataagaacattgtataccattcttgatagatcctgcaagtaagtatgctcttgattggccaacaaggtttaagataatcaaaggagtagctagaggacttctttatctccaccaagactcaaggttgacaataattcatagagatctcaaatcaagcaacatcttgttggatgtggatatgagccctaagatatctgattttggtatggcaagaatcttcggtggcaaccagcaagaagccaatactaaccgagttgttggaacatagtgagtgatccaggaatttgttttttactattacattgatttcctgaaaaatcctttgttacttattactaaaactgttaagcagtggttacatgtctcctgaatatgcaatggatggcgccttttcagtcaagtccgacacatatagctatggtgttatactcttggagattgtaagtggtctgaagattagcttacctcggctgatggactttcccaacctattagcttatgtaagtaccatggaatgctctatgtccataaaaattcaaaataactataccgcttttatatggactgatctatttcactgtttaggcatggagcttatggaaggatgacaaggccatggatttggtggattcatccattgctgagagttgctcaaaaatggaagttttactatgtatccacatagggctgttgtgcgtgcaagataatccaaataataggccacccatgtcttctgttgttttcatgttagagaatgaagctgcagcgcttccagctccaatacaacctgtgtattttgcacatagggcctctggagccaaacaatcaggaggaaataccagcagctctaataataacatgagcctcacggtattagaaggacggtagatttactttttgcacgcaaaggcacaaagcgtttcctttggacaagtcctgtaatcggattgtggatttccataaaattaatagaaacaagagacatatactccctccatcccaaaacatttgacgccgttgacttttttaaaaatgtttgaccgttcgtcttattcaaaaaaattaagtaattattaattcttttcatatcatttgatttattattaaatatactattatgtatacatatagttttatacatttcacaaaagtttttgaataagacgaacggtcaaacatgtttagaaaagtcaacggcgtcaaacatttagggaaggagagagtattaacattacactaactagaatatgtggaatatgtggttctcccaagattgtgtgttgtacaaaagaatatttcaacatcctttcaggatcagtttcgtcaaataactgctagtaagttggatgttttagtgtttcaagaagtcggaagttctacaccaggttatacgtaccaaaaaggaggaatgcacggtgaacatgcataggagtaattaatcttaaggagctagagtaggatcataacatatatgccatataattatattctacaaaatttattattctaagtttctaacaaatcttaacaaattccttagtacacaaactttgatcccattgtactggaaacgagtttccttttttattttcccaaagattatagctgatcttgaaatagaattcgaaatcgaaattagcaatacctggcttggatggggctcgcgacgtcgcgtcgtgtcgaggtggcaccgcgaacttgtgtcaccgccgcacaagcatgtgacacccgtgagcggccggaacagtgcaggttaggctcgccgtgtcttccgcctcatcagccggctgccatggccgctaatccgtccccctccctactgcctcagccgagcgcttcttctgtcctctccctaggcggcaatggcatgatgcaacccctccggcctccatctcgcgcgcgctgcattgggagcggcggacgccgggcgtcggggcacttggacgtgcgggccgagccgccctccgccggttcactgcccctgttcgacggatggctccgcggcacccgcgcccgctcgccggttgacgtggcgcctccgtgccggggcagccgacgtcacttgggtcttccaccggccaccgcctcagccctcatccaagcgcttccctctcctgatctcctccgctacctcgccgagcgggagtgcgggacaatggggttggacgcggcgacccaacgctgggtcaccggctcactgcccgaccctactcagctcggctcaccgctctgccggtctccagcactcacggctcatcgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgtcaacgaaatttgcaggcggcccccttgccgccctccgcgagggcgattttctactgtgcggggggccgcctgcaaatgggcggcgaggggggcatggaattttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatacatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggaacgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaacgaggtcctgctccgacggtaggaccgcgaggccgtgggtgtaccggaccagcagaaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtcgcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacagttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattacgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgaacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcaccctctttgttcgatcttcaaccgatgtaaatgtatgtaggtcatagtaagtattattattcctctgggggctgcag

SEQ ID NO: 64612 - DNA, 24371 bp, Oryza sativa
tctcccctcgtctcgtgcaaccacccggtgtgctcgctttgctggtatccccgtggttcgctcggcggctcgccgctgtcgaccaccgtccgttccggccggcgtcgtcgtctacctcccgccggcccgcgtgggagccacgtaggcgccacgtcggcaccagctcagccgaggtcgggacgggccgaccccggtcagccccttcccgtgcgcgcgttccaccgcgagccgtgaggctgcgcgtgggcccccccgcacccgcgtccaccgcgaaccgcgcgcgtgcaccgagtccttccccccaccctagcgccgcgtcgcgtgctccctccgcacggtgagccaagccgctgacaagcgggtcccacctgagaccgcgcgtggtgagcccggtccaccggctctctctctcctccctcccgcgcgcgcgcgtcttgggccgttctgggccgccttcttgggccggccggcccgttaagctcggccgagccgccccttttctctcgggccgcgccctagccgcccgagaaaagtctataatccctccctcttttcttttcttttctttttcttttccaaaaaggatttaattaaatccttttcctttagaccaaaaatccaataatcttagaaattcaatatcttcccatccgtaaatccgtttgacaccgttcaacttccaaaattcctcaaaactcgagatctatctaatggcacgcttagaggtcattaatagggctttattttcgccgtttgttgagttgtcccgtttcgcgtgtagtttcggagcccgaagacccgcagtgcgaggatttcgaggatcaagcttcagatctcgagcaaggcaagccacctttgaacatcttgagcctatatttgaaatttaattatattgcttgcaaaatattatgcattgataggatcgcacttgatctgcttgtcccgtctgcaaggcagattggcggacctacctaattttgttgcatttgatcctccctttgttaattgcgataccatgtccccttgtaaccatctagttgcgtctcgatattcgtgcaccctgcgcgagtatcgacggacgccttcaaacttaaaatctgagtaacaacttgggtaaaaacttgggttttgcaaaagacttggaaaacccgacacctgggtcggtgcttgcgaactaaatgaatttccaaaaccgcggaccggggaacataccgggtgtacggtttcccgttcttgcacttaaggaccgtttccttggaatttcatccaaacataagacaagtacgaccatatgggtggaatgggacacccctggctgagtaactagcttatcaggggtgccttgatgccgagagacatgtggattcgccggggtggtgtcggggaggacccctgggctttctggcacagtatggtctgggacctaacctgttggtggtctgggacccctctcgacggcatatgggaaacctgtgtcagctttggaaataccttgtcatgaaagcttggaggtctcccgacgtggctgatccccaccggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttggggaaaggagttcgatgtttgaaaaatctgcagctgatgggatcagctaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgttcgcagcccaacatgactgtacctctactctataataaagagacctctgttgctgtgatattctgtcttcctgtgataccagcactgtatcctgggactggtatcgattaacaggttaatttggagcgtcacgggctagttccggtcggggctagttcggggcgtgacagattggaaggcacatatgtgcgtatatttagttgcagcagttttagtgggccatgcgcatagaagtccagcttgtcccacgatgccacgtccttgtcctaggtggaacagccacatcatctcgcgtgtgaattcattcattgatagtgtagttttgtgaaactacactatcaaaatatatgtacttaagtgccaaatgtcaaagtgtgtgtagttttctgcaacttggaccacaaaacgtgtagttttgtgaaatttactctttattttaacgtaactccagggtctttgactctgtgctctcttcggtcttagtggttctagagtccatcctttcggagggccggctgtggtcgttagcggccgtcgcttcctttggggaattgttgggagcgtagagtggctctgccctctcccgctgtttggagtagagttaccgttgtatcgagttcttttttcctttccttccttgttttttttatctttgtttttcttccttccttggcataggccgatctggctgagtgcgtcgtgtaacaaaaactctattcttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatatttaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggcgttaggcataatgggttgtggtatctggatagaagagggacggacaaagcactatgtagtgctttgttagctagcacaagtgaagaggaggctaaattgattctaaaacattgtcaattgggacatatgtcctttgatactatgtctaaggtatttcctgatgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgttcactcatgtatacgatgaatgtaccaaagtttctatggagtgaggcagtcatgacagcaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggatcatcaggtactgaagaagacacataatcaagaagcatgaaatttgtggttggctcaatcccatatcctgttagtgaacccattcatgagcaaaattggagaaggccatgtgaagaagaaaatctacaagtttatactaggaggaaaacaaggtctttggaggcgcaaacaatagggcaacatgagtctcctatggatgggatggagcagcaacaatcttcaattgttgctgaagtaggtgataaaccatctgatcagtgtgatactatacagatttcatcggatacggaaggagaggagtttgaaacagggggagaagaaactaatcttcctattgctataagaaagggggtaagaagcaatgcaggtaaacctccacaaaagtatggttttgaagctcaaggtgtgaatgatgatgagaataacatagccaattatgtctcttatgcttctttgtcatccacatataaggcctttgtgacatcactaaattcagtggaaattccaaatgattggagggaaaaaaagcaagacccaaggtggcatcaagctatgctagaggagctagaggctcttgaaaagaacaaaacatgggaccttgtaccattccctaaagggaagaaagtggttaactgtaaatgggtttatacagtaaagcaaaatcctgatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaagatctgggccaattaaaatattttttgggtattgaaattgcaagatctccttgaggaatagttctttcacagcgaaagtatgtattggatctgctcagtgatacaggtatgcttggatgtcggccagcttctacaccaattgaacaaaatcataagttatgtgctgaatctggagatccagttaataaagagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgatatgaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttctagaggaaaaatcacaaaactacactcactaggatatcataatgaaaaggagaaaaaaatgtttatgccactacccaatagtagagattagtgaatgcacacttttcatatgtaccataatttttgcaacctctcatatttgccactaacaagtaacaagtgcatggctttttggggcaaattcacacatggtaatggataagagattgtaaaagttagttgtgtatgtgagaagtgtgtccaagttattgacatacacaaattttttttgtttgattaaatacaatttctttgtctcgcttgttcttggcacagaaacttatggattctccttttgatcataacaatgcaatttaaggagcactaggtgtccacctagctggtatggttaggtgcagtgattcaaagggccctagttgtagcatatagcacaaaatgatcacaataatgcccgatgttgatagtggattctagtactctttatataaaatcaccagagttggtgtttagtagccaaatggcaattaaccatttggttcgtatttagtagtggccactatccactagtacagtttaaatatagatactaagcagctggttcttctatctgttccaagtttggttaaatgtcctgatgagtgttgattttgtatctcaaacatgtttttttccaggacatcttgcatcatgtatattctcttatgccattgaaagatgctgctcgtgctgcttgtgtgtcacatggatttctacgttgctggagacgctatccaatccttatattaaataacaaaacgataggtttgattaagagaaaactcagtttggatgacatggaaagctatgctgtcagtaaaattgaccatattattaagagccattctggcattggggtgaaagtgcttaaacttcaactgttcgcctgtccgaatataagtgcagctgttcttgacaaatggtttgtaaccgttatcaaacctgggatcgaagaactctccttggagatgtctttcattgaaaaaacggacagaatacaacttcccatgttccgttctatccaataaggcagagggatggacaattcagtcacttttcctctcctcctgtgcttttcatcctacggtgactcttggttgcaacataagcttgacaagcttgcatctatgtaaagtcgatatttgtggggaggagttagggcagttcctttccaattcattctctttggagcgattggtaatttctgaatgcagtgatatagtccagtttaaggtaccttgcctgatgcaacagctcaagtacctcgaggttacaaaatgtcaaatgctacaagtgatagagatagatgctcccaaactctccacttttatctatggggatgttggagttaaaatctctcttggagatccactgcaggtcaaggacatacgtctgatgggttacaatgaagccgacaccgtctgttatgctcgtaccaagcttccatccattttgccaaatattgaatcacttgtcgtgtcatctcctaatgaggtatgcattattgttttctttgtgccatccagttgctttataactacaattaattacatgctggtgatatgcatgtcacacgtgcacatgaaacacgactaaaattcctgaggcatctcttcttcttctctttcagatgaccagtacgccagtggtgcccagcaagttcctccacctcaagttcttggagatttatcttaaagaattatttgcctcacttcccagctatgatttcttttctctggtttctttcttggatgcttcccctgccttggagactttcatcttgcacgtatgccactttctcaatgttgcataccgcaaatcataaaagttcagttaatgcttgcagtttgggcctttgggggcttctactcttagcaaatttggcaggataattaattcggtatagttcgttgtagatatttttaatatagtttctcacaatatataatagatagtagaaatagtttagtacttaaatacgcactagtaagacaaccaaatagagaacatctgtggtgcttcacaagccaacagcagcaattcagtttgggcttttctcatgataaaatattttaagcttctataatcattattagtgactgtacttgatgaggagtatgtgaccaagttttaatgagtaactactactattcctatgcaggtagagcagcagttcgaaaggcatgattcgattcttgatggagaacctacggatttgaggcgaattctgcacgacggacatgccaacctccagaatgtgacgatcaccggcttcaattctacaaagagcatgattgagctaacaactcacattcttgagaatgcaccatcgctcaagtgcattacgctggatacagccaacttctctggcaagaaccatttggcgatgggcgaatgctctcctatgatgagaggagggatcttggaagcacgaagagctttcgaggcagccagaagacacatcgcggggaaaataccctcctttgtcgagtataagtttctggaaccctgcaggcattgtcattttgggtactgacacaatacatctcaagaagtccagatagcgtttcttcagaggagaaattcaagtgtagaaatctatattgacgctcaatcctttttgcttgttcgcaaaaaagaaaaatcgaatgtagaaatgtaaaaatgcacagcagtacagcacaaccaagtaaagaacaagtatggtattttgggggacattcttgcattcagaagccaagagcaatatttttgtgctagaattgtttttagtttagtgtcaaaagcagtagctttatctggttttattagtataacataaaagaaatgaaattagtgactaaaggtcatacagattacagagtagctgccatcgctcatcgctggttgcaatcgcaaagcttcgacaaagccatggccgtcgaccgtcgtatcgctgagttcgtctctgacgagtgagttactgggccgaatagagagcccattgaaaagcaaggcccacattgcattctggttatatcatagattttaaatagaaaatttttgcacagaacatattatataacggtttgaaaatgtgctgttggaaactttaaaacaagaaagttatagtttgaaagtaaagtttaaactcgtccaataagtattcaaagttattttggtagtcgagaattgtgatgttatttcattcttttattctattattactttcgttctaaaatattattattattttatttttattggatgataacatataaatacttctgtaactatttttttaataaaattttcaaataaaacgaagaaccaaacattaagtaaagaaaataaaaataaatttattttgtaacaaatgtactttctctgtttcacaatgtaagccattctagcattttccatatttatattgatactaattaatctagataaaaaaatattaattttatttagatttattagtattactataaatatgaaaaataaatgacttacgttttgaaacgggggagtaactgagaaagtagccatcgaactgtgagtctgaggtgtcctcaccaacttccttcatcatccccttcccatcgccgcggttctccacgctccactgcggtggactgcgccgcatgtagcgccggggagctccacagtccaccccggcccgcgcccgcgccctctcgagttcccacacgagctccgccgccgacggctctcgaggcaggcaggcaggcagcgccgccgatctcggttgccgccgtgtggagcgccccccgggattttcattctcagcagtacaagaggcggccggattcgccgccgtttgaggtaatctcgcgcgccggcgacgtccggatcgcctttcctggctggcgtctggagtatgtagactgcaagggggaatcggaagcggccgggcggagccatggagacccgtgccaccgagtgcaggacgatgcagctcctccgtgagcttcaaacaagtatatgcttcccccgccccctcagctttcgatccaccttcctatacagagatcgtcgttggattctaccgctatcgtttattgcatacttattactacctccatattttaatattttaatgtatgacgcagttgactttttatccaacgtttgaccattcgtcttatttaaaaaaattatgtaattattatttattttattgtgacttgattcatcatcaaatgttctttaagcatgacataaatatttttatatttgtacaaaaattttgaataaaacgaatggtcaaacgttggtcaaaaagttaacagcgtcatacattaaaaaatacggagggattatgttttagaagaaaaactgctcttaggctcctccttaacctgattggttcttcagctagcttataataaagtgcaatttagacaggggaatttttaactcttatctggtctagtgctcaaatcttcaccttattttggtttatgcaaattagtggttcttgtctgtaagccttgaattgcattagcaaattcattctctaaccttttgtttctatctctatctctagacaaattggacacatcttcaaagataatttacgctccacggcagcaagatgatatttatgcgggcataatgccagaactcccgctcgataaacttccggaggtatggattgctaataatgtcatagtctgttaactactacagtatcattgaaactgctatgttttggtgtgcttggattgtaatattttttttctcaaggggtagattgtaggaatcggtgttaaacaacaatgttttagcaaactatctcaatgaggtttcagaatgttgtgcataaattgaattcgaatgcactgttactttttaatgtttggctttctctgcacattgtctactactccatgctccaaaattatcattgttgtggtcttttcaaaactactagcagaacaattaactattaccagattacttctgtagcattagctaatttgttatctcccgatatgagctttacctatcatgaagatgacctgtgatgctattttttgtggattgatgacatataaggactaaggagtaccgtgtgttatgaagtttggttaaatgtcccaatgagaaaaatgtatatccacttataagtcttttggtaccgcatatagggaaatttaagaaaaagcacttgacctgttggccactgtccactagtaacaatttaagtatattttactaagcagctggtccttctgtttgttctaagtgaagtgtgcattgctagtactctctgaatgctgaattattcaaacatgtttttttccaggatatcttgcatcatgtatattctctaatgccattgaaagatgccgctcgtgctgcttgtgtgtcgcatggatttctacgttgctggagacgctatccaatccttgtattaaatagcaaaacaataggtttggctaagagaaaacttagtttgtatgcggaagatgtgccattgtatgagccagcgcttaaagtggatgacatggaaagctatgccatcagtaaaattgaccatattattaataaccactctggcattggggtcaaagtgtttaaacttcaactgtttgcctgtccgaacatagatgcagctgttcttgacaaatggtttgtacatgttatcaaagctgggatcaaagaactctccttggagatgtctttatgcaaaaaaaggacagaatacaacttcccatgttccattctatcaagtaaggcaggtggagggacaattcagtcacttttcctctcctcttgttcttttcatcctacagtggctctaggttgcaacataagcttgacaagcttacatttatatgaagttcatatttctggggaggagatagggcagttcctttccaattcattcgctttggagagattggtaatttctgattgcaatgacataatccagtttaaggtaccttgcctgatgcagcagctcaagtacctccaggtgacaaaatgtgaaatgctagaggtgatatcgatagatgctcccaaactctcctcttttatctatggggatgtcggaatacaaatctctcttggagatccactgcaagtcaaagacatacgtctgatgggttacaaccaacccaacacagtctgttttgctcgtactgagcttccatccattatgccaaatgttgaatcacttattgtgtcatctactgatgaggtatgcattattgttttctatgcactatccagttgctttgtaactacaattaattacaggctggtcatatgcatgtcataggtgcacatgaaacatatgattaatcctaagtcatctcttcttttctttcagatgatcagtacaccaatggtgcccatcaagttcctccacctcaagttattggaaatttatcttgctgaattactggcttttcctcccaactatgatttcttttctctggtttctttcttggatggttcccctgccttggagactttcatcttgcatgtatgtcactttggcataaaaattcagttgatgcttgtagtttggggacttctgcaaatttggcaggataaattggtttagtttgctgtagttattcttcatatggtttctctcaacagattatagataggggctgaatcagcagtttagcacttaaatacgcactaaggcaaccaattagaaaagccctgtggtgcttcatgggtattattgcactagaagccaacagcaccaattcagtgtgggcttatcatgataaattgttttaagcttatatattcatcactagtgatcgcacttgctgaggaggatatgaccaaggtttactgagcaactattatcctttgcaggtaaagcagcgatgtgaaaggcgtgattcgattcttgatggagaacatacaaatttgaggcaaattctgcaccccagacatgccaacctccagaatgtgacaatcactggctttaactctacaaagagcatgattgagctaacaagtcacattcttgagaatgcaccatcgcttaagtgcattacgctggatacagccaacttctatgataagaaccttttgacgatgggtgaatgcttgcctatgaggaaaggaggaatcttggaagcacggaaagcttttgatgcagccaaaagatacatcgcggggaaagtaccggcgcatgttgagtataagtttctggaaccctgcaggaaatgtcatattgggtattgaaacaaaacggtagatctcaagataccgtctttttgggaaggagaaactgtgagataaaattggttgtgtagcagtatatcgccgaaatttagtgatttcgctactttctgtgaaaaggatgtgtttaagtgccaagacaagtaatttaactttatatagtttgtaattataaatgtataatataacataaatttgtggccagagttgtatggagtataaatgtataatataacagaaacccgcacttgtttcagttgtttggttcatccgttcatgtataagtttaccatgtcattgctaaacgctccactactgccgcctgccacagtttattagcattgtgtcacaagccagacttttacctactgtcacttgagtgcattgcactggatacagccaaattttatggtggttaccttctgaaaattggcaaatgtctgcgtatgagcaaagaagctctcatagaagcccataaagctcatgaggctgttagaagatgcattgaggaagaggccccctcatccgttaagttgaaggttcaggagccctgcagggaatgtaattcttattactgacatttttgactgtgcgaaagctccaagttgaatcagtagtccacatatgattatcatcttggctctgttttcagctttccttttggtaggtggtgttactgttagtcagtagttttttccttgctgtactggggatgaagtatatgtcaagctggtttccccagcggttgaagtagtatgtaaagaaagaaaagtagggccatttggcctttcctcttatgaaaatgattgtcatggagatgctatcagtacaagtgtagatggaggctgggaatctgggatcgcgattattgttaacggtccaaatttctaaagcctaaataatgcaaaactacctccaacgatgaaatgggactgctaagttatgctggaatcagatcagatatagtcaatgagactgctaagttttgaagacaaggatgattatttcaagaggtagttaatcaacgtttggaacctttttattcatatatgaagcacaagcaactaataatgtttagttacattcaagagctgattcagatattactttattacagaaaagaatacttagaacggctgacagataacttttcccattatcgaaagaacataaagaatacttgtacatgtttgaatgcagtgaaaatgggtgctcaagtgagaagtcattatactctgttctactttttgagagaaaaatcttggaaaactattacaaaaggaaatgtgagaagaagaatggcaagaagcaaaacaagaacccatggttcatctgagactgatcacttcagtgtacaggaatcatgccatggattcttaaggatggcttcaacttcagtatgaactcgacatgaatctaactggcatgaaaaacttcctatgttagagtttgtgtcgaatatgagtttaggacttggagttgtactaggtgtaggactagagtatgagtcggactttatcctaggatctctcataaatagagggacgtgcctgttgtaactgcatggcgacttagcatagcgagagggagcggttgccgacgtcgaccggccgtgagtcgttgtaactctgatacgttgtatatgctggatcggggaggagcgcccgtaatcagtgccccggagatgtaggctacggctgaactccgttaccaaatatcatgtctcagtgtcgtcatcgttttggatcttctatggcgttttcttccgcgtttagctaccgatgtcgattttggggctggttttataacaagtggtatcagagcctgcaggagatccatggtagaggtgcgagggaggtgctccacgccgcgacaactacacaggatgtccagggacggacatggacgcaaggtggagcacggcggcgatcaacgaaatttgatcggtggaatcggacacttcaggcggcggtctgaaccgtttgatggctgcaatcaacagggagatgaccagacgtggtgctcaggttgatggcggcggaagcgattggcgattcaatcggtgggtcggacacttcaggcgggtggctcgaactttctggtgagctactttcaacagggagatgtgaggcctcacgggggttgattgaagctggaggcgatcggcgttctcgatcggcggaatcaaacactctgggcagggtggctcgggcctttcgatgagctgcgttcgacggggagatggctagacgtggcactcgggtcgttcggtggttgggaagacggtatgcgacttgtcggcttcggctctcgactagattgatggtgttcaatcggaagtcagagcgggtggatccttggtactgttataggcacaagtcagatcgatgtcgtttgttgtcgatggaattgactggaggtgttggacaacagtgaaatttgtggtgggagtacgtgaagctcgtggagatcaggaccacggcggtgtgcgtgatttcacgttgaggccgagccggaggtgcagactagagcggtgttgttggtagctggcttgggaaaagccgtgttcgtgcaggactcagatctggaagggctgcaacataggacatggactcgggcacgtagtctgtttctattttggtcgtgattgtggcagcggagaagagtcaaggaggacaccatgtcggacacaggaagggaaaacgaagaggattccgtactggacacggatcggactcatattttccaagcaaaatcagcaaaggagagccacgggatcaaaccaaccaaagcaatgaagagatcggacatgatttcttgggcagtggtggtttaggcgacgaactgcgagcggtaggagcacggcttggtgtagttgtcgtgcaggtgccggcgagttcgacgcgggccagctccaggaggaggtggcggataccggcggaaggggtgggctgctcctgcgtcggggggcggctccgtgggcgtcggcatcctcaccagcgggaaacccacggcggcagcggtagcggcgttttcatcggcggtggtcccagggaggtggcgcaaggggagaccagctcctgtgcgtggcagcatcttctagacgggcagcggcgtcgggaaccgaagcggcatctttggtggcggcgcggaggagaggtgaggcgcggcggctctggtgctcgcagtcagcagggaggagcggcggtagcgaagcgtctttaggcgctgggtggcggcgcgcttgagccgaggatgaggcgagcagaaggagcgacaagggccgggatcgttctggtccttgtgtgttgactgggtcttaatcgagagaaaaaaaaaacgattttttttaagaaaaagaccggtcggtccgctggttaggctgttgatggttgagtctgctgtggctttgcacgtgaagaggctatgagctgcatggaacgttaattcattcgtgcattgatttggtcggtacaagattggtggacatgtgagggatggacacgtgtatgtccagtgcacatgcttggatcttgtgagcaatggcatatgcaaagaaggaaattgatgcatgcagcaagaaagtgacgtgttaagttttggtatgacttagtaaagacagtcttgagctggtgaaaactcccgggcaacagcgggtgaaaatcgttgagggcgtcaacgggctgtttggcagtacaggatatgtagcgcccgttctgtcgtggcgcctagcaggaaaactatctcttaaaaactctatttgcgaaatctgtttctttgcttgttgcctagtgtccgtgccatctcagatctcaatccctgatctatcgtcgagttcaatcccgaacccaatccttcccaaatcgatccctccgcaaaagtctattttgcctcccccggggtcgatgggccgaatctttctcggctcatctccccctccctccccggcgccctctctctctctcgcgctctccccctccgctctgcccgcgcgcgtgcgcgtgagccgctcgcgccgagcgccctcccttcccctcgctctccttctccccgcctccatccctggcgagctccctgcccgcgaaatcggccccgcgcggcgttgttcgcgcgcgcgcccgcgtggttgccgcccatgccgcgcctgcgccgtccgcgtcacccggccccgctgccctgccgcgcctgcagccgcgcagccgctcggccccgcgagccagcacgcgtgcccgagccgcgccgctcaaatcgtcgcgccgcccgttgcttcccgcgcgcgcgtgccgtggtggccgaccgcctggtcgccgccgccgtcacgctctgccgcgcctgcccgcgcatgtcgcccgtgtcgtcgcgccgctccaaaccgccccgccgtcatcgccgtcgtcatcgcccggcccccgccactccgcgcgcaagctgccaagggacggaggcaaagctcctcctccatctgccgcgtcgcttccgctccctcctccttttcccgaagcggcaaggaggcaagccctcttttctctccctcttttccttttcccctccccgccggcgtcatccgcctctgtcaccgttttggccgcgagcgctgagctccagctcgcgccttgaccgcccaaggtcggtttccaaaccgacatcgtcgtcctataaaccaaggcgccctcccatcgattccccccccccgtttcgcttgccgccaccgcgcctttgccgccgccttccgtgctctgtcccgcctccgccgttcatcgccaagcaccgggagagccggtgcgttcgtggacgcagaaggggacttcgggcgcgccctctccttcctcttccccggcccgaggccggagagattactcccgcgccgttggcctctcgtcactgcgcctcgtcccgcatggtagtgcatctccccgttctccctcctcgctccatctcctccccttagactcgggtagtagcacgagtagcctccccgtagctagccggcgccggcccgaccgttgccgccgctcgccgtgtgctcaccgccgtcgccgcccgagctcggaagcgccgctcgtcgccggcctcgctcggcgcagctccgcccaatccggcgcaagggacggattcccgtagccccgtagatgctctcgccgccaggaatcggcccctcgtgacctcgtcgccgtttccccttccctcgccgccggttgccgccgccgcaattcgccgccgtcaagctccctccggcgaatccgagccgttggctcgtctcccctcgtctcgtgcaaccacccggtgtgctcgcttttgcctgtatcgccgtggttcgctccgccgctcgccgctgtcgtccgccgtccgttccggccggcgtcgtcgtctacctcccgccggcccgcatggctgccacgtaggcgccacgtcggcgccacctcggccgcgaccggcagccgctccctccgttttcccccgtgcgcatggtccaccgcgagccgtgaggctgcgcgtgggcccgccgcatccgcgtcctccgcgaaccgcacgcgtgcaccgcgtctttcccccatcctagcgccacgccgcgtgctccctccgcacggtgagccgagtcgttgacaagcgggtcccacccgggaccacgcgggatggacccggtccaccggccctctctctcctcccctcccgcgcgcgcgtgccttgggccgccttgggccggccggcccatttagctcggccaagccgccccttttctctcgggccgcgccctagccgcccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgcgtagttttggagcccgaagacccgcagtgcgaggatttcgaggatcaagctcaagatctcgagcaaggcaagccacctttgaacatcttgagcctatatttgaatttaattatgttgcttgaaaaatattatgcattgataggatcgcacttgatctgcttgtcccgtctgcaaggcagattggcagacctacctaatttgttgcatctgatccttcctttgttaattgttataccatgttcccttatagccacccagtcacgcttcggtattcgtgcactctgtgcgagtatcgacggtcgccttcaaacttaaaatatgataaacatcttgggtaaaacttgggttttacaaaaggcttggaaaacccgacacctggggtcggtgcttgcgaactaaatgaatttccaaaaccgcggaccggggaacgtaccgggtgtacggtttcccgctcttgcacttaaggaccgttcccttggaatttcatccgaacataagacaagtacgaccacatgggtggaatgggacacccctggctgagtaactagcttatcaggggagccttgatgccgagagacatgtggattcgccggggtggtgttggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaactaactgttcgaacagccgtacccacggttatgggcggatgtgaggtgattcctagtgtagttttatttgactactgtttgtgaaattgctgttgtggaaaggagatcgatgtttggaaaatctgcagctgatgggatcagctaggcccgggtgaccgtttgaaagttgttggcccgggtggccgtttgaaagctgttggccgggtgccaatcttgatctattttaaagattgatacattgcacatactccgaccggacgaaacgcactgtctcaaccgtgtcgtttgagaagcactcacttagttgtttcagaaaagagttcaaataaaatcaattgcaaaacaacagcctttccttgaagccagcattaaacacttatttcccatggcttgctgagtactcccgtactcacccttgctctatataaataatccccccctcagttgctgaagaagatgaagcggatcctgctgatgaggagttcttccaggagcaagccagctacgatgagttttagggtttcggcctagttcccaagtcgcgcctgtgttgtttggtccaagtcttggcttccgtttcccttttgtaatgcagttgtgagctcgggatctgtccgcagcccaacatgactgtacttctactctataataaagagacctctgttgctgtgatattctgtcttcctgtgataccagcactgtttcctgggactggtatcgatcaacaggttaatttggagcgtcacgggctagttccggtcgggactagttcggggcgtgacaggatatatccaggatctgcgtggattgcatgatggcgatatatggaaactgcgtcactgaaggagaagagcaatcgctatggtggtaatttcttcgggtgattcaaggcaaccgtgaattttctcagattatcaggaattcagtctacagatgcggtaaagcgtggatgttggatttgctagctttgttcataagacgataaggaagaaaaggttctattcaagtctggtgagtttgatttatctatttggtgatgacgtcagttaacgggccatggattagatcaagtcaaatttaagacggtagatgaagttgaacttggttttcggggagtctatgatatgacagctaggaaggaattcaatttcgcttggcaagacgactgtggtgatatgagagaaggtggagcactgttgcaggtggagtcaagaggaggaagttacagggatagcagagtctcttgttacggtgagcctggtggaggcttattggggtagctcggtgtgagcggcgaaaaaggatcaactcaagtcttggtacatggaggttcgagcaagtaatgaattcaggttggcgtggcatattcgccaaggtggagtttgttagagtttgtgtcgaatatgtgtacgtagtcggttacagtttaggacttggagttgtactaagtgtaggactagagtatgagtcggattttatcctaggatctctcataaatagaggggcgtgcctgttgtaaccgcatggcgacttagcatagcgagagggagcggttgccgacgtcgaccggccgtgagtcgttgtaactctgatacgttgtatatgctggatcggggaggagcgcccgtaatcagtgccccggagatgtaggctacggctgaactccgttaccaaatatcatgtctcggtgtcgtcatcgttttggatcttctatggcgttttcttccgcgtttagctaccgatgtcgatttcggggctggttttataacattcgagccggataagtagcactgctttctattgatgaaaacttgcttgcacttatccatatttttttttgactgaaaaggtagagaggctctaccttataaccattgtattaatggtggtcaaaaaagatataacaaaaatacattcaagcagaaaggcaagaaaaagaagaggtagaaaagaaggaagaaagggattagagagaaccacaaacaaacagaaaaacaacatctatgctagtagagctgcccaactacatattggcggctgacattgtggtttaactcggtttttccataagtgtaggcagtccttgatttgatgcgtcacattagttacggagagttcttcttctctgaaggttctatgattgcgtgcttttcataagctgtgtgaacaggcagcgaagcatattggccatcccagtttaagttgagtcggtagaattcccaggacatgctcggtgaactgtagaatgtcagcactctgaattgcctgatcaaggaggttgagtttgttccagatttcagtggctaacttgcagcgtagaatgatgtgattagctgtttctatagccgggcaaaccgcacaatgtggatcagatgcccagcatttcttcaccctgttatcatttgtgtttagccttccccgaaaggctagccaaaggaagattttgcaggtgtttggtattgctttaatccagatgaagtgtgccgggcgccataggatgccatgatatgttattagctcatagtatgctgttgtcgtaaatccaaccgggctcagtgtacagcttctgttatctggtctttcaggatgtatctgctgggattgtaaagtcgtcataagcatatctaattcaagttgagcttgggtggagatcaccgggtggagatc

SEQ ID NO: 64613 - DNA, 4769 bp, Oryza sativa
cagggagaaataatatcttcccattaaataaaatgacaaggaggccaaattttcgtgccactgttcaagaataacatttacagatatataataaatatacatattttaatagtgaacattacagagccacataaatttcagaaaaactttcctcttcctctgtagttagcttgtaggcaaacaaatggatacatatgcacatgaaatttccacagatcaacacaacggcagagtcacattctccataatatccagcctcagcacgcaacatgatcacatttcttgctgcataatacaatgtaggcaacttcaatcatctcatgtgagcaaacagaaagatagaaaaacacaaaaatgcttttctttacagaacagcatcacagcctggttgcatttctgtcaggaatctcccaacctccatatatgattccaggagaactttagatcctctttaatcaaacaaaaaaatgtaggtaaaatatatacgtataaactttgtaaagagcaacacaacaatggaatcacattttcctatacacacaatatacttacacactacgccatccagtcatccaaaggatatagtgtcacacctcacaacttcttttgaatacttcctagaaaagttttcatcctaagacgctaacgcaaagagaagcaaatcacttctgtcaaaagggcaaaatgccacaatgatcttatttcttccacggttcaggctcatcaaagaacatggtcaaatctcctgtcttgctgttgcatactgccagaaaactttctatccttccatgtagagaacaaaaaacacaagaccttttgtgagcaaaggtaacaagagtcacattccctctgggacaatcctagtcacaaaatggatcctttttctttgccgcaagctttcattgcatccacccgtgcaaggaaacaacaagaagaagatatcaacaatttataccatacggcaaactcttctcaagcgtgatcctagctaccaactatttttattgtatattgcatcacaaaggttatcacaaggccacgtcaagactataggcatgtcatgctggctcgttttgttttgttcctttttttcaccgacatctacttcgtgacgaaatgtctctctctaatataccaccatgcccctaaacttggctttaatattgtgaaatgccactcaccttcgttgattctcccctcacatgtttcctatatttactgaactgccacttgctttctaagcttctatggggatcctctgtgacccacagatttgaatatttatgtggcataataacgtttgcaccaaaccaaaattactaagagcatatttaatgttaattttaccactttacatatgtcccattaatttacttttttagcattggatactatgggaggagtacagtgtatcaaaaatggaaggcccatattcggaagttcaagcaaatacaaaccgtcaagttgacatgtggatacgaccatcctttttttggcgttgctcagtgtggtacctcgacaagcattccaacaagttcctttcacgttttgtaatctcgccaaccagctctgaagaggaagggggtgtgggtgttctactcaacacatttctctcctccccctcccctcacccccgtctcctctcaactcttgttctttttctacttgctcccttgagactaatggctttccttagtagatgatacgattattttcctgtttttgcattttcctttggctcatggttgcaggagtcgattgttgatggtggcaagcaccatcggtcaaaccgtcgtgcttctcatcagtaaatgatctaaccactagaagaattatgtcggaatttgacagtatgacatatgatcttcatcatccaaggggtttcaatgttgtttctgagtttttttgttttacatggaggataaggaaaagaacctgtgtaagtatagtcacaatatctttttagaaaattattaagttctctataaggacctgtgtagtggattccctttcctatatattctatttttttatataaaaacattatcagtactatcaaattataatgtttcatgatatttttatatgaaaacacttagcatagtttggtagaatgggaaaatattgttttttataatgagcacaaatcatattttaatacttaaattaagaaagtatttgtaaggatattttttgaaacttgcatgttaaaaaatctcatatctattattctcttgtataagtgaaattgtttttgctattacaagaaacacacatgcctacacaccaccacgcatgcacaccatcacacacatgcgaagcccccccccctccacctccctcccaaaggccctaacacacgcttaaagagacggacacaaaagaaaaatccctgacctcactatttgattcaataaaaaaaataatgtttagcaaaacatttcaccaattcgcaagaaaacagaaaaaaatacttaaaatatgacataaaaatataaataaacacatctcctctctgtgttttggagtaattgactctattgattactgccttattgccatctcacttcgataaatgaaagttgtatgattataatttttgacgctgcacgcttcgatgacataacatattttcagctgtttatgatattttgctaaataaagtggtttgaaattaaatattttcagtgtcaattatttaagaaggcaggtactatcattttagagcatgcatgccatcatcgaagctcaaagttctagcaacaattaatagttgcactcttaataatcatatccatggagtatcataatgcataatatgctgcagagacaaatccaagctcatattctgcagaaacaaacaaaaaagatttggtgcaaatgatctggggacatagcaggaaaagtgatttaacgaatcctacttctcgcaggggcaatcttgtactcacaaaaaattaaatcctatgtcaacaattaatgttaaactcacctttattcctagttttaagctatataaacaagactagccactttgttatcattgccctctctcagctcccaaaaatctcactcatgtttgattgctttagttattctccatcaagaggttgaaggctaaactactcttagttcaatgtttaactaaacatatccatacccatcactttggtaagtatcatttatgtgccacactatatatgtatatgcacgtcatttattttattggccacttttctagaaatcttaacccccttttcttacaaattcatgtgttgatgggtatattctgtggatttttattattatttggcatttattatggaggatggattcgaaggtaacatgtagagtaaaatacattgttggtccttaaagttgttgtgtgatgtcatactagtccctaaactttgaaactttgaagatggagtttgagaggagggggggggggggagagagagagagagagagagagagagagagagagagatggtaaccacaccagtatccgaaggagtatttggtattttaataagattaggatgtgtacttttttctcaaagttaagggatcaacatggcaccatgcaacaagtttagggagcacttctagtgtattttaatctttacttaaatgtgggaaaattatgtcttttaagtacactgtaggtcttgtgggagctacttttatggatgtgcctttttgtgtggcaacactatgttcaatttatttaggatattgtgcttatgtagtgtgattaaaatgatcaaatcaaaattgtgattgatgtcctaacacatactcctttgtcccaaaaaaaccccccaatcctagggatgtatctggacaacgtgtatgtctagatatatatctaggattggattttttttttttggacggatggagtactactttaattaatttcacaataactatatttggaattcgaaatgcaaagttcctttatctatgttcttacaactatttctcttcatgtacttgatttctggagatggcttccaagatattgtaattaaaaacacatccctcacagcttccatagacgctactaaagtttgtggtgcatatcaaagaaactattgttgacaagagcatggcatcaacaggcattgcagtgagcccaagcaacaacgatgctttggacctagctgttgcacaattagatggtgatcaatcttcatatcatcatacaccagaggtcttcttactctaccttgcagttcccggtgttcctctagccaaaatgcaagtacttgagtctgattcggttgccgcagtgaagcttcggatccaaaacagcaaaggatttgtggcgagaaaccaaaggttggttttcgaaggcagagagctctctcgcaatgatagccatatccgtgactatggggtgaggtatggaagtgtgcttcatctcgtgatccgactatcagatccacgacgaaccgctgtgaggactgtttatggaaggaagtttaaattccaagtggaccaacgtcgaaatgctagatatatgaagcaagagatttcaagaaatgttgaaagtcccaatggtattggagagagcatgactttggtcaatggtgaaaagcttgatgaaagcacattaatctccaccatttgtgagaccaacacttctgataccgattttcttgcaaacaagtcagaaaattttaatggaaatgaaatagaagaatcttttgagcaattatccatttcttctgacattggaaacaatttacaatttgatgatg

SEQ ID NO: 64614 - DNA, 5404 bp, Oryza sativa
  unsure (1)..(5404): unsure at all n locations
attgaaaaggtaaaaaaccgagccgaacaaaccgagtttgtttggtttggttgttcggtttcaccgaacaaaccgggagaacatcttccatgaattccgaagcacacgataatcaaatgaatcgctagatggttcataaaaatcgagaggggagaagttgctttctgccctcgcacatggtaggagtcataaaacttgcaatctgagcaaactgccagctatgagtgatgtgtgcatgtggcagctatgcagctgcccgaggcaatcgtccacgcatgcagtggcagcggcagcatcgttaaggtagccatccaatccagccatgcgcgtgcaaagatcgatgtcgagatgtcgatgaataggcttgaccgcttgagaagatacgagtagtgttaaactaatgggctctgtgccttgtttaggagatgttgggcctttcatgttaccaggctgggttgctgggatatgatgtgaacgtgtggtttcggttttctcgggttgtttggttcgtgaggattggaaaccgcagaaaaaaccatacaccgaacaaatgcagaataaaaaccgaaggataaaccgaagcctgaaaaacccgacacttcggttcggttcggctcgggtcggttcggctttcagtcttcgggattttactgcccacgcctaatatagatacatgcacagagtatcaggaaataataagccattgcagcagtgcaccacatgcgtgcaagtatgaagatcgcttgtgtttgtagttcgctgcggcatgatatttgttgttgtgccgcttttcttttgtaataatcgtaagtcgtgtgcatcttaatcatgcagaggctgggactggtcttagagtaattgtattgtcttgatgtaattgtttaagatcaataaagcttcctttatcttaaaaaaagtgcatcacgtgtacctcttcaagaacctttgcaattttctctgaagcctttctaatatcttcagtagttttagcttcaagaactgaaaataatcaatatagcacaaacattagcttccaaagttaccaacagcttatttcatcaagcatatttgaaaaataaacagtatatctttaccaacacatgtttcctccttagaagatggaaatataattttgaccccagtttcatcttcaatctgcttctgcatggttccactgcatgccaaagaatacgattgattctcagtcacagagagagacaggccagcattatcctcaactgaggatagttgaggataatgcatatctgaaacaggttcaagagaccaatacccttttcctttcacaaagcgcatcagaggagcatctacctagaaaagaacagaattcatgaatatttgaaaagaatacaagtaaatatcactcatacattgagctttttacagggaaaagatacattaattgtcatacatatccaccgagcatacctgaacagaagaggaacacttttcagatagattggacctatctatgtccttattgaagctagcatcctccatagtatcttctgtggctaatttattttctggcaaggatgcgttgtaggtggaaacttcaataacaacattagttgttccatctgaggctgaattctcttccacttgtttgcttacaggacctgacatctcattaaggtcagctgcatcatgtggaatataggatgattcagaagtgccacccaatgctatacacaaacaagttaaggaaaggaaatttagagatagatggatattatctttacagcatcatagattagcagcgtccaatcatgactagggcatatccaggtttgaatgcactatgatcttgagtcaaggtattagcagtagcaagtagcaaatggggcttaccttttggagcagcggcttctgtggagattggcctccatctctgcacagcagactttcttttcttgtgttttgccgaattatttgaggctccttgtgcacctttcattacaagtgagtgaatactattttgattaacagatccctgtcacggtcaaagtactatcatgtaaaacaccatattgactattgaggtgatgtatcacagaagctctgatgaaggcaaacgcattaaaagaactagtagaagcagataacaaggtgctgaaaattttggtaccgtgcagagttagacaattttcaggcctgcaaggttggcattcgatctcaaggccaggccaagtgctacacacaactcattaagttaaacatggaccggcacagcataccgcagcagatgaacacgatacagagggtagaacacaaagtattagctacggaatttctcaagagagacatggcaattgcatagctgttcaaaaccatacttgattcaatcaattgatagcataagcccctcaaggcataaacttttctcaacaaaatcccccaaaaaaagatccccattactagctccaattgacacactgcggttcaattagactaaacaaattctatcggttcctaaaaccctagctcagatatttatccatccgtatcaataatgtatgtacgaaccaaaacaaaacaaaaataaaacaaccggaagcttcttgtgggggagaacaccgtggggaggcagaggaatcggacctggaggaagcgcggcgcggaacccgcggcgcatagagggcgagcgagccgactaaacctagcaaagacgacaggagaaataaattactccattggtaagagagagagacagaggagctgcaacccccccgacgatccgggcgcttcgatcgaggaaaagattggaatttctactggcttccttcgatcgaggttgttgcggggagagggataacgaaccttgcgagggaagcgcaagccaacatgggtggtgtggaggccgcgcggctcagagacggcggcggcggcggcggcggcggcttccggtttagcctgcctgctcggctgcccgactgcccgtgcccgctagtggtgaggtgagcgacagcgactccacggcgccataattaactgaagtatttgctactcttacgggcggttctaaaggatttaccactgcgtccacgtatcatagacacataaagatctatatgtggcaaataattaaatgtcccactgctttggggttattttggtttgtgctttgataaattttatggtccttgaaagagtacctcacggtatcttaaattttacactattttttttatatggaacgatatttagtatctggatatatcaaaatttacactagaaaggtggtgtttgaatgtctgaagataaagatgaggatgaagattaagtattccacgtaaaaagggtgttaataacgtgtgattaattgagttttaattattacaaacttgaaaaatggattaatctgatattttagaacaactttcatatagaaaattttcacacgaaacacgccgtttagccgtttgaaaagcgtgccattttaatccaaaagtttatctcccactttcataagaaacgaacaggccaaattgtgcacatctcggtattttttcaagaatagtaaaattgaccttgtgcttatcatcaatgacaaattttataatagcaggtttaagtagttttaggagtgccaaaaaacctacgcaaacttttatagtttcaattttttaatcacttgtgcattatcgatgaattttgatatgaaactaattattacccctgccatcctaaaatataagagatgtatgtgtcttatccaataaaaaaaatcttatattttagaacatgagagtgctattttatctattagagtccgcagcctggtccactaaccgtgggccacccaggtcacattgggcctgctctaccacaggcccaactggagccacaactttagatcctgggcctacacacccaaaagactagtttgataggtgaggactacactcacattttaagtcgtgctccctcatcatcaattatcgatgtaggactaaacctaacattaccaatgattttgcagggtgcattttgacttcaaattagaatgccttaggttctctcaggtaccgatatctgttactgatggcaaactgtagacaagaaaaactagtgaccgtatacctttatagacctttgtgctttgtagagtaaatctatgtaattgttagcctatagccttaggttctctcattctttctatcagctcattctttctatcagctacgaaaaattgttcttgccgtgatcatctcatactaattattctacaatctaatattttcctttttgaaattcttccttgtcatcagcttagctaccgacctttttgtaattgtatagtgcgcgctaatttactccgatccaacttgaaccggtgctattgttgattggccattctaataagttcaacattgccaacttttttcttatatacatgattctctcatcacatactctggccactcttgtgctaagtgatagtatgtttttgcactgttgacatctgctttgatgcaggaaaaaaaaagataattcctggtgacaaattaacaagatacagctgcaaccctgtctttttctctgcacttctgcatacatatgcaaattttggttcgtaggcaggtgatgtcttttctctgtcagacatcacaccacaaggcagcatcacgtagaagtgatngaagctctaaagagtcnagggctttctaagggggagatcacatttcatttttgcggttcaatgctcccactgacatgcaggacaagggcccacctgcaagtgagaaagccagccgcgaaaacactctcaaaatgatggattgagttttgaaaagaatttcaagaacgctgaacatgcaatagcacggctacctccagcccagaacagcagcaaaacggcacatgggagctaagatgattgatgagttcaaactgaagatatattagtaaaaacaacagagaaataaacttgcagtagtgtgattgtacaaggtccagaccaacaacaggtttacaacaccatacaggattatttttgaggtactaaacctcataaaggagtgcaggtagctcctgcttcatattaagaaggaaaaaaaaccgaagagttgccacacaggattatgcatggctgcttattccactatcaaaagaaaagacctatatgaactcactcactcaagaatgccacaccaacaatggcacattattggttcagtaatagtaaaccgcagtttcatccttgggggatgaaatggttattccgaggctcgctccgcttgcatattcccgggcaagggaagcgaagagcagcagtagtagtgtccactttcatcaaacctgcgtgtctgacaaagatgaatctcgggaatgagatattcgccccattcatgttccgcgtatttttcgaatatcttccgagcat

SEQ ID NO: 64615 - DNA, 18392 bp, Oryza sativa
tccctgcataagggatgaacagaatgcacatcaagtcattgacgataccacaagcaagggattttggggtgcagaggatgcaaacaagactttaagttcatagggaacaagggaactcactacatattatgcaacatgtggttcaaaaattacatctggcattggcacattagcgccttgaacagattaagctgcatcccttggacagtaccgatttcatgtagttggtgtcaatagaagatttacctaaaccaatacaccttttgtcagctcatatgaggattccatgtagttgggcaggatgtaaatattcggaagagatggacatttcaaaaatctaaccagtttatcatggaaagcaatgagaagaaaaatacataacagcacaacttgatatgaagaataaaaaacaatgcccttcaaacattatcaatttaaatgtttagaaaacgtagaagttctgaagccttaagatcaacaaagttggattgggaaagaaaaatatttcccaatggtaattccaatactagattgaaggaaagaacatggcatacttaataaggaagttttcatgaatagcacaaagaactgacacatgagaatcaaatggtaatctatttgtagctcaaacaatgaaaatataagttctcctgcaaacttgtactggtgtgctatggagtgcaggtcagttgaataactaagcagtaacatggaagcattcttttttgccgggtcggccaaaggttggccgaccaatttcattaagattggggaggaaaacaaaggaatgttacagcgacattacaatgtcgcgctagtccgggagagatcccagacacatcgtgaacaaacgaaggagaaagagacaatacaacaacgattactcgccgaattgggagaagatcccagctaccctccacatcgcgatttcttcttttatatacatggaagcattcacatccattaaagtgcaaatcgtgttcaggagtcaagatggcaaaatagtttaaaatatttggagattatggaagctataccttcaagcatattactactgcattgttggttccaaaagctgggtcatatatcgatacatatcaagcaatccaacaatcatagttatgaatctgaaagttaaaaaccatacatatcttcatattactactttttcgtgagtagaacataaaacagctaaagacgtacctctcatattaacgcgttccatataatattaacctgagatctgaagggactccacaatgaactaatatgatgtaatggctattcttgtgagtgttctgtacaccagtaaatttcgttaagcaacataactataagaatgaaggattctagtacaccttgtatgtgtcagaaatatagcactggagcaagagaactgcaaaccttaatccaagtagcaaaacactgaacactcattgttttccacagttgttatgccatgactagccaaacactactaattcctcataagtgacaacctgccgaaaaaaccccaaaacaatagtgtgtaatctcaatgagaagttactatgaaatgacaataactgtggatcaaattagtatttgcaaactttgagaaaaaatgtcaaataatgatttaggatacctgtttggaagttcgctgcaacaattcccggtaatagagtgcaaacagtctaatctaaggcgctttggttcactgcataaatggatgaacaaaatgaagagcaagtcattgaggatagcacaagggaagagatttgtagcttgcagaggctgcaaccaagacatcaaggtcctaggagattcagaactgattttacaacctgtggtccaaaaattacgtctaccattgacacattagcattttgaacagataaagttgcatccaccagaaagtaccattttcatgcctctgtcagtagaagaagactgcctgaaccaatcacactttttgtgaggacatggggattccaaggagatgatatacagaactgaagtatcattgtaataatataatttgacattaacttccaacagtatgcatctaattgtaaaggaagaagattaatagtagtgaggcacttacaatgttaccattctgtcactagttaagcgagattgcaagtatgaagttgggcagcacgttaaatactgtgcatcctgatttagtggacataacaaaaaaaatgaattactttgacatggacatcagtgagaaggcaattaagtaaccgtacaactcaatatgaagaagccgacagaccggagttacagaggttcaattgcgcttcaagagtgtgctaggcacactagtttttcttctcttcttttgaccatcgtgtcgttcacttgtcttgccattgtacagtttgttcccttgtttgtaatattcatccagtgataagagggtggaatgtttccaaaaaatagataaaaaatacacaattttacttcaaatatcagtactgtacatgttcagaaattggagatgttctgaagttttaagataaaacaacatgaactaaaggaggaaaacattttccaacggtgtttactagatcgaccatcaaggaaacaaaatgacatacttaacaactcccaggaatggtataaattagcgtcacaggtggatcaaatagtagtctatttatagctcaaacatgaaaaataaatactcctgaaatctgttctgctttgctggaatatctggttagctaaatacctaagcagtaacacagaagcatacccatcttccgaaatgcaaatgttcaagactgcataccatttgagaacactgagagtatgggaactaaaaccttcaagcatgtaactgccagtttgccacactgttggtttccaaagctgtgccgctgccgcactatctagcaatccaataatcgtagttctgaatctgaaagtttggaaccatacgtcagttcatattactactttttcacaaggagaacataaaaatagttatacaactactgtttcatgagaacatgttgagcataatactagccagagtctgaagggactccatgatgcactgatatgatttgattgggttttcttgtgacggtccggtacgccattaaatttcactaagaaatggtaactaataaattaaacaatgttagaacaccttttatagtagcaaacgtaccactggagtgaaaaacaatatcagttgcagagcactggaatttaccatgttccaccattattatgccgtgatgatattttgatccataatgtatgtcagtgcaactagctgaacaccactggttcttcaggagtgatgaccaaaatataatacaaccgaagtattaagaagcctactggaactcacaaaagaacacctgcacaacaaactcccaaaacaatggtgagtaatctgattgcaacataactctgaaatggcattaactatggattaaattagtatttgaatcttatgagaaaaaaatctccaaaatgatttaagttacctgttctcactaattccactactaaagagtaaaaattggaaactggtcaacttagtgcatctgtttgatatagtgtttggaacatcttacagcacaagtgaatttacaggattatgcaactaaccatgaacattttttcacataacagaaatggtttacatcaactaaccataacgattccctaaatacactgatggtactgaaaaaccatgcaaccttaaagcataagattaagatatattcgtttttaatcaaaggcaagtgtacaacaacagcaacaattcatgacaggtgggatacctatatggcatattggcatctctttcttcagtatggattttaaaaatgtttgttgtgcatgcatggaaatggtacatcaggagtgaagttccattctacatctacttacataatatatgtacaggaagaggatattgcacaagatcaacagatgatgccatggaacttaggtatggggaacagggaagcatttgttacctttattagtctagtatgatttctgggatggttccctttagcttcctgcaccgctgtttgaacttctcgttccagctagctctgacatctagttcttgcagtgaactggggaggccacccttgggcagcgaccggatggatggacagccgatgatctctaatctcttgaggctggtaagtctatgtagccccgcagggaggcactgcagattagtgcatccccaaaaatggaggtcctggagggagatgagaagctgaagtgcctcctcttgctccttcgtgaaacgctccacctcgtcgttccatccaaggactagcttggtgagggaggaagagaggagtctgcagatgggcttcacgtggacacctgcgaagtcatccgtatgaagctcctgcagcttggaggaacactgaagaggagaaagctgctgctcttgtccgtcctgcagccccccgagtatgggatccaaaccagcaaagaatctgggtgttccaaagactcctaatacaaaattgaacgttgtgatgcaaagcaatgagaaacaattaagtagccacataacccgatataaagataagaataatacaatgatacttgtaacatgaataagtagtcctcctaacctgtacaacgctgcagcggaaaattatggtctgttcaataacatgaaagcattcatataatttgaagtgcaaatagtgtccaggactacttggcacttgaacacacattgagtctatggcagctatcaggcctgtttattgccacgctattcactttcaaagctgtgctagcgtactacagcgcacaactagcaagcaattcaaaagtcatacttatgaatctgaaagtttgggaaccacatatcagttcatatttctacttctctgcaaatggaacataaaacaattacaaaagtaccttccataagaacctattgagcataataatagactgaaatctgaagggactccatgatacactgacatgataagatggttattcttgtgaaggccctgttcaccattaaattatgttaagcaacaatagctatgactaatgctcaaaaccttgtatgggtggcaaaaattaaagccaaaagcaaatatcaaaacgctggaaattcatcgtaatcaaaacactgaggttgcaagtgggcagcttgttgaatactggcatccttatttagtggacagaacaaaaatcaaattacttttacatggaaagcaatgagaaggccattaagtaatcacataactcaatgttcagaaaatggagatgaggagaagaacattttccaacggtgtttactagatcgagcaaagaaaatgatatacacattttccaggaatggtataaaattagcaacacagggggatcaaatggtagtctatttatagtccaaacatgaaaaataagatctcctgacatatgttatgttgtgctctggaatgctctggtcaactcaaagcagtagcatcgaagcattgccatcatttgaaatgcaaatgttcaagactgcgtaccattcgagatgagactatgggagttataccttcaagcatgtaactgccacattgttggtttccaaagatgtgtttctgccacatctgtcttgcaatccaataatcagatctaaatctgaaagtttggaaccgtacatcagttcatattaatcttcataggaacatgttgagcagaatattagcctgagtctgaagggactccatgatggactaatgtgatttgatgctattattgtgatgccattaaatttctctaagaaatggtaagtaagaacttaaatgctgctagaacacattttatggtagcaaatatagagctggagcaaaaataaatgcaaaccttaatatcagttgcagaacactgcaaacttatcattttccacagttattaagccaataagccatgatggtattttgatccataatgtatgccaattcaactagctaaacaccactaaagtcttcaggagtgacgaccagaaatatgcacccaaagtattaagaagtctactggaactcacataagaacacctgcgcaacaaaccccaaaacaccggtgagtaatctgattgccacataactctgaaatggcattaactgtggattaaattagtatttgcaacttataagaaaatctcaaaaatgattttaaatatctattcttattacttccattactacggaggaaaaattggaaacatccattactaaagaggaaaaattagaaacaggtcgtcttagtgcatctgtttgataggaattaaaatatttgggacatctcactgcttaagtaaatttacaagattatgcaactatgtaataccattttttagataatggaaatagtttgcatcaactaattaaccataaccattccctaaatacacagcccgtaagaaaaacactatgctaccttgaagcataagatatattcatgtttaatcaaagacaagcttacaacaagcagcaacttgttcatgacagggatcagacctatatgacagctgtttcttatatatgggttttaaaaagttttctgggaatatctaggcaaggatatggtacatcaggagtcaagttccattcaacgtttacttacaagatctatgtacaggtagaggatatcacatgagatccacatgttggggaacagtgcatggatagattgtgaagttctacaaggctacaggaatgtacaacttgaaggcagtgccctgcatgacagattgcaaaaaacaaacatttaatcagattgtgtagtaagtactacatcaaaaccccaacagatgatgccatgggacttactaggtagagggaacaaggaagcatttgttacctttgttagtctagtatgatttttgggatggttccctttagcttcctgcaccgctgtttgagcttctcgttgttgcagtatccgacatctagttcttgcagtgaactggggaggccacccttgggcagcgaccggatggatggacagccgatgatctttaatctcttgaggctggtaagtctatgtagccccgcagggaggcactgcaacttactgcatctcaaaaattggaggtcccggagagaggtgaggagctgaagggcctcctcttgctccttcatgaagcgctccacctcgtcgttccatccaaggcgtagttcggtgagggaggaagagaggagcaagcagatgggcttcacgaggacacctgcgaagtcatccgtcctgagctcctgcagcttggaggaacactgaagaggaggaggaagctgctgctcttgtccgtcctgcagccccccgagtatgggatccaaaccagcaaagaatctgggtgttccaaagacatctaattcgctgagctgaccctgggtgaggagaggccacagaccctcgcatctcaaatcctccccacaatcatcgatgtgtagttctgtgaggaagttgaggtttgagatgaaatccagggtctgcacgccctccttacagccagcaatcttgaggcattgcagggaggacgggaaagggcagcctggggcctcgtaggcggagagaaacttggggcattttgtgatttgtagggcgtgtttggttgctgccctggcgagtatttgcctggcctggagctagccagagcagtaagtagtagtgtttggttgcttccctgaacggtgtctatgctccggcaagggtgccggactcaggccaccaaaaatgaacgcctgagtcaggcgtgggtatgtgtctaatcctcccccattgattcttcattgatatgactgttatcaacacttgtcaacatcttactcaagtaaacaaaatgtttatatataatatattcactcaggcgtaggttttcaaccaaacaacaaaacatcacacatgcctaatcaggcacaataaaacacagcttttctaccacacaggcatggatttttctcagacaagtcagtcaggtcaccaaccaaacaagcccgtagtctctggagggagcgcagggattggagcccccatcctcctgtctcatcctcgtggctggtgggaagagcaggacgagcaacatctaagataagctccgggcatctgtagagaattagttgttgtagagagttggagaggtgtgctgggaagatcagcatcccatcgtcatcttcttgatccatggctagctggggtaccactccctcttcctccaccagatcctctgctacttgctgctgctgaatagattcgactgcttgtgtatcctccagctcaacagcagttgtttgctgctgttctacagctatacacatccgtgtaatcttgttgcagttcataagatacaactctgagagctttgggagatgagagagaagctgtgacaatgctttcccacttccatggtagctagaaatagataggtactcaactggaacttgccacttatagtcactcaaactttctgacagatggaacacgacacttgaactatcaagtctgagtatcttcagtgaagtcaacatttgaaggtaacaccccgccaaaggtgggcaattattgatcatcaactcttgtagttgggttaaattatagaaagccagaatcttgtcatctaagccatttagatctgtctttcctacaatcctcaagctgtatgtgctcatgtagtgtaattttttcaaccttgtccctacatcctttatgtatacaaagcacaaggtttgcgtgtaaggcataggaggcattcttagttgtggacaattctcaatttcaacctctcttagcctaggaaacaaattctcatatccttctgatgggcaataagtacaatatgaaaatggtaattctattacctcattgcaattctttacgatgagcacttctataagtgagaacatcgggacttcttttgccgtccactttctcaaattaggcaacccgacaagttctagccttttcaagttctgaaagctttgtcctgtgttgcagctaacaaattgatcttcaccaagtccgtttaccaaacacacctcccctatcggcggtaagtttttccatgttacattggaaagatgaagagtctccaaggatttcacagagagctctgcacctagccatgatgggcaagtagatcctccatgttcaatgatgaatagctctttgaggttgttacatggtcgaaggttctcaagtacttgatcttctttgtcaggatacctacttgcttggcatttgtcccaacttaatgccaacttcagtaagtggttcttatcaaaaagttttgcttctgccgctgcttcttttgtgtctattctctcaaggttataaataccaagtcttcttagctccatcaaatgacctagttgctttagttcaaaacttttttcctctttattgacttcaaatctttctaactcttgtaaaaactgtagttttcccacatcgcaaatagcaaagtgaagcttatcatgtttcgtaagaaaatggcataactttgaaagattgctaaagtctctaggcaaatcgagacaaccatcccatgcttctagatctagaatcctcaaatgataaaatctagaaagggcacttgttaaatgagttttacttcgacgtggtgcccctagccttatgtagcgtagatggactagtgtcgagaatttattaaaaatgaaccccacaggaaatgacattttgggcaaatgtagaacacggagagcacttgcttccttgaacaaatcatgaaaactttcagcaaaactttcatctagttccccaaatatcatcacagtttgcaagttttcaacctttactcttgtctttagtttttgtaatatgttcctaaagctttcattgttcattccatcactatcatccacaccatctgtattgatagacaagtgacgaatggaaggccaaatttccactgatctcacattagaataatgtaaactaacacactcacgagatgcaaccttcgctgctaaattatgtagcaggtcatgaataatatagcatggatgcccatcggtttcatcttttttgaaaaatccatggctgaccaaatcatttaaattgttcaaagctatatcatcatttgttttattctgatattcagaatgtaaaatatctagtcctatccaaaagcaagtaagttcttttgtgtcaaacttgtaatcttcaggaaacaaagcacaatagaaaaaacattgttgcagatgaaaaggtagataatcataactaagctgcaatgcaggcataatgtcatgattgctggtttccatttcccattctctactttctaggactctgttccaatgatattgatcaaagtggttcctcaatagtcgacctactgtttttgctgcaagaggggaaccttttagttttcctgcaatcttatctccgatcacaagtaagtctttatggacgtctcttggtagcttatcaccaaatacatatgctaggaataaatccctaaacgctccagggtccaaaccttccaaatctactgagttatccattgttttaaccatttctgctacaaccggaaaccgagttgtgactagaattatgttaccctttgtctgtccttttgttagtggaagtaaaagctttttccaatcatcactttgacacttccaaatatcatccaatatcaataaaaatcttttagacttcaatctttgttcaattagctcttctggtctaccatctttttcaccatccactttagggacatattgtttgatctcttctatgagcttatcaacactgaaattttgagaaacacatatccagaccttgacctggaaatggttttgcacttcaaggcttttatatatgtattgtatgagagttgtcttccctatgcctcctgggccaacaatcggcaagacagtcaagtccttgccgcagtctgtaccttgggttatataatctattatgctcttcgctgtatcatccctcccatacagtttaggctctatacttgtaggtgtggtgatgggacgattgctcgcagtactggaatcagtgctacggatagaatggtgtatctctagattaagaatagtggtgacctttgcacacacgagctgcagttggtcgacaacatccttcattcttatagacagacccactctgtcaatcttcaactttggcgtttctttgatcacatcctttctctgttgtggtggcttgtgcatgcaagcaccacaacagattgaaacgctagaatcatcatcaacaacagctggaaaagatgagcaatggaggcgtttaccgacagcatggatggtgttgcgagcaccggaagcaagcttgcggatgccgccgccggtggcctcctcctcctcctcactgtcatggtcgttgtatgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccgcccacgcctccaccaagccgtccgagacggggccgagggccttgcccaccacccaccgcgccgcgctcacggcggaatccatcgatccgatgcgcgcggttgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaaggccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagataacatgtgagattgagaccgtcttcacgtggataccacacgtcaatttactctctccgtcctagtttatgaaaaaaataaacctagcatggatccggaaaggagtcatattcatatttataggttgcagcgatcaaaccgaaaaagtgttcacctgcgtggacgcattagtccaaacaaagtgtccttgtacgtagattttataaacgttaccaggttggaaacagattcgacccacataaatgagctcttgacccacagaaatgagctctccgcgcgctcctcgctggcagatctcaagaagaggtcccgtgcagagatactaacaacaatgcagtatagaacttttttaaggtacacttggaaaaaaaaaactccacacttcaacaatgcaatatataattactagaagagcgtgactattggcacgcttacaattttataacctgcacaatatgcttaatgagtatgtaggtttaatagactaacatcataccatttaatatattgatggtattaaaatggaaggggttggatattggctaccggaaattatttttctagcagaaaaaaagctgcgatatctaatccatttttttggccggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctgccaccgccatgtcgtcggcagccgccgcgagccgcctcccttctccagtgtcgcaaccaccgccgcgagcctctcccacctcaccctaatgacctcctccccacccgccgttgccctgcagagaggagaggagagagagaggagaaaggtagagaattggggaaagagaaagggtgctaaggcggacaccctgacatgtggggcccacatgcgtcccacgctgactcagccgccacgtcagacaaaaccggggtcaaaacaaccgaaagacctaaagtgaacggttttgtaagttgaaggatgttctatatctgtttttgcagctgggggacgattttgtaactcaatgacaagttgagggaccttcggtgtactttttccctttgtgcaaggccctggcccagctaacggcccgcaggtgatacagggagattgcccacgtgggcgcctcccattggacggcactggatgcgcttctgcctctgcccagaatcatcggtctccagcaattcggctcctctctctctctcccgcacctgcagacatcgaaagccaaaaaccactcaagaagctgcaaccgcgtaatctcgagaaaacggtttactcggcctaagacagtgggagacgacggcgacggcggcggcgggaggaagccatggttctcgctctgctgttgggctcctcctcttcttctcttgcggcgccacaccctgcttgctcttccaggtaacaagcgccagtggcagcaacacgcagttgatttttcttggatcaaagttgtataaggctagatcaggtgctgttctattgtattcactgttcgaagcaggcatgtattttgggtaacattcttgatgtcaaagtcatattccacattcagtgatggcacgtaggaggagtcaggttagtacagtacctggatgaaaatgctgataagtaatcttcttattggtaggagaaaatgcagacccgctggacgaaataatttcagatgctctctgcatgacaaggtgccactgaatgctcatggagtattatccacaaaattgctctcatgccttgctgcttcgcttgttttcatctctccaccttgtcaggtacctataaatgttaacttattgtcagatgtatatacactaaggctgtgtttagttcacaccaaaattggaagtttggttgaaattggaacgatgtgacggaaaagttggaagtttgtgtgtgtaggaaagttttgatgtgatggaaaagttggtagtttgaagaaaaactttggaactaaacacggcgtaattcaaagagataacctcgggatcactaagcaagaacagttttttttaagaaaagatatttttactgttgaggattgagagaattttactgctgcaattttgattggatacataaaacttgttaatttcaattaagagaagagggaaaatggagtgagattaccagttcaggcttgtaacatggtatcgatgtactcttaatctctcatagttgaccaggctatccctgcagagacctttgtacagccaaaattgtgccaggttgctgtggtagcagccatcgacaaggctgcggttcctctgaaattcgatagcccttctgatgatggcggcacaggtttgatgatgaagggtatgactgccaagaactttgacccaattcgctactctggtagatggttcgaagtagcatcgctgaaacgtggctttgctggtcagggacaagaggactgtcactgtactcaggtattgtagtgccagaatcctcacacacaaatactagtagatcttaatctgtatgatgccccagcaatatgtacctctgaatcctgattcctgaaaacaccgatatctgacatctttgtatcaaactgatttggaataggttatcacaggcatgctattttttctatgccatttgcaccatataatgtgtaagaagattgttacagaaatttgttggtactgcagggggtgtattcatttgatgagaaatcacgctcaatccaggtggacacattctgtgttcatggtggacctgatggttacatcaccggtattcggggaagggtgcaatgcctgtccgaagaggacatggcgagtgctgagacagatcttgaaaggcaggagatgatcaaggggaaatgctttctccgtttccccacactaccattcatacccaaggaaccttatgatgtgcttgcaaccgattatgacaattacgccgttgtgtctggtgctaaagacacaagctttatccaggtcagaaactgatctctgaactgcaaatgaccactatttcttagccctctgcatgcttattctgcatattgaaagatcaatctagttacgtaagctgttccatgaaccaaatatagtgtcaaatagagacaacatagggttaagcaaggacttgaacactgagaaatcaagccaatattccttaccttcatatgcctattctgacgcattttgtaaactgaaatatcataacattgtgtcgtctctcggcaatgcatcagatatactcaagaacacctaatcctggaccagaattcatcgagaagtacaagtcctacgctgccaacttcggttatgatccgagcaagatcaaggacaccccacaggattgcgaggtgatgtccacggaccagcttggtctgatgatgtcaatgcctgggatgactgaggctttgacgaatcagttcccagacctgaagctgagtgcacctgttgcattcaacccattcacaagtgtgtttgacaccctgaagaaacttgtagaactgtacttcaagtaaactccatattgtaaaacttgtgatcaatgttccctccacatgaagatgcagttgaataaaattctcacacacagatgtctctagtgatttatgttttttcatgcgccttatcagaggaagagtttagcaaaaatcataaaatataaaatgaactgtttagcatctggaaaccttagttcatatcagtatgtactaactaaatagagattagcttatgaagagtcagctcttaaacagtgaccaagaacactgtggctggtaagcagaacgcacaatgagacagattcagggcattatgggacatgttgtgctgttattcgactccattctcgtgtgctcaagcagagagagggaggtgatggcaacacttttttctgtgcgagtctcgcggcatccaagcttggaaatccatgttccaacaggacaaaaacatcatacgctaagactcatgagttcatcaatgtctcaatgcctgcatcaaatcccagcaagaacgctaaagagaaaaccgagaagagaactcaaaaccaagaacacatcaacgaaagaacaagccaaccaacctcgcccgcgtgtctacccacacggcggcgccgagtggaaccctagaaagccgctgatataggcgttttagctgcaggccaagcccacatggtgatgggccttgggccccacctatctcgagggccgggcccatgtac

SEQ ID NO: 64616 - DNA, 2008 bp, Oryza sativa
  unsure (1)..(2008): unsure at all n locations
gcttagctagctactagctgcagcctcgttgtaggttaactactgaactttaatttgcttgtgctgccaaatgcaaatcagcatcggattactacaaattaagcaagtgtgtccgggaaactaattcaactggtaatctcgctggtattatggcagagatcttcgctgatctcaaactgatatgcgacgatttttctaattaagcaacgacgacgactgggtggatgatcgaatggttttgatcgagacgtgatcttcctaggacacgggagggagatcgatgtgatctgctagctacctcgcacgtttaccgctgtctgaatttgttaattaaccacttaacatgcatctcgcagcactgttcagatatcaagaaccctttgttaattgcgtgctgggatagttcaggatgtttacaggttggggcgccgatttttggaagatctctggtagatcgatccaactcagagatgacaacgatatatttatgtatagtgtggtttttgctggtgtgtgtatgtagtatttgctctctgacctgataattcagttcgtttcgcctttttcttttcattcaagttgtttgattagcccatgcgatcagtacagtgccttatataggcttatagccaactggggcggaacacgtacattatcccccaagaatatactccaactagatgaagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttattggcaagtaatggtaaagtgtggctgggaaccaaacagccccgaacccaacgacatatatataagggtattgctaaatcacattccatataaaactggacaaaataactttatttttcacccatctcacatataccaatgcaaaagcaaaaataatatcttttggtttatcgaactttaataaaactaattttttaccttatttagttccaatgtatttaatttgttctcactttcacaaactctaataaaaaggttacgttaacttattttgggacaaataagatggtgataaatatagttactttggaataactagagtgggcaaatgacgggcttttcctgctttctttcgcgtgggaaatgatgggcttcttggccgaactagcaacgaaaccacaggaagatagctacacatttggcccacgtagtggaatttgcatcgaacaagtccagttaccttccctcaacttacatcgaagttaatcagcatccttaaacctcttatcttttcaaatccgtccgtattgcgattagggatgccaatnaagttcgatgtgaagatgagggacggtcagtggacttattccttctgcatcatgcaaaacagcccgattccggatacatctcatcacgttttgtctagtcgcctcgaatagggcttaagatctctcattttgtgaggaaaaggaaaaaaaaacgagagagagagaggaagcttcagccaggcgccagttgaggtctagtggacagtagaatgtgtgggccccacacaggtcagattcgatcgccaaggcagaggaacaagtttacacgtcggcatcgctggggcccacgttcagttcaatccaccccgctgttcccgccgaaccaggtgtactactactccgtacttcctgagctactgatgagtagggcccacctgcaggtgtaccccgcccattttcgcccttacgtggggcccacaaacagtggtgcgcgtggttagtctaagcatgggtacgtgcaactggggggctgacgtacgggaccggagttctgtcgggcccactgtcagtgacgcgtgggtggggccatggcgtgtgcgtgggggtagg

SEQ ID NO: 64617 - DNA, 1729 bp, Oryza sativa
cagctactacaatctcagctccaaatccagctcctccgacgagctcccggcgctgctccggccgccggagtagccgtcgtagctggagctcatccaggagtagtactggggctgcctctgctgctccgacgagccatactggccgtggtgatgatcacccttcacttcatacgccacgaacgccggcgacgccgccgccagccggccggagccgtacggcagcatgccctcgtagtacggctgcacgccgccgccggcggcgatcctccggtgatccgccgcctcgtagcaatcctgctgcaacggcggcaagtggaagggcggcgaggcgaacggctgtggctgcggcggcggcggagagtacggcgcgtcgccgccggcggcggagcggagggcggccaccatctggttgtggaggcggatcttctccagctgcgcgacgccgagcccgcgctgcggctgcttggcgaccttgtgctgctgctccgccgcagccgccgccgccgccttcttcccctccgcgcgcctcgccctgccgccgccgccgccttccatgcacatctcgccgccggcgtggctgctgcccatcaaccagctgcaacaacctctacgttctcgtcttctctcttcgagcaatgcaaggtgtagtagctgcagcgatggcgaccagctgcctatttatacagagcttagcttagcttagctgaagccacatgggaggaagagctggacgtcgtcagagcaaattaagctgagattaatggatcctaagaaagattcaggccgatctgctccagcgattttctatggctcgctatctcccaaagttctacttccaagaacgatccctacctagctagctagctaacccattctgccattgcaatgcaagttggtgacttttgcgacatgatgtgcaaatataatactacaacaccgggagctcatcaaatcatgcatatttctatatcatttttgctactccatccgtccaaaatataagcattttttattacacagtcttcaagatactactttaactaacaataagtataaaaataagatattttaattaaaaatagttgcatattacgatagtttgtttaacaataaatctagttacatcaattttacattattgatttttttgattttttttttgctattaatagtcaaagttaaaaatagttgacttgacactataataaaagtgcttatatttcgagacagagggagtagatcagtaatgttgccgtcgttagcctgacctacatatcagtgactaccagttcgcgagatctccgtagcaggcgagattgggggttttgcatataatttatagtttggatatcaatatgatagtcgccatgcgaccggtaaggcacattttcaaggaggccacgcatgtcgcgggaatgcaaattgcagccccaactgcgtataaatccagcacggattggatctctcgatctaacgatcgatcaaattaaactggatcatcaatttggtgatatcgatcgatccaatcaatcatgcgtgtgtgtgtgcgtgcctctctcatgtcttggcctttttcagactgctaatcacacaggcattaaacaattggcaactcgtgtagttgacgcaacaactgcgtaatatatatagtacactgctctgaaccagaaataattaatgggaatatatgaagcaaatgaaatcgtatctagatccttacagggcatgc

SEQ ID NO: 64618 - DNA, 5835 bp, Oryza sativa
tgaatgttgtcacactcagtagtcagtacctgatttgctttccgaccgaggcccatcagaaagttgtcaggctttatatctctgtgcaagtatcctttggaatgcataaactcaattctagtaatctgttataattatttacagaaaaagtcttaaattaatcattcacagtgctcaactcatgcatgcagagaagagaaaaagaaaaggattgagttggtacaaggacaactgcaggtgataagttgtaaaactaagttttgcatgtcaaaagagagatacacttccttttgttcttttttggtgaatcagcatggcgattgggaaactttataatgaaatatttcagataactgttagaaatgaactttggtgttcaatgactattgtgagagaacaagacaacatggaactatccaagaaatttaaaaactctcaccaataaaccttttgtttctgtgagactgatcatccaaaatgaaaattgttgcataagtaaaattcacagtttcactagtattcaaacttctgaaaagaatgttgccattctccaagtttttccacgctatcaataatgagttggaataaaatgaattaagcaatgcaaaatattagttaccatctggtctgctaacattagaactgtcttcagagtgaatttcctgccgcaatagacaaacagatcctctaagctcggcccaagcaaatcgatgacgaggacattttcctctccatctacaccacaccacttaacattcgcaatgccacctggatgccataattttttttccaatcaactcatgatctcatcaaaacagagtgcacaattgcactatgcagaactgtattcagggcctacttcctccttggagagcgttgtagagcttcgcctcataaaacagctggggatgcttcgtcttgctactctcctgataataaaacgagcaatcaaattaatcttctactacatacaaacatagcatgcaactgtgtggtataagccatcaaagaagcatatgaggattgaacaggacaaaagcacaaacaacttgtactcatcaaagaaggaatctgattcaagcaacactaacttttggctctctctctctctctcacacacacacacccctgtgttcctcgtcagcagctcttgcttaaagcactaccaatgcaactccactacgccaagcgtaatcatggcctacccagtcaagtagtcaacctccatccacgctcatcaatcatcatgacgtaagagaataggccaagtagctagccgtacaactaaactaagaaaaagtaaatgcagcggttacacatcctcgatcgttcaaagttgttaaccgcataattatcatcacagcattttcaatcttatcatcagcaacctacaaaggctaaaacaaccaactagtaactggaaattttcatcaaaatcaatcggaacactaattcgtatcgcacggcagaataaacagcaaccgaatcgaaaaaaaaatcgaacagaagttcagtggactcacaatcttcaccgccgcgatctcgtaggtgtccacgtgcgtggctgcagtaacaacaacaacaataacatcatcagatgattcagatgacacgcagtaaaaaaccccaaccgccgccgcaaccctagccgcgccacggaaacgaatcaatcgagcggcggccgccgcttcttaccgaggtagatctccccgaaggagccgcacccgatcttccggccgagcttgaacttgccgccgacgatgcggtccatgcccctcccactccccggccgcgccgcgtgaaccaaacccccgaggaattccggcttggggattgggctaagtaggaagacgacgaggagggggagggggaagcgcaggcgtcgcgcggttgttgcttggtgcggacgtcgcagcggagcggggcgatcgagcagagagcaggtggaggcggcgcgcgcgcatgcgtgcttttgcttccgcctcctgcctttatttctggtggagggtgagcgacgcggcaggcgccgggtcggaaactcggaagaggacgagaaggaaatggtgccgattttatttcctcggcggttggatattataaagggcgtcgtatattcggacattaataaaaaaactaattacaaaatacgttaatagagacatagagacaaatttattaagcctaattaacctatcattagcaaatatttactgccacattatcaaattatagagcaattaggtttaaaagattcgtctcgcaaattagtcgcaatatgtgcaattagttattttttagtttatatttaatactttatactccctccgtcccccaataaatcaaaccctagcttccccaggtagaattagggagaaggataatggaccaaaatatccctaattagtagataagttatattggtctatggttaagtaatgggtattgaaggaataaaatttctcgatctacggaccgatggtaggtaggaagttaagagttgatttattttgagataaatttaaaatctagaagttgatttattttggaacagagggagtataggggtttaaacgttcgatgtgataggatgtaaagctttaagataagatctaaacagggctaaattattatattgtacttctcgtagtattatatttttgggtgcgtggcggcgtggcgcttctcgtatcctgacgtggcgcttcgcctctgtgggtgggggttgaaacgtggcaggtgccacctggacgcgggcagatttttaggcggtgtcggtggtggcgcggctggccacgtcattgtgactggaagtgaagcccagtgggcctcctttgtgtcaggcctgcgcgtagttgggactttggtagtgggcttgcagcggaaaaagtgtaccgaaggtccctcaacttgttagcgggataaaaaacggcctcaaaccgcaaaatcagatatgcagattccttaactatacaagaccggtcacccgaggtctttgatggttttgacaccggttttgttctaagtggcggctgggtcagcgtggggggtagaacggaacaggcggcggcgagcggtgctgagcagcggccggcgaagcagagtggagcaaaggcgcggagcgccggtggcggcaggcgggtgagcacggtggccggtgtcctcctcctccaccgccgcatcgacggtgtgtgccctgcttctcccggtggtcgtcggcgtcctcctcctcctccgccgccgcatccgccgagtcaccggcaccggcatcctctggccggcggagctcgccgctccgttcaactcgcacgcgatgctcagctcctccacgagctactccgccgtttgccccatgagcgccacgatgctttccgccgccggctgcgcgcggtcgacgagcacggagaggagcagtgaaaggttctgcttcagcgtgcggagcgccgggcggatgcgggcgtcggcatggacagctcgaggagctgctcgtccattgcgccgtcgcggaagcactcgtcctccacgccgccgcactcactcggctcgccattgtagtcgtagcaaaacaaatctgtttcagacaaaagcaaactccaaatctttgatcgaacaatgatcttagccacaattcagtgtgatcttgatctgaatcttgattgttcttaccccggtactgcatattgttgatcaccagcgtcggcaagatggtcacatcccctctagcgccatgtccaacctgcatcaagaacagcactggcgaaggtgttcgccagtcacacaccgaaaatcctgcatttttcagcatcaagctggtcagttggtctaacaacctgaacaatctgctccgtcttgagcacgtcgttctcgatgtagtcgtagcacccgacgccgctgcactcgggctccgtgtcccagcggcagaagaagtagcggtcctcgtcgccgtagaacccgggcgtgtccggtacggcaggggcgatgcaggggatgaggcggagcacccgcgccgacgacgtctcctcgatctagtactccggctcgccgtaccgcaggcgctcgctgcggccgccgccgccgacgacgccgaggcccacgccggcgcgccgcaggttgctgaacaggcagaggctgtgcaccgcgctgcccttcctcgcccagagcaccgccaggcgcagcagtcgccacgctcgtctcccgatcgacgccttctgctgcttctgattcgccgctgctgccgccaccaacgccattgccgcaaataccagattcagcggaagaaaacggtcgcgaaatgctcccctgctcccgcgtcgccgccgccgccgcggcgtcgccggccaccggacctcctctcccgcctcgccccgtcagtctcctccccacccgccggttgcccagcccagagccccagagagaaaattgagagagagagagagagagagaggaggaagggagagaagagggggaagagagaggaggctgaggtggacatactgacatgtggggtccgcgtgggtcctgactcagcagccacgtagaataaaaccggaattaaaaccgccgacggatctattgtgaccggtttttattagttaagagacgccggatatctggtattgtggtttgaggacgattttgtatcccgctgacaagttgagggaccttcggtgtactttttctgcttgcagctggtgcgagcaattggatggcccattctagcggcatggaccaaattggtttgagttttaaggcaggaatgtttagttgtagggaataagttcacttgaaggttccttaacttgtcaacgaatccgattttcgttcttcaacccaaaaatcaaatacaacagatccctcaactatcaaaacccgtacaaagcaggtctctcagcagttttaatgatgattttggctgatgtggcgtctacatggccggttttacttatcctcgtcctacgtaacggtgatgcgacactagaagcaaaatataaaaaattaaaataaaaacaaaacatagtgcccatatgtcagtgagacaaaagaaaaaagtagtgggacccacctatcagtaggttccaccatcctttctatccacggacgatgggagaggagcaaccagcgtctcctctctccctcctggccatcctttctcgcagccgagcgcacgcgaagagggaaaaaggcgacggccggcgagagggccggagataccaattaaccagagatatacatgcacttgtgtgaaagtaaatttacaatagtttcaactactagttgattagctaccctgactgtttcgttgtttcgttggagacctgaaattaagcgaaaacatcggcattgaaaatacgcttttctgagggagaaacacaaagagttgtgttcgaattacatgacgaacagtatagttcttccggatgtgtttgaggagaggagataaaggagattggaaagatacgtaaaataaggtgagccattagcacatgattaattgactattaactattttaaacttcaaaaatagattaatatgattttttaaagcaatttttctatagaaattttttacaaaaaaacacaccgtttagtagtttgggaagtgtacacgcggaaaacgaaacaaactcactcagatcaccccaggaaagaacacagtcttaatcaagattaatttatagcgcagtacattaccacgtccagtagtaatccagatgaacatgctagcatcattaacagagtaccaatgtaacagcgcctctaatcaaatcagaagcaactaataagaacatctccaacaacctctctaagccaaattttagccattatagctaaaaaaac

SEQ ID NO: 64619 - DNA, 576 bp, Oryza sativa
cagacacgaagaattcccatactcgctcgcatcaacaaaaagcattgaaccggatcaacaggcggcgggcggcatcaccgtcaccggaggcgcacacacacacaaccttactgttgaactcgaatatcgacagcgtcagaggtggagcctccacgccgcgctctgcagattgaaccgccataggtaaggaagctaggcgaccaaatctgcaggggcggcggatccaacttcaattgaacccccccaaactcttttttgcgggggaacaaacaaactcaaactgttattaaggctctgaaattaagagaagaacttcttgcagatctacaagagaagctagggttaacgaacgcaagcgaaaaaatcgagggcgggagagagagatgaatcagagagaggaagtgcgatgctcaccaggatcccctccgcgagatggcgcgcgcgaggagcggaggagaggagaggagacgggaggaaggagcgcgcgcgacagagaattttcggtgtgggggcgcaggggaatagaaatggggaattttcggattgataggagtatatatatacgagtaaagatat

SEQ ID NO: 64620 - DNA, 34434 bp, Oryza sativa
  unsure (1)..(34434): unsure at all n locations
gtgggaaatgctagaatgacttacattatgaaacggaggtagtagtacgtagctgatgtactgtactaatgtctgatcactattagcaatatgtttatttttttctgtagtgctcataaatatgcgtcataattttattattactattattattttgtcaatcttcaacagcagtggcttgccaagatcaaatgagggcatgaggctcctattctcagcagttattggtgttatgctaggttacttgtttgggatttcatttcctactgtcaatgtaaccaaggtaaatatggatcatttgcttctcttgttttcttctaccagccgcttttgttcagggaaaaaagaactgattgtatcttgcagctccacttcccttccagtattatctcatatattgaagacaaagactctggtatcacaacccaaacattgttgaatcatgcatggacatctgcaaatagtaaaaagaggaacaattctgagtctaactctgacgaaattcctaaggtactttgccaaactgtgatttatgccatcattattttagttttgtgagtaaaggctgattctattacattctgcattattatttcctggtcaatgtcttttatattactcaacttatgtattccactatttctcatgcatggtgtgtgaagtttcaactttcaagatatgaggttgcatgaaggatgtaaatataggaatttatgcctatgttaagtttggcactgtatattaggtcctcatttacctgtgtactttgatatctcctttactggagtgtatgccatcatgtgctaaatcaacgttgttgctaatgatttctttcttcatttctattatttctgtattactgttctggttaatctacataattctttgctcaagatttatgtgccaacaaaccctaaaggtgctgaaggccttgcacctggcattgttgtgcctgaaacagacctttatcttcgaagattgtggggtgaacctagtgaggttagttaccatttcactttttcagtacttgtatcaaccaatacctttgaatggtgggtcttttaacctcttctgttttgtatgtggacgtgtggtttatgatctgaaccatatgaaccatcaggatcttactagccagccaagataccttattaccttcacagttggatactctcaaaaggcaaatattgatgcagcagtcaaaaaggtaattacttagacaactagcatgtgtaaactgattgcattgaataagcatacaattgctttgttcaaaatagtcttcagaatagaaaaaaaaaacttatgttcaactataaggcatctatcatgcttaaacagttaactgagacatctatcattcacttcaaatttacatgccttattatatagttttcagaaaacttcacaattatgttgttccactatgatggtcggactaatgactgggatgaatttgagtggtcaaaaagggccattcatgtgagtgtcagaaggcagactaaatggtaaattattgtaacagatcctgttgtgttttttcatcttctagtttagcactatgtatttgacaaccaaaggctaagtgttttactctttttttttatacaaggtggtatgccaagagatttttacatcctgatattgttgccccgtatgactacatatttatctgggatgaggatctaagtgtacaacatttcaatgcagaggcgtaagcatacaccaccttccccccttgtttgtttattttcggtctgctaaggaagagtatttcaacatgaatttttaggtacattaagcttgttaggaagcatgggttggagatctctcagcctggtttggaacctgataaaggtctgacatggcaaatgaccaaacggctaggagatcaagaagttcacaagtgagctgatgaatctacaatgcttcattgttgcttgatcatcacctacttgtattagtttcttgagtgatacttctctatgtacagagtaaccgaagagaggccaggctggtgcactgatccacatctaccaccatgtgcagcgtaatggctcagtcatttatcatgatgttttcttttctttttttttctttttttttttgaaacgatcgcggcaagaaccttgccgaatatattagaagagtgaaataaacagttttacattagacgattacaaaccagacggataagcgacatgaaggaaaaacagcaacggcataacaaaacggaaggaggatcagatgttttctttttcttaaaactatccgtcttcacattctgtttcacatgcagatttgttgaaattatggcaactgtgttctctagggatgcatggcgctgtgtatggcatatgattcaggtggagtggcatctgcactgttcttagctttgcttgaagctgtatgcttatgcccggctttttgcagaatgacttagtccatggatggggcctcgatttcgctcttagaagatgtgttgaggtatctttttttttttacattaataagactctgccctactgcattgttatatagtcctaaccagcagaaggtctaggttttcttaattttaagattctttttaaatttaattatcttggggactagtggtgtgccaatctattaagagcaaggaaaatgtgggggctaagtgattcatgtagcgaactaatacagatgacagggcagtaggtttttctcgataaacggagggcatgttaactgttttattcatgctcctagcaagctagcacaatctattatgtactggttgccaactttgttatgacagttatctggttttctccactccacatttatttatttcaaatcagtcatgttttattgagtcagaactttggtttgacagccagctcacgagaaaatcggagttgttgattctcagtgggttattcatcaggttattccgtcactggggaaccaggtatatgcactgcttatctcacttctcactccatacaattatatgatgttgtaagttgtaacattatctcctggtactggtagggcacggctgagaatggaagaacaccatgggaaggggtaagctagctctgatgtattcctcgcttctcatctgggcatttccgatgcatgaattctagacttaacaacatcctatatgaatcgcaaccatccgcaatgcggatttgctcttacgattttatttgataatgtgccataggtgcaccgaataaaaccgtatgagcaaagacccagagtcttaccggctagcaccataagttggtgggctagcccgccttggtttgagcctcaccaccgagaaacgctcaggggttttccggctagttccacaagatggtgggctagacgacctgagttcgaagcctcacccccttctaattatttgatattaggtcattccctaatattcgcgtttgagcctcaccacctcttaatatacaactttttttcacaggtgagagctcgctgtagaaaagaatgggggatgttccaaaaaaggttggctgatgctgagaaggcatattacttaggaaaagggatcacaccgccaaattgaacagcagtttagatgaaaatacacgcacatcaggagtaacaagtcttagcaagttttccatttcggaaatctgcctcttgcgtataggaatagagatgttcatcaaagcattgtcgccaaaataagaagagaaagaaagcagctgccttctgcaaatttcagggcaagttttgtacatgagaatcgccagttctcgcctttttttcacttggttttattattattctttggtagtgagattagctatgttgttagtacagtagccgctgtaacaggggattctatgctctgcttccttgttcatacacattttttgtattattggccagacggccagacctgatgcaaaatctatgctactgacaataatacacattttgttatagtcaattaagtcgagcgtattagtaatcatcaaacctttataaaaccttatacattatcatcatttaccacatagtggatgcagagcatctataataagacatacaatttattttctgatacattagagatcttagtagtaatagtaacttcttaagccaagcgtcgaacagtttattttaagcgcatcagcaacgcaattgatattttttttttacttacgcgcggttaattagtttgggattaggccatgattcggaaacatggcttggcattgccacgcacgcatccgccgttgccgccgccgccgccggcgtagcccacctgggtggagctctcgtacttctggtagcgttgcgcgccgccgccgtgctcctcgtggcgctcgtatgcatggtagtggttgcggccgccggcgtgctgcttctcctcgtgctggtacgccgcctggtggtagctgtggacgctgccttggcggctaggtgggcagtggccgtcgtcgtcgtcgtcgtcgctctcgtcgtcgtcgtcgtcctcgcagtcgtcctcgtcggaatcttcctcctcgcattcgtaggattggtggtggtattgggtatggccgccgctgctgtggtggccggcggcggcggcagtgaagtgctgcttgttggaggcgttgccatacgcggcggcagtggcgccaccgtagtggtgctgcccgccgccagccacggcgacggcttggtggcggttgtagttgtacccgccggcgccgcagccgttgacaccctcgatggcctggtgctgcttgtaggtggcgtgctgcttcacggcgccgccgccggcgccgtggtggcggccgtaccctcctccggctgcggcgtcgcactcctcttcgtcgcggcggtaggaggagtactgcttctgcacgccgccgccgttgtggcgagcgtacccaccggcgtcgtactcctcttcctcgcggtaggagtactgcttcttcacgccgccggcgccggcgccgttgtggcgagcggcggcgtacccaccgccggcgctctcgtaccctttcaacacctcgtgctggtacgtggcgtgcttctgcccaccgccggcgccgtgctggcgagcgtagccgccgcagccgccgccgcctccgccatggttgctctcctcgtacacctcctcctccttcttctcctcgtaggtgtgcttctgcacggcgcctgcagcagcgccgccattgcggcacacctgcacgtcgccgccggcgccgccctgctgctcgtacaccttctcctcccggaacgacgacgacatcttctgcacggcgttctcgtggacgctcatctcgtccatcttcgtcacgacggtggtgacgctctcggagctctggctgtggtagttcacctgcggcttgctgtagccgtagccgtagctgtaggcgccgtactggtagccgccattgccgcgcctagccatcgccattttttcttttggcaaatctctctagcttgttgctgggcagtagtgctagctagctgcttgtgttgttgtgttgcgttgcgttgcaagggttgtgtttttataggcggggagatgggcgcgcgcgcgggacgggagcatttgtgctcgatcggtttttcttcgtggcacatatgggcggtgcatctaatcggtaagatatgataaacttttttaatcgagtcggcatccgctgtatgctgcatgtcaagtataaaaaattaaaaatactaataaatatagggtgtatttagtttttttgggggtaaagtttttttttaaaatatactagtattaaacatagactaataacaaaacaaattacatattccgtccgtaaattacagattctgcccgtaaactgtgagatgaatttattaagcctaattaatatgtcattagcaaatgtttactgtagcatcacattgtcaatcatggcgtaattaggctcaaaacattcgtctcgcaatttacatgcaaactgtgcaattagtttttttccccacatttaatgcctcatgcatgtgtccaaacatttaatgtgatgttttcggccaaaaattttggatataaaaaaggccatagattaatagataataaatcatgaaaattcaaagttaactcttaccggttataacataaagtttatttctaaaaaaataatataactaattggttacatgtaataaatactaataggatgttccttgagctattagaatctctctccggtgagatatactccctccttctctaaatgtttgatgacattaacttttttaaatatgtttgaccgtttgtcttattcaaaaatttttgtgaaatatgtaaaaatatatgtatacataaaagtatatttaacaataaagtaaataatagaaaaagaattaataattacttaaattttttgaataagacgaacggtcaaatattttttaaaaagttaacagcgtcaaatattttggaattgagggagtatgttgtgcaactttttatcttgataggcatctctcgtcattcgagcctgcagccagggaggcgccatacatatcttcaatttggtctatgtgttcatcgggcatcttgtaatttggcgcatatactcaggccgacggcctttggttgaatgatgataaagcgaatcaaaagatcctatgcgcctgccatgttagatggtctgtgttttttccttcactagctatcatgccgtagctagcgcttatcctggcatatcacagccaaaaaattgatcatggtttactgaaagtccgcaactgatggaattttcatcttgcagtgattttatgagaacacacattgaaacatagatatggcatgggagatgttttttttcttttttggatatggattgtctgcagtcacatgtattattgaccgtcagtactgcaaataattctcgtcgattctttgcactttaaatcaatcaattcttgcatgacattcaaacaactatgaaatatttaaatttttttttgataagatcaatatatgatattcataaatatgtaagtttaaatataacttctacaaattacaatgaaagagaataaactaaactcttaaccattaagtgcattattcagccatactttctttttcaacttatataggttgaattaaatttatatgtttgtacagtgatatcgacgtaccacatattaatttatttaattatttttttattactatttagattacatgtagaacaccaggagacagctccttgaggagaaaatgacttttcccctggcatactgaagtagctagcagaacaaaactactccactatatttgtttcgtacatgtcgttcaaaaagttatcaaaaaaaattaaaaaaaaatcaagatagatcaatatatgatatatcttttcgtaaacaagtgagttaaaattcgacatatataattcaaaacaaaaataataaatttgaccatgaattacgtgttttgttcatagtcaaatttgttatttttatttctacttgcataatttgaatttaaatttgcatgtttgcgaagtgacgtatcacatattgatctatcatactaatttttttcaattttttatgactttttaagtgacatgtaaaaatgatcttagggatgaattgcgttttcccactatactctattttttaagagaaaaactcaatgacattccatggatttattaggcatcttgtaatttggtgtatatatactccggtcattgattgaacgataaagcagagatcctattcgcctgccatgttagatggcttctttttttccttgcctgccttggtacttatcctaacttgttagagcatgtataatagcagaatataagttagctataaatatattttaaaaaaattaaagaaaagataaaaaagcagtggactacaaatctgtagccagctgtaacacggactccaaaacataatgtgtgtatgacatgtgggatcagatattaatagtatagtaagcaactattgtatgaattgactattatattggttacagataatttaaaattagtagttgactacactattaaacttgctcttacagtgcaaaatgatcatctttttttttgagaggcaaaatgatcatctcgctgtgctttcactagtaacaaactgaaactgatggaagaattcccatcttgctgtgccttcatgagtacacactaaaacatacgtagtacatcgacacatagacatgagtgacatgctgaaggctgaagcagctagcagaataaaaaactccatgatatattgatattccattgctcataattcgtccacttttgggaaagcttggaataaccaacaccttgcctcaagttgatctcactgacctttcggctactactagaaaagatcaacgtacgcgatgcttgtgactgtgggtgagggcattcccaaccaagaaactaatatagattccataaacttaacagcataaaaaaaaaaactagtactatagacactattcttctaatacaaacactactattccatacttaaatttaatactacttatctcatataatgtcttagatgttgtatagaaactatgtctcatgcaagatattgtttccttctcttttcttatttatttacttaccacatcattttttatcttaggtggtagcttatttaatgctaaagacgcatcctagccctgatacggcgcctgcacccagacctgcacacgaccgtgacacactgacatgcaggtggttttgcgtttcagcgtggtgttgcgtactgtcgcctgatcgtccgtcgtgcggtcgtgccgttggtgttgacagttgagcgtgggatgtttctctcctttgaatattagcagccgcgtagcaagttatgacttactgtatatatgcatatcagagttggaatatatgaataccaataaatgaagaagattcttattttttttaagactgataactggggggcaaagtgcccacctttacatattacttggaaccaaatggcaggtttagccgcgtaagcacatgagccctgtagaataaagtgaaggaatacacgggagacttaaaaaaaattatgttattattttctcttcttttgggggtgggtgggtgggggggggattttatgttgctttttgttgttagctacaacctccgtcctaaagacgtcgttgattttttatcacatgtttgaccattcgtcttattcaaagaatttacgtaattataatttattttgttatgagttgttttataactcatagtattttatgtgtgatttatatcttatatatttgcataaaatttttgaataagacgaatggtcaaacatgtgagaaaaagtcaacagtgtcatctattaaaaaacggaggtagtagcaatttttagctatgagatatacagctaaaaatacttacattttggaacggagggagtatatcatcggtttgttggtagccataacgaaatttttaattttaattagagttgattttagaaagaagctgtgagttttgcatgctaacgctggtccaaatattctcgtgtacaatataataccacaataaaacggtaggtgcatatatgtcgagcatcaaaaaatcggccgggagtactacacgatttatttagacatcgtcgacacatcgtaagatcgtcgaaataattttgtctcactccctcaacagatcaacctcgtctcccgcacgcgcgttaacaaagactataataaggctgtgtttgagggagaggagattgagaagattgggaagatacggaaaacgagatgagccattagcgcatgattaattgagtattaactattttaaactttaaaaatagattaatatgattttttaaagtaacttttatatagaatttttttgcaaaatacgcaccgtttagtagtttgggaagcgtgcgcgcggaaaacgaaacaaacattcccccatttgttctccaaacgaacgcagcctaagtgacgcgcgatttatgccatcagaagcgcttgctcgggcgcgcaaccctcgatgcagccgagcgcccggccaccgacacggaagcagatctctcacgctattgcacaccatgacatactgttaggtggtcttcttttctcctgaagacttgaagataaaaattaagttttttacgtaaaatgagatggtattaggtggtcttcttttctcctgaagatttgaagataaaaattaagttttttacgtaaaatgagatggtattaatgtatgattgattgagttttaattattacaaacttaaaaaatagattaatatgatattttaaaacaactttcatatagaaagttttcccacgaaatataccatttagtagtttgaaaaatgtgtcacacaaattttaatcttcatcgttggagaaaagaacaggaccttaagctcataaataattctcgggtccacatgtcaaccaccacatcaaaattaaggaaattacacgatgaggatctcaatcccaccagcacgacttcctcctccgatccttgcacaactcgtactctcgtagcggcgtggctgctggtggagacggagagtacgtagtcctccttgcggcggctgacgtacgtcgtgctcctcctccccctcgccgatggtagtgttctcgatcgtatgcgcctcgtagcgcggtagcgctgcacccgttgcacactgctgctttcttcttgtcatggtggcggcgaccggcgatggtacgtgcctcaagacaacaaccaccccgagtgcctcgttgcggacggcgtgacgtgctgcatggcgccgccagcgctgtggcagagacgtggtggcggtggttcagatgagcgtgggccggcggcggcgaaatatcggcatgccctgcttactctgtttccttgtcttatctgtgtacgtgcaggtgtagattgtgtttgctactgtatggcgtggtaagtgctagcaatgagacgcaggcagtatatgcgaccgatccattgatctagtttacggcttgcatttagtatttgttttaagaaacacagtagatctacggcggcataatgttcttttctttttcaagattaccggcgcatgcataatgttctatgttctcccactctcaactcccaagccacggttgtggccttttgtcggctggtgggctggtttctattcttacctgctggcgcaggcacagcaagcgggcgaggacacacaggtggcagcccaatatcccagcccatatgggtgttaccactaggctcggcttgcaacatcggaactccctagtcccaacaaacgttggccgtagtttgatggctccattccagttcgtccgctataataagagagattttaaataaatataacatattctaatatgattaatagtattaagatgtgttatattttattaaaattttttatattttgagacagagcaagtattaaacttgaatacaaccgggaagccgtgttccgccgttccgcgcgacgcgcgcgcccacctcgcgtgtgtgtatactgtcgtgtcggcttgccgcgtggtcgcgccggccgccactcgagtctcgccagggcttgcgcgaccgtcgtgtcgtgacattgataaccggcgcacgaccgcctagtgcgcgcgcaaaaggaaatatggaatcctgcaactgcttgcatgcatttgtgggtttgtgctctggctagcgcgatctcgctaaaattgtgcgtgcgctagccactataaaaagcatttttgcagacgacaaaaagcaatttttacaggcggaggggaggaccgcctgcaaacagacaacggtgaaaatcatccatcttcacaagcaggcaaatggcccgcctgcgaaaatccaataaaaaaacaaaaaaaaatcgcctcgccgccgccgccgcaccgggagagggccgccgccgaaggggagccgcccacgtcgccgccgccgccgctgccctcccccggtctccctccccgccgtcgccgcaccgggtcgccgccgtgtccgcgcgcgccgctgccaccgcgttcacgcaccgccgccgctgccctctcccccggcctccctccggccagatctaggaggggaggccggggaaccacgtcgcggcagccgccgccgcgctcccctggcctccctccggccggatctgggaaggaggggagggagccgagccggccccgagcgtcgccaccgccaatccacgcctcgccgttgccgccattgacccgcatcttgccgctgccgccataggtcctcccccttacccctcggccagatatgggacgaaggggagggagtcgagccggccccgagtgtcgccgccgccgaccagcgcgacctgtgccttaccgttgccgccgccgaccccgcgcctcgccgttgccgccgccgacctcgctggtgccgccgccgaccctgcgcctcgccatcgcgcgcggatcctcacctcgctggagagaaaggtgagggagaggataagtgagggagataatgggacttagaaaaaatctactctagcctggtctatttatattgctccttattttcgcagtcggaccatataaggagcgcttgcgaaaataattttcgcaggcgccgcttaagtggtccaaatatcaccccaatttatatttttgtagacggtcatttggcaccaaaagtcatgtccgactacaaaaaataaaaccccaacgttggggaaaatgttttatctagtagagagcccgtccatccccccgtatgatctttaccacaacagagaacacgtacgcatgaatgaaaaggagtactgtaacaaacgtgcatatatagaagcacgtcgaagctcttatttattcatgtaccacggtctcatttattctcgtacgtacagaccatagataagatgctgcatgtgcgcgtagacacacgctcgtacgtgcgtcagagcgcgcacacacacaccatgtacacgaccgtgcacacacacacacacacactcacacatagtcatacagaaactgcagcctcgcgtacgtcgtccggtgcgaccgaacgtgctcagccgtagtactggccggtgcaggagtcgtactggcgcccgccgccgtggccgtggcggtgctcgtcaccgtggacgaggtgctcctcccggtggccgcccagatgggcatcaccgtggcggctgccgctgtagcccaggtggccgccgccgccgccgttgccgtggtggtgccccctgccggcgcgcgccatctcgtccacctcctcgtacgactccctcctgacggcgtagtgctcgccgccggcgtgcggcggcctgttcatctcctccgcgcagtggtccacctccgagtagtactgcgccatggtgcaaacaactagctgcaaattaattactacgagtgtttctgtgatgtgcaatgcagggttacaatgttgggtttgttaatgtttggttctgctatttatagtgtgcctgcaacaccagcagcccccaaaggtgtgcgtgcgtgtgtgcaagggaatttgttctgagatagatgcctttgtgcattgctgtctgccgagacgtgccagatggccgtttcgacgggaaggtaggagagaaatctagacacatttctacctatcaatatgcccgcgaatttctgactgagctgaaagtttcaggcaagctagggcctagggaaggcagacagttacacagatcatatggattgaagcaaagaagaatgtagatggaataaaagaagagcttggatgcttggtaaatggagtatatatatcctgcaaactagaagagatgagaataacaaagaattaatgtaatgttttgttggaaaaagaagcatgcgtatattgtgaacgtttagcctcagttcgaaggagttgtggggcttgcttaattattagcggtatgcaaaacgagataaatcattagcgtatgattagtcaagtattaattatataaactttaaaatgaatttatttgatttttttaaagagacttctgtatagaaaacgtttacaataaatacaccatttcgagttgttctttagaattcggcctttagcatgaatgggcataccggcatactgtatgaaggaaaccattgtctgatttatgcatggttttatcggagaaagtaaatttcagtccctttccagaatttgatgagtatgttactctgtactgaactttgtttcaattaatatccgggtgaaatcttcttatgtttgcaatgctagaaaatcttataatatgaaacggagggagtactttgatttgggttgtgatggcatggatgtgacaaatacagtatattaagatttacatatttatatatgcggagcaatcctataagtatatgaccatatcatatgtaagaagtattaaaataaaaacttgcaaaagaacaaacgataatcctgtacatgcggaagaatatttggaatctgtaaactaatatgaacaaatagtgcaaaattgcattatatatccattttcacaagaagctcgttttcattctacacctaccaaactgacatcctttagtatggtttatgaaacctcaccaaaaaaaaggtacagtttataaaagaaccaattgataggaacaatttgtgtttgagctgttctgctactcacactgtttttttcttgtgaatgtatgtcctttcattattgttcttgtcctgcttggtagttgtcatcaatgaattgcactgcctgaacaaaaggcagaaagatggcatcctgatatattgtggattacagatgggatcgataacagagatgtacagagatgtgcaatctgcaatgtttccaccattttgaagttcttcctgatcgagcacaacttaacaacgagtaaagatagatggaccccgtgcatatataataggtgttagaaagggggtggccgggtggggaactatatacatgggctgcaggaagaaaatgtgttaaatcaatctacagtctcattaggagattggaaaagaattgaaggtaaagactacaagagtgtcctgaaatgacgagagcccgcgattgagtgcatcatgcatcgattggatcaaacagggatcatgattcatgagcatgagaggcaggaggagcacgaggatttggcgagttcgctgccaacgcacaaccatgtttagatggtgcttgttcgtaaggcgttttactaccagtttaaatcatgctgaattttcctttttgccttctgttcttctgttcttctgtaattggctttaaattttgttatcagctacacgatgttaattatcagtccttatcttttcctaaaaatttactagctagaattctgataagaaagatggttcaatacaaggaccattgtatattccatctgtcttgaaatacttttctgtggatgttattcacctcttaacttggttgtttttttatttgaagaaaatgtttaattacttagaagtatatttcctaacaaaatatattacattctaatataatcataaaatgttattatattttcctataaacttgatcaaacttaaagaaatttaacttgtaaaaagtcaaaatgacttataatatgaaatggaggtagtagtcaataggcatcattatttggaacgtgagagagtatgtaaagaataatttttaaagataataccattttaatagaaaattgtaaaatagaagttggttggctgaaagtttgtaaaaacagtattactttaacaaaattcagtatgtaaaaaagtaattacttacaaatgacaacgccgtaatagtatagtaggagtaaaatttagcatatatgttaaaattaaggaccttctaatttagcgtgttacaattaggcaccgttattggctctcataccctagcttccatacgattggcgaagagccatatatagttgcaatgagatcatcacgatcattcacgatatataactaacctgatggttcttccttgtaagttaccggcaggcagcgacgatcgatatagctaaacctttttctgggcgtctggctgcttcttgcttaattaatgttgcatacgaactgaaactttatactccagactaatcactatcacactatcagagagattcagaacagtaatcgaccggtgataattaggacaagctttattatattcaggtcacgaatttatttttcatacaccccccctctccgttcgtagtgatcgcacagagaagaaggtgctaattagctaagctccgtgtacgcacgtacacacgcacgcacgatatacacgtagagctaagccaccacatgaccaccacgactacgtacgggcacacatatacgtacgtacgtacacgggtacacacagcaggttcgatcagtcggacttgagcaggaagctctgcttgcgctcgcggaactcgccggtgcaggtgttgaagtcctcctccaccttggtctcgcgcaccatcaggtagtcgttgccgtggttgtggttgtggtggtggcggccggagccggacctgtcgatctcctggaacgtctccttgacgacgtgctgctgctgcacgccgccgcggccgaggaagccgccggtgggggtcaccgacctcacctcctccgagcagtagtccacctcctggtagtgagccattgttttttagttggggagtgaggtgaggtggtgttgtgatgagcgagaaatggttaattagggtttcggtggtgtacgggatggtagggttagtgtagggggcggttttatagtgtggaggtgtggttagggaatctggttcgtgagagaggtgcatgtgtgcacactgcacaggctcacacaggctttgtgcttttcgggctttcagcttcgctttttggtgttcatctggaagtatttggaatattattgatttatcggccaggatgatacctctgcggcggctgggtgaactgtaattggacaagagagagataagatggactaaatagtattaatctgccgttaatgaggatgtttttcatgaggaatggtgggtgattttgagttttaaccagccaatcatggatctgtgcaagcaagtgttctgtacttctgtcgtgtacatatgttcagatttcagagtatcaactcacgagaaggcgcgcctgaagattcgtgctaaaatagaggaaatggagaaagccaatcttgaacatggtacatggaccatgcaggcagaggtaatatataatatgtttattcattcattagtttctaaaacaaaacatacttttattagggttttttttgggaagtatattagttaggtttgataataaaggtacaatggatgaattgttagagaacaataaaatattccatcgaaaccaattggtccaattaatcataatacaacgggcatctctgtttggttctcaaaatagctgaaatagaaccctggtgtttaattaacccttttgttactagctaaaaaactattgtcatgtaagcattttccatttcatgtggcttagctaagctgccttttaacctgatgcaaaattgcatttccatgttaccgctggtaaatgaacttatcgagatttgcaggtcacattcgaaataagtcaccggtcgggtaagaagaatatactcatcctttgtactacctttgtgttagtgggaatatatacttgcgttccgccctgcaccgcattattactgcacttgggatggtgacctcaagatgctcgcaggtgtgatgggagaaaagaggaaccaaagtttggaaatggtgaacacatccagacgtgtatgtgatcagttatgcgatgcatcgcccatttcagattccttccagcatccataaaaaaggaagaagaaatcattcacagcagtcattttctgaccagccgccgttggttttaaaccaagcggttattcaagaatgtggtacaggaggattccggaaacactatctggcaattggcatgatcatgagtcacaggattacaaacaaaatcataacgacagattaccaattgacttaagtatcgacgatcaatatcttttaaccgcgtactgaagaacaagttgacagatagatgcacaaaacctgctgattctaaccaacatggctctcatgccgaagaaaatcactcatttatactactcaattcgcacagatcaaaattttggttttgaatgtgacattgctgtgtgaaacgccatctgtgggttcactaatgcctcttcctcttgcctttatggtgttttctccgacctccgctcttgaaatggggttcggttgaaccgacatcattatccttgtctccatcgacgaacatgttaattccaagatcgaatccatctgttaggccccgtagcctgttttgtttttcaaaataagatcagttacatacacaggttgggtatattggaaatcccaacggacaacctcagctttaagctatacttgcacataattttacgtattttataatggatagtagcagaagatcagctccacatacccgtgaagctcttttctcatccacttctccgtctgcttatcacgttttgtcagcggagctcgagtgaacagctcctcttcttgtttctcttgcaactctctctgccgcatataccttgtaaattccctgctttcatcacctgctgtttcctttaactgcaaaataatacagatgattattcaggtggacatagaacactaatcatataactatacatctaatcaaattgctagtgcatcaaatgaaataactggcaaacctcttcaggtctatcagcagcgtcatcaataatctctttgaagtaagagctttctgtagccattcgcgctaatgttttgtctttccttgaagcttgtttatggcgcttatcctcatcatccatggtagcagcaataaattttggtggacgatagatgccatcgttgtcctgaagtcagggatgtacatcagcaaaaataattgtatgaacatgtcaaactaactaaaaaatgatcaataatgctctaacaaacagataaacagttcagtgtcaacggatatagtgcactcatatattctcaagtaattccaaatatgaaagaaataagaaaatatttaactgcgattagtatgtccatagaagcaagcattagaattaagccaacgctgatataaaaaacaagataaataaatcaccattttataaattaagtcaagaaatactacatcataagtatccatatatcataattctaccaaggtgtggactaatagtagttaattttaattccagacgaggactatactacaaaaacacacgaaagaagcatggccaggcttagcctagctgacaattacttaagaactattggttcatcgttgggctaaagtaccagctagatgtcaagtttgatttaatgatatccaaaaaaagaaaaaaaaatcaacgaatacaatttctacaatttcgagaaggtaggtaatttcaggtgcacacaagaacaaatctgaccacttagcaagtgaaaattaaaaaataaacagtgaaattgtttgtggagtggaaggggagatgaacaacctgccccgcaggatcgatcttagagtccatcatatcagggttcggccgatacttcagtaggtcttcatcatccttaggctgatccttactctttgcttctgcatttagcaccttctcctgggcagctccgctatccgcggcgttggtgagcttctggatttggtactccatcttcttgtctatgggacgaatctaaaatccatccaattcaacacagcaccctccaatgttagccaacaaaaattgagccatgaaacttaaaaatcagtacaggagggctctggcacaccttctccaagaacagcctgatctcgacaaggctccgcacgacggggtgaccttccaccgagagccccttcgccttgcggaggagatagtagacgatgtcctggcagtagctcagcagcaggtggtgctttgcctccaggtacccaatcccatccgccgtcggcagctggttcttcttgacctacccacacatcaaacgcggaatgaagctcgctgtcatcttgccaagaagcgggagagatggggcaactcacgaggaggaggggaaagtgggagtaccttgcgggtgagcgccttgaccttgccggtgacgaggtcgagcccttctttcatctccttcaacgcggcgagcagcttcggcgcgtcatctccgcggaagaccgaaccccggccaccagcgccgtcgccggcgacgccggcaggactggcagtgccgccactgtccatcgggctcctgcaaccgccggacgccttcgccccgcgcggagtaggatggttaaggttggctccaccacgaaggggagagggtcgggttggcggagcgaccggcggccggagagcggagaggaggcggcggtgaggtcgtgtggacgacggcggcggcggcgggtgaggatgctcgcgcgcgctggacctgttaagaggctagggctttgccgttttgttgctattgggccacctaggcttcctgggctactttgtttagagctaccgaatgggcctgtaagcccagtaacccctcgatcatcctaggattgaaaaaaaaaatgtaagcgtaaatagtagaatttaaaaagcagaaatgatcgtttcaatagatcacatgaaaaatatataaattggataaaataatagatttaaaaaattcaaaagagtttagttgtcgctaaatttcctctaaaattgatgtttatttgtcagaaatttcatagggtttaaaagtttcagtccttcatttcaaagaatcgaataggacaaattttttataggatttaaatattaaagaagtcctccctgaattctttgaacgagcactcttactctgcagttctcttttactatagcagcagtttttcaaaaagaaaaaatcgtatattcatgtgttatgtttcgtctcgacatatccggttcagtttcctttagaaacatcaatccgtccactctaacacggtctccgagttactactttaaccaacaatatatatataaaagtaatatattttaaacaaaaaatagtataatagtttgtttaataacaaatccagtgatatcaattttacatgattaattttttttgtttttttcagttaaaaatgtttgatttgacactatactgaaaatgcttatattttaaaacagagaatgcttatattttgaaacagagaatgcatatattttgaaacgttgaaacggagaatgcatatattttgaaacggagagagtacgtttttaaaattgctatcgtacttttatcgttcaaagttaaccaaggacgttaataacttccaaattgtcaagcaaagagagaaaatggtatacatcttccccgctcctttttccacatgcaccactaacgttcacatctctcaaagttatatatcagtgtaaaggttgttgcatgaagcactaccgttgaatagcaccatagatcaactgaaacagcctccctatcattcgcaactcaagttgctccaaaaaatgaatagcaatagcacaaataataccggatactaaaaagataacaaatggagcaaactgttctttcaagtaacccaacaatagtaaacaataacccggatactaaaaagataacaaatggagcaaactgttctttcaagtaacccaacaatagtaaacaataaccagtaccgcacgaggacgttgcctcaatagtcaaaataacactggacaaaccattctccaagtcgaagctaaacttggaacacatatcctacgctgttggataagtatatttggccattcgtgtgacatgttccacctccaatcaatgaaaattgacttatgtcaatcaagcagtcgagggaatctcaaaggaaatttaccaaagaatgcatttaatacctatcggtatacagtaaaagttttaatctttttgccgccctcagtatggccttcttcctcttatgggaatgctatttgagccagatctgttaccaaacccaccacgcccccttgaccggaaattgcctcctaaacacagatacaaatcgattagaaaataaggaaataacataatactatccaaaagaaaaactgaaatagagaggcacctacctcccatagaactggcagatttagccatagattctagcgctggattcacaacctggccagcttccctcaagatcttaacaagattcctggagaattttgcattggagagtgtgaaaaaggtgaatgcagttccactagcaccagcgcggccagttcgacctattctgtgaatataatcttcaagagttgttggaaaatcaaaatttatcacacacttaatatccttgacatctgcaaaaataacaagaaaatgatgagtatgtaatcaagataatacttttgccctgaagaccacagcagaccaaactgggatatcaacattgtcgatctccatagaagtcagcgcatggcttgaaccagagccgaagaacaaaaactgcccatggatgcactttcaagttctacaactaatacaagtcgaaggggctgaaaaactgaactgggcatcaataactgttggatgtggatatgatggtgattgatctgtcagccttaactcacaatactgaaagttatccaataacataccagtatccataactatccaaatgaacccaatgaaaatctgtaaccaattccaacacaggctgcaatgcttaaggtgctgcatcagaggtcaatatgaggatcacacttcacactgtcaagaacaatacagtagtaggcaatagctctacaaacatcttgggaccagttggcagtgataagaccagggcacacgtttaaaatagcagcatataaacttctaaaaattcatggaaaacaagggaaagcataacagcgagatccacacttctaaattacttcatttgtaaatttagttgaatttacactagtgacttagacaaataataattagtagacattttcatgtatgcatgcatgcgagctgaaattgttgttaagccacacatagatctacgagatcacaagtccacagcaaaaagggaactaagtaacacatgaataataaataactaaagatgcaaaagaaagtaattccttgaggagagaatagattcatataaccatatgaattttagcgcaggaaaattaacaggcctgaaagcgaaagcacctagagctctaaattttcaaacataaaaatacaaaacaaatttagaggtcaacagatgaaaaaaaaaatagtgctaatgataatggccatagactctcatcgattctatatttctacctgaagataagttcccctaagagtgaaagaccaaaagccaagtaattttcaaataattcctaaccaagactaaatgtcaacattaggttgaagtgccctggtaacactgccatcgcttactctcgagggaaataaacaggagaaaagacgatctacctctgacatgatggcaccttgcatacaccatcaatccacaagttcagttcactcaaccaaaaacagctgacagccctccgacttatcatccttgagcacttggaactacaacctaattctaattttcaaacaagtcaccataccaagaccacgtgccgctacatctgtggcagccattataggacttttcccactcttgaactctgccagaacatagtccctttctgcttgagctttgtcaccatgaatagataatgctggccatccatccattctaagttgacgagtgaccttgtcacagtcctttttagtttggaaaaatatcaagattctgcttccatccattagatcagataaaagtttactgagtctgtaagaaacaagttaacattaacttaactcatggaaatttttagttggaggaacagctcatggtacaactttgtaaataatagtgttattagtagatacctgggatacttttcgtgttcagatatgacctcaataatttgctgtatggaatgattagctttcagatcaggtgatcctatgattacctgagttacgacatgtgcaaaatgttagtaccaagaaagaaaataatagaacacaaaaatacttttcaaaagatggcatggcgatggcacaagttattcgcaccttgtatgggttctgcagaaattgtctagccaaggattctacttctcttggccaagtggcactccaatacaaggtttgcctgtctggccggatctattaacaacaaaaacgtttagcacaatagaaaaaatggagagttagccaaaacaccagaactgatataagcattctaaaacaagccatgcctgtgccactattttacgaatctggggctcanaacccatnncaaccntccnnnncnnncttntnncancgagatatgttactcttcgcaggttagtgtgaccaccttccagcatatcgatcaaccgaccaggtgttgcaatgacaatctcaacccctggaagtagacgcaagagacttagcctacaaaaccttatgtccaaaattattttcggtaagatgggacaaatacctctcctaaggtcacgtatttgtggtcccttaggtgctccaccatagatacaagtgcttctagttcttgagtatgatccaaatttgccagattcttgttgtatttgaacagccagttctcttgtaggagcaaggatcagaacaattgggccatcaccttgttctgcacccgttacaatgcattcattcaattgacaatttaaaatagagagcacgtacatcaattccgtaacagaaacaaacctagtcgaggctgtgcaccaacatgaaccaacccagggagaaggtaagatagtgttttcccagagccagtttgtgcgataccgatcatgtccctgcccttcaaagccattggccaaccttgtgactgaataggcgtgggctctacgaatccactcttggctattgcttgcatacagtaatctgttaaaaaatgaaaaaaaaatagaacgattatttcatccaagacatgttgccgtattatccagagatacagattgctataacagttaacagaaccccgatttgaaatagcaaacctgggaagttggcctcctggaagtagcgaaccggcttgggcacgtcgtggccttcaacagtgatatcacgctggcgacgatactgcgacacatccatgtctgacatggcctgcacggcggggcactccacatagaagttcttctcgaagggtataaggctccggaagtcaggcttcggcaaggagagcgagtccagcgcgtcccttccacctcctctcccaccgccgcctcggtatccgccagcgccaccaccaccaccaccacctctaccccacccaccgccgcccgcgcctccaccacggcctctcccgccgaagcgcgagaagtcgccaccagcgggggccacgggagcagccggcgcgggcgcgtacgcggcggcgtaggggttggcggccgcgggggccgacgcggcgagcacgggagccccggcaaggtcgctgcacggaacaaccaaaccaatcgattcagtcccatctcaacgcagatccacatcgagccgtgagctaagctagggttagggttagggttagcgtacctgcgcctgtcgcggtaggaggaagggtcggcgtagcggaggtcgtagggattcatgtcgccggtacggtacgtctcggtgcgtgcgcgcgcgcgcgagggttcgccggagtccggtggcgccgccgccgtgggggtcgaggaggaggaggggaaggggagacgacgagggaggtttggatctgggaggaaggcggcgtgcggcggggtgaggaggcccgtggtttggttttgatgggtaaggatgcgaagcgtgtggggccgggctaggtcggttgctatggcccacgtgtcatggtccttgggggagggggggggagacgcgacgcggctcgtacgcatgagaagtccctcacgcaactttccccgcgtgtgattgggccatgtcgtaaactcgtaatgggccgcatctccctttcactgtaggaataagttcactttgcgaccctcaaaaggtatcgaaatcttatccgtggccctaaaccacaaaaccaaatatcttaacccccaaactcttaaaaccgattcaatttgactccctgggcggttttggagagcggtttcgctgacgtggcgcctacgtggcgatattgaccgagtcttcgttgtacgtggctttgacgtggcacttacgtggcagttgaattaaaaaatatgagtgggacccattagtcattcacacaaaaagaatgtgggcccactgacatgtggggcccacatgtcagtcctccttcctcctccctctctcccttctctctctccccccttcttccccttcggccaacgggcgggagggcagcgagagcgagcggcggcgggcggcgaggccggagctgcggcggcaggcgagggctccaaggtagagagagaaaatccaaggggagctcgagcaatccgccatccgtgtcgtcggcggcgaggtcgtcgtctccggcaaggggggagccaggtcgaggcgaggcgggggagcccggaatccgcagatgcatgaggtacaaagcttataaggcattactaatcgtacaaacggcggtgccggctacttctttgcaccgccggccttactcctgttgtccgtggaggtaccgccgccgccgcccgcggcctgcgccgccttcttggcggccttctcctcaagtgccttcttatccctgcgtcaaatccaaactcgaagatctaagaacccgcagattggaaccccgcgtcaggccggggacaagggagatcgaatcgggagacaccgagcaaacagacctctcgcggcgctgctccgaggtgagcccgtcctgggggtccttggcgttgggcttccgcgcctgcgcgcgctcgcggtcgcggttcctctggttgccgcgtgcacaccacgccgccggcgagaagtcaaggaagaaacagagggagaagaacggatcgccactagcaagaacaaaaacgagatcacgacaagcaaacaacacgaattcgagaggtagagcaaaggatacgaacaaacgagatcgcgacaaggaaacaactctggagctgcgctggtgttcgatccgcgtcgcctcgcctagccttcgtcgccgtcgagggcgccggagatggccaatcaccgcctgccctcgcccgccgccgcagctccggcctcgccgcccgccgccgctcgctctcgctgccctcctgcccggccgaaggggagagagagaagggagagaaggaggaggtagaaggaaggaggggccccacatgtcagtgggcccacattttttttgaatgactaatgggtcctactcatattttttaattcgactgccacgtaagtgccacgtcaacgccacgtactaacgaagactcggtcaatatcgccacgtaggcgccacgtcagtgtgaaactgccctctaaaaccaccgagagagtcaaattgcaccggtttcaagagtttggggtcaagatatccggttttgtggtttagggtcacggattaaatttcgatcacttttgagggttacgaagtgaacttattcctttcactgtacgcggccattgcttgggctctggatggcctggtagtcctcgagctacaaatactcggcatagtggcccaggagaatagtagacaagtttgaggtctcatcggaggcatttcacaagaatctcgaaggaaatatatagtttttctttgtataagatttctgcgtttcaaatgataaaaagctttcggatgaccttgaaattttttaataggttgttttatgtttaccgcaattgaaaataggggacaataaaggctaagagaattgaactttcacgctggctttggtccaacgtgagacatatgcgctaaactcgagtctcgaacatcacgcacacgaaagatgggattggcagcgctagtgaagttagcagaggaggctgtagccaacatacattttggatgagtaaatggcttcatatctgcatgctaagttgttgccccaacctccaataaccgttggcatgttactaggagatatgtgatggtatttttatttgaattgaagcagcgggtgctaggaacaaagatgtctagtatatagcacagatgcataaagtacacatcctcacttcctttgtgggtgtctgacctttagtttcatgatgcagctcgctagcagaagaaaccagtgtcgtttggatgtgtccgaatgccgagaagtggatggcaccctgcacggtggcaccacatcggtgaggggttaaataccagtctacaactcacgccaaaggcaccatctgtttcggcattgtcaacgtgaaccttaaatgcactctacgagatcatgttcactcttttgctccgagcatgattttgagctaggctggtagccaaaagcccatatcgctataccctggtccaagctgcaaacaagtgtaatcttatatgctgttaagtgaaaaacctagtagaaacatggtccatcacgtaacatgagtaataaaaactagctatagtgtaattcgctcgtataaataaaatgaaagatcaggaaaaacaaattgaaaatcatgcaaatggcagagactaacggacccttcgtttcgtttattcgcggaataagccaaacgatatatttacaaacgaatagtaatttgtgaataaaaattttatatacgtgttcttagtgatataaaagtaaatactaaaaagtaaactttaataaaataacctcaaaatttaatattgaaaattcaaattttgactaataaatataagcataagtgaaaagattggcccaaacaggagagcaagtttaatagtatagctaactgttggctccaaattatctatagctaatataatagcccatttatataatagttaactataaaaatatactacatcattaatactagcccatttatataatagttaactataaaaatatactacatcattaatacccggtcccacctctcatacacacgtaacgtcttggaatccgtgttgtagccggctacaaatctgtagtccgctttcttctctctcttctctcttcttctcgatatatgattatagctggtttataactctattgtacctgctctcaaagctaaaccagagcaccaatctcaaagcattctcctcctccccggaggccggagtccagacgtcgaggcggctgctgaccggggggcgagcgaaaatatttctagtcgtctccctccctcaacctctcatcagatctggccactcccacgcacccagtctcctaaaccctacacaccctccccccctctcctctcgccggccgcgccacccgccgccgccgcggccatggccgccgccgggggtctcccagcctcggccaccctcctcctcctcgtcatcgccgccgtggccgtcgctcccctcgcctccgccgtccgcccggtttccgacgcccacagatccgctgccgccgagctcttcgccgcttcccccgacggatccttcggcgagtaagtcgacagtgtcccgatctcgagtgcttgtcccacgccgggcgcagttgcgcgcgcgccaccgagctcagctccagatcgatccgaggcggggctccctgcttgagaattatggatgcttacttgcgttttggtctgttcattcgcgcagtttggagacgacgtatgaggcggtcaggacgttccagatactcggggtggagaaggacaagggcttgattggtaaggcgtgcaagttcgccgccgagaagctggcctcctcgtcatcgtcgcccgcgaaggatctgttccacgcggcccggatcagcggcgtcctcaagtgcagtgttgattccggagtttacgatgtgggtcttagcttagcttaacagatcttgttgatgccaatggggttttcttgtttgatggcatggtgacacttgtgttattggtgttaggatgtcgctacgaggcttaaggctgtgatcaaggacactaactcgctgctggaactctactattctgtgggagggttgctcagcatcaaggttactccgctgaattcactactagtttatacttgtttgtttgatttgctcatctccacttgttgatagttggttgatcttttctgtccattaatgaatttgcattgtttgcttcaggaacaaggccacaatgttgttttacctgatgcagataacacatttcacgcaattaaggtgacaacagttcattatagctttgcgtttttttctcttgtttacattctgcaatttacatcagaattttattttaaaattagagttgctgagatgtgtctttgttcgtttaggcacttagccaaagtgacggaagatggcgttatgacactaacagcgctgaatcgagcacgtttgctgctggtaacagttattattaaattgtaacacttaaaatatttctggcacctgtaaacataaatttaatgttgatctgaccttgtattagagggtgtgcttattgctgttcactgtttaatttcttgagactcatttaagttattatagggttgaatagtggattagtaatcagtgcctctatctctgtgaagctttctataccaccattcaccacttaatgggaagatctttactgcaattgggttgcatattttttgttactgatatttaacataatgtatttctacaggtatcgcactagaagcattgtctgcagttatttcactggcagattcggaagttgactcatccatggtgtgtgcatcctctctacttgagtatctagtatatatacttgatttgcaatagctatatgatttttcttcctttgacctaaataataaagtaccagtaatttcatatggtgtaaattatgttataaaaccatgaatagggaagtggctttgaatggatggagaacatatatagcactcatcttatagattatattacctctgtaactgataaagaagtatcgatgaccatagatagctaaatatcataatacaagttcattaaagtttgaagtgcttaatttcacaagaaaacaacaatctggtaatgttgtatctccccaactatcctcctttaggtgcgacaatctttcatctgaaaccttgaacatatatcaaccttgtctgtgattttaaaagagattcaaccatgccactatggcattctatgtaccatgactttcatagtttattttagtgattatgtgttatcttttgtgtagcactgcttcatacaatttgttggtgctcttcattcgtatgtgtcattgcctgttagcatggtgttgcaaatttgtactgattcctgtttcttctattaaaatatcatgacaacagatagctgtggtgaaaaatgacattgtgaagctatttgacacgatcaagagctatggtatgttctataaccttttgtttgtgctgcaaagttaccctgatggtatcagcttccaaattacaaaacctatgagatttagataagtgacagtagccagtacaatttatttttcatattttgattttatgcgtagtaagtgaggaaatttaccttgcctactttgaaagattagtaggaatcatcccacctacaaatacaaaatataatgaatgaatactttctaatggtatatttgcagatgatgggacattttactttgacgagaagcatgttgatgctgccgaatacaagggccctataacaacatctgcttcagtagtaaggggtgtcacctcttttgcagctgttgcttctgggaaattgaatgtgagctttcttgcatcaatcttgtaataatcattcaataaatttatgtgtaaaagcttttgttaagtagctgcacttaatctacagatccctggtgagaaaatactgggtttggcgaagttttttcttggtatagggctaccaggtagcgcaaaggattgctttaaccagattgagtcattatcattcttggaaaacaataggcaagtcattatttatttgttttcttcaattggcatgcatcttttattcttttttgtaatatattgagtgacacctctttctgcccttttcttaatatattttcaaaaatgtaaatgtttcttagtgcactgttagccttttgtgcttatttcttatctacaatttgcagggtatttgttcctctggtcctttcacttccttccaaagtattttcgctgacctccaaagaccagcttaaggtgattagtacttgctaatatattggattttgccagatgtataaaatttttactaggattgagtgtgaatctctgtatgaatgagcattcgattgatatgtgctgtgatgaattgacatttatatgaacactgcaaaagtgactgttatgatgggagaaatcccatattattcaacttgcaagcactgcatttaattgtaaaattttaattcctaactcatatcatattttaagtttgaaccagcaaagctgttatagtaactcacatgccattttcagttgtccttctagattatattctacacctagatttttcttattactcgattatgtctacagttagtataaagtataccttatctacaatagtttctcatcgatttcctttttttgtaatgttttagtccatataagttaactccagtttgtaaatacttggcattttcaggttgaagtcaccacagtatttggatctgctgcacctcctctcagagtgaatcttgtacaagtgctgggctctgactctaaggtcatcactactgaaaccaaggtagaatcaagattagtggctacctcttggaacttcctctatgcctgtctttttcccagctgccatcctctaaaacccttttacttctgatatcaggaacttcagtttgaccttgataacaatgttcattacctggatattgctccattgaaaatagatgttgggaagtactcgcttgtttttgaggtatgtgtaaagtgtattagtttgtttgtgttatgataatagtaattgacaagccttttttttttctcgccagatttctcttcaggaacaagaacatgaaactatttatgctactggagggacaaatactgaggcgatctttgtcacaggattgatcaaagttgataaggcagaaatcggaatttctgataatgatgctgggactgtggagtctgttcaaaagtaaattgtttaacgatgtgattcccttccatttttttttaaaaaaaaagaaagagagaaaaaaagttagagctacattaaaaaaagacaagctgccaaccttgtactgaagaaatttcatctgctttcttaagtatatagccactgaaagagttccattctcatctggaatagcagacaagtgctacaaaattacttagtttttatttttcatttccctgatatatgtctggagattttcctgctatttttaacttgtttacttttgttgttttgtgattgtgaatctatttaatattctgatttagttaatataaaattgcatgaaaattgtgaagcgggaaagcctgctttatatgtctcatatttcaagcttcttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggctttgcccacggacactacgaaatttgtgaaattggctgtgagacaccgaaggcaatattttataatttttgaggcaaaagaggtcagataattttttaaaagaccaatctacccctgctcccagctgtccatctccctccccaacccgatttcccagtcctgaaccctaaccctaggcgacggcggtgc

SEQ ID NO: 64621 - DNA, 20392 bp, Oryza sativa
cgccggcaccggcggaggcagtttcggcgccagcgacggtgttgaggacggcgacgacggcggccgctgaagctgtgatgatgacgcagtaaatcgatccctgtggcaaacccgacgagtcctgacggcaagtgcgcggtctggcggtttcaagccgatagcggcggacggcggatctcagttgccaaatgaagggcacgttctctgcacagtcgtcagttaatcaactaattaagttgtcctttggtgacaaatatttcctggtgccatagaccaattagcatctgagtggattataacagtaggtgcatcgtcaccgtgcaggatcaaggaggaagaagcagccaaaggcagtaatggagcgcaggcggagaagacgagcgagagattttctctgtatggaacgcgctaggcacggccctattcgcgtctgtgcgcggcgaggcgcggtgcgcacatgccatgccggcatgccaattgcgcaggggtagattggtcttttagaaaattatctgacctcttttatctcggaaattataaaatattgcctccagtgtctcacagccaatttcacaactttcatagtgtccgtgggcaaagcccagattttgcggtgtctcacagccaattacacgattttcgagtgtcctgtagcaaattttgccttgaaataaacaactgatttatttatatatgtttcaacataatatagcggggatggatcttcctgtatttttcttggattcagcctgtatttgctactatacaaagacattctcatgttaccacagattataatatcatgggatttgtcagtaacaagtgttcctacgtgtctgttcaatttgtcataggactttcttggtttggtggagaaattctactacctttctggaagatatgacctggagcttgcagttggtgatgctgcaatggtatgtaaccatgttactggactctcattcccgttttgttgcccttgctgatttctttttgttctcaggagaattcatttctacgagcccttggccatattgaattggacctgcctgaggccccagaaaaagccccaaagcctccggcccaggctgttgatccattctcaaaatttggtccgaagaaggaaatatcgcacatattccgttcaccagagaagaggccacccaaggaactctcatttgcgtttacgggcctcacgcttctgcctattgttgggttcttgattggggtgggtcaacaactcctatgtgtgtttcttcatttctcctttgcagttttttttgtttagtctaacgtgtcactcttatgttgtctatgcttgtggcattcgtttgcagcttatgcgtctcggggtaaacttgaagaacttcccgtccttgccagcacccgcagcatttgcctcacttttccatgctggaattggagcagtgctgctgctctacgttctcttctggattaaggttagtaccgttcattgttggtaaagcataattgcattaacaaaggtttctgctggcgctgacattcattcttgttgtaatagctggatcttttcacaaccctgaagtacctcagcttccttggtgtcttccttgtgtttgtgggccatagggctctatcttacctttcctccacgtcagcgaaacagaagactgcttgagaggacgatccaaagaggagtattccgaatcacaaaattttcaagcgtcacaagttgcttaggttccttattttagcaccttcgctttgatattctgaccatttttcttgagcaacttcgagttacgagggacgagtcgatttcagttttgtgggggttaagaatactggagctagaatgtaggacctcaccttcttgtatgatgatgccctgatgtgttctcaatagacgtatgtttgatgatagaattaataatatcttattctgcaaatgcatagtatgccttttgcaaaaattgagttccatatgcagaatatgaacactcttaatcccgaggcccatatgatatcacgaacggtgacttcagaatttagatatgattaaactttgcacgggggcattcgcgtgctccatttcatcagaccatatggttctggaaacacaccttcgctgcaacctgcaacttcgaaaaataatgtctgtttatcgtgacacggtcacacaggtatacaaattgtaagtatacaatttgagaaataagtatacagtgtaatgctctatgcaaattgtcaaaactggagtaaactttccctgcagagtatataagttatgatttccgatggtcttgactctgatcagaatgcctatacatttgtattacaggttgcgcctgatgacatgtataactatttgacttctgtaaagaatcatttgcagttacaggttcccggatcctccatactaccgacccgttttatggtgggaaacaacttcttagtttgattagttatcatcatttgtaaactatccagtttcacctgtttggccaccacggtcagggtcactcgtaaagaatacaccaattactaagaactctccttgcctgccgttccacttgaaaaaaaatggtgtggagtagaccaatctctgtgaattcaggactaatcgagggcgtcgttttgtcgcctagctaatctggaatacaaaccatcgtgcttattaataagctcgctgtggtttccatcctgcataccacacaaaagaactttaagaaatctgaatgacatcatatcatgtgtatagtaggatcagattagttctggtttgcgttttcagtgaagcaacagcggccgaaaacatacctccacaatattaccattttccatcacgataattctatcagccgcttgaattgtagatagtctacaagagaaatgattgtgtcaactaaaatcttaaaattcaaaataaacaactgcagtatgagcatacattacctgtgagctatgatgatcacggttcttctagccttaggatcagtactaaactttgtgattacattctagcaaagcaggagggagcgaatcagcaagccgcccataggcacattgtatttatatctaggtacataattggtcaaatatcttgatgaagaggttaccttcacataatgttcactctcagcatcaagtgcactagtggcttcatctaataccaagatggatgggtccctaagaagggccctcgcaatagcaacgcgttgcttttggcctccactaagaagagcatcatcgacaatggtgttataaccatcagggagagacattatgaaatcgtgagcatatgcctgctttgcagcccactccacttcttcattgctaacttctcttggacaaccatacctaatattagaactaatatccattcggaatagcctaggttcctgcacacaccaatatatgtggctatttaatacaacaaaagttctagtggtagcagagccttgagttagatctgaacctgtccaacaaaaccaatcctttccctgaaccatctgatgtcaagctcactgagtgggacaccatctactaatatctgcattgatcacaaaacataacttcagaccagccaactggtttgctttgaagcgactgcatgcggtcatgtggcacagacaatagtttgacgcagaaattatcttacttgcccatctgtaggttcatatagccgaagtagtaggttaactacagtactctttccacttccactaagaccaacctttaaaagtttcatataaatgcagccagtttgttagtcagaaatgagaattcagaagtatgaaataattaaatcaactgtgttcttctacacaacacacacacatagggagagaactagaaagcaactgtgttctctatctcttacaattgcaactacttcatttggatgaagtgttagattcaatccacccagaattggtacctgttaaaaaaaaggagatcaataatataaggacacaaggtaacagaagattcctcttatttacataacaaatatgataattatgaaattgttctgctttagggttcactctactggttttcagtcaaaagtcaaatgaatattatggttagatcagctggatcataaacaggtattctttttttccctttttggtgggtgacaacaggcactcctcaacagagaagtatccataaaagcactgtaatcataccgtaggtcttgatggatatgaaaatgatacatcggcatactgaatccggccttccaacttctgtaacctgtggcctgcaatggtgacgtactttagatcactaaacaattttacaaccacaagtaaaaaaaaatcaactagccattctaaatcagacatcaggttacaacagtatcttgtaacatgcaatttattttcttgccttcagaactaagctgtctgctaggaagtagatccatcaaacggaagaccttttcacttgctccaacagactgcatcagagaggaccagttgtctccaatccaccatgttgacaaaattagccactcagcatagagtatgaattttgtcagttgctcagcagttagcttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgccgccacgcccaccgacagcgccgccgagccggtggccgcggtgaggagcagcgccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacatgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcggtgtgaaacgagttcaataggttaataaaaggaccaattggataaatttgacataagaacggttatggtcgtatactaaaccaagtgctagcccgttaattaatttggtcaaacgcatgcgtgtaagtactatgggaagatgctctctcaaaaaaaaagtacaacgagaagataagtttggtgataagccagctcaatgcatgcatacgaactttgatgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgtaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaagttacaatgtaactggggtgtagctagacatttttttgccttaaaatctgtttacagcgctataggtagacccttggtaatgtgtgttgagttgctccaagataatatatgtctgtcttcgccttcccccccccccccccccccattcccattacccaaaaaaagttgtatctcctagcttctcaccaactaaaatgcagatatcataatttgaatatggtagatggagttatattttcacgactttatcatcgcaccagtgatgttttccccttccgattgtccactcgatgcatatgccatgataagatccgctttccactttttctctgggggatgaataaaccttccatatatgtcccaatgtaaggtatagctatagctagaaaccatgcgcacgaacgaaattaagaaacgaacgcgcaagaggacagggcaccaatagt

SEQ ID NO: 64622 - DNA, 598 bp, Oryza sativa
tctctcttctctctcacgggccggcagtgggctgaaggaggcgcggtggcgcacctgcgggcggtggagggcgccgccgcggaggctcgcgcctggacgaagtccgcctccgccgccggccgcccggacgaggttcggcctccgccaccggccgcccggaggaggtccgccttcgccgccggccgccgaccggacgaggtccgcctccgccgcctgccgccgaccgggcgaggaccgcctccgccgccgactgcccggatgaggtccgcccgccgctggctgccattccgagagcatgcgcaagagagagcaggggggatccttggcgccgcccgccgccgccgcgtcctcccgccgcagccgtccgagctgcgggcgcctcctccgccgcccgagcttcgcctccgcctatcgccatcaccggcccgagctctgcccgccgccgtcatctgcttgctctgcgagcgccccctccaccgcctcgacgagccgtgcaccggcagttgcgggcttctcgagcttcgccgccccgagcgccggcagctacaggctcctcctctgccacccgagctccgcctccgcacagggctgcaggaat

SEQ ID NO: 64623 - DNA, 8189 bp, Oryza sativa
atcaaacattttcgcaagacatgctttctcaactagagctggcagccatggtattactcgcatccagtataataacagcaaatccatggctatctaggattttagcccagcaatgttccagagcatatttgcctcactttatttttagaacgaggggaaaaccctaatgaaaatggaaaaaatattaagagagttttactgtttttataaaaccttggaaacatttataactttacaaaaaagaaacacaaggaaactagtgctcaccgattaatgtttttctgcttaaaatatttaagccttactagaacatcttaagtccaaccaagggttattttcgagagtaaaattttctggtctaaagctttggcacaaataatggaacaagccttagttgagaacagcctaaagacagaaagaaagtaaaaaaatgaaatgataaaaaataattaactccctaagagcaagggaggaaatctacatagcaatttgaacttaccaagtccaattgcatctgagcctttcatgattctgagcctccggcaagagtcggtgaacatcctgtgattgcaccaaaagtaagacaacagataaatgataaattcagtgagaagagcaacactaacaatcatattcacagccagaattgctattttagttagatggtacaggtgtacttactcccatggaacatcaccaaccagcatccagtcaccatccttgtcttcgtaggttaacacatattcaccatctttctggttctcagcaccttccttacctggtatcacattagaccaactactacctgtcagtccaaataaacaaatagcacaaaggctccttcatgctaaaatccaccaaaacctacatagcgttgttatttacctgcatattcatgatttgtgatggtatgatacaactgctcatgcagaatttaccattaataaactgagataatgttttacccttcattgatgattatgctgaaaatacaggtaatgcatcctatgcacctcagtactttttattctgtgaggaaatgcactttgtataactctaagatagataagttaaacgagaaatctaacagcaagtatcatattaataaaacaggttgtctgcatcaagatctgatcagcttatggtacatgaatccagatacaaactctagtctacaatatcacagaaaaacaaaataaatcatgaaaactagaatagaagcatatctgcgtaagtatttcgtctacaaaatatgcagaattagtactccggtggttagtttgcaccacctgatcactagaaaagatcctaaaagggccacattatacgtaatatgctacaaatctcatgcaaattatattcgtagataactagcaaggtcaaactttggagggattccctacataatgggtggctggttgctttaataaacaaaatcaggttcagtcaaatgtttggcatgccactgaaaacaatcctcatgtgctctaataaacctgaaatttactcgaaatatactaacgaaagccccactgttttttccatctaacatgatgtgtggaggtgagtttcagcccatcaagattaaattatgttgcagcttaaacaaaatagcacccgagaaacctcaccggtgctgaagccaatgaacattttctcgagacccaaagacatgtccttgtagttcttgtaagttttgaggtccaccttcctcagatatggtgcaccatccatgctaaccttgacgtacaggaaaccctgaccctgcttagcatcaacatcctccttgttgctctttatctggttggttgccatcgtgttcttgcggtagctgcggattggtggccatcccaccacctgagccctgcacaagcacatcattgcaaagtaataattcagtataaatgtataagaacaagagaaaaaaatcaataccagaaagaagaatcagcaataattgttcaacggtgggtcgacaaaaaaaactgaaaacgaccacacaactgatttttctgtgaactttgatctaataggggaggaagaaatttgaccatttcaaaggtagccagctcaaactttcaaatatcaggttatcgcaagtattttaatccttcaaatgagaaaaaaaaagagaggaagagcacgcactcacaattaatctttgggggcaaaggagtataaatttagagggaactagaaaaggaactacgcaaagctgaaaaaaaaaacttttgaacggttctaaacacaagagatcaagctaaatccaaaacgcgccacaaagttaaaaaagaaacaaatgaaaaaagcaaaaaaaaatgcgaattttgccacccaatttccacggaaaaagtctcttttgcgaatccacaaaagagctgcctcaaataaacatggcacagattgcaaatttcaccttctcgcaggcaggcctaactaaatcccccacaaaaaaaatctctttatgtaaggaaaaaaaatccttcaaactcatcacccattcgcgctccaaccacaccgaccagcagcaaggcagcatccaccaccaccaccaccaccaccaccaagaacacgacatggcaccaagaaaaaacacatgaagaatcgacggaatccgcaggagcaaagggcacctacttcgcagccggctgcggcggcgcggcgaccttcttgtcctcctcctcagcccccacctcctccccctccctcgccgccttgcccttcccggcggcggcagtgggcggcgtcagcgcggcctcgtcggggaacacgcgcttggcacccttggcgggcagcagctcaagggtggtggcagtggcagcggcagcggcaatagccgcagggcggcggtccggcgactcggagccagggaggccgaggcggagctcggtgcccttcaggtcgacgtcgtccgcgcgggcggcggcggcggaggaggaggagggcggcggcggcggaggcgagaggcctatgtagtcgagctcgaggggcggcgacatggggagcggcaggacatgaaccgggatgcggcgggtttggattcctataggagggaaggagggagatgagatgagcaaagtgtgtagtggtggtggtggtggtggtggtggaagaggctagagtagagtggacagtggagaggttgctgctgctgtgctgcctacttgatgcttctgttgctcgttgttcactgttgtttaatcttttaccagtgtacatccttccagtgtcttttgaatcgtacaaataaaaaaaaataaaagaattaaaaaaacacatgattctgatagaaatgtaagtgtaaaacaaaatattgaaaaagagaggagaaatatatgaatgatcgttagattaggtcataggaaaaacacaagaattgaatgagagttagactcaactaaatttttcaagatgttgaacctcttcctaaactctctcctacatgcaatgaaccatttcgttggaattctataggatttagaaaactctaatcttttgaatcaaaggtccaaatagaaaaagatcatatatgatttaatttaatcctatgaaattccttcgttaatcctttgttgatttaaaagggtcccttactatttttatgtgtccaatttacttatctcaatacctttgctttgatacatatgaattactctctaatatagcaatttctaattatgtatctggacatatcgttgtccaaataaatatgattagataaattcttttacgcttccttaaaaaattatatacatatacatagctaaaatttgttatattttacaatagagggagaataatgtttgaaaagaaataattgtgaggtttttaatcaatccgtctatgtagatatgtctttacataataagctgtattttagtgatgaaataataaagaaaggactgttttataatattaaaataaataaagaattagtaaatgaaaatgtatttataatacagttctttaggtgaaagattcatcgtcatcacaattactcattctgtttcaggttgtaagactttctagtattactcacattcatatagatgttaatgaatctagacacacatatatgtctagattaattaacatatatataaatatgaacaatgctaaaaagttttataatatgaaacggaggaagtataagatatcttttcgaaatgatggtgtgcaagataggtgtggcatgtttataattgtttctagaacattattataagatactctttgacagcttgctattttataaaactaatttatgtggccagtgaggcagtgacccgaccgcaaggcaaactggtagtactcttttaatataggcgtgggtaaatatatgtcgtgacattaactaatcatgccaagcgtggcaatgctagttcaattatgctacccacatttcttgacaatctttttttttaaagaaaaatagagcacttgttggatgcttaattctaaatcatcgaaacatgatcaaataaataaacctaagtgtgatattaattattaaatgatccacggtggtcgggaaactagatatattttgaggattttagatttattacttagaagttgtttaattaaggacttgttcggcggccagttgctggaatgtactccatccgcctccataaaagtgaatttaagactggatgtgacacattacaacgactctggacagatgtatgtccagattcgtaggttggttttttataggatggagggagtagcttctaagcagcactagctgtgaaacagcgctgcaatataatcaacagccgaacacccctaattaagttaacaaaataaaatgttcgtttaattttatagtttttttccctgcatcatctcttgtttaacaagtttatatcaaaggttgtttgaaaatatgaattacattcctatataccagagatcagaactcacggtatggagacccatttctttttggtatcaatagatccgcaactgtctggacaacatacaaaatatgttaatatagtttcatttattgggttttaagatatgatcgacaggaattaatttcatgacaaaagatattatttatcttttccccatcttttgctacatactttctccttttaaatgtttaacatcttgattattagtcttattaaaaatttatctaagtattatttattgtgttgtgatttgttttctcatcatgagtactttgagcatgacttacaaatatataaaagttttaaacaaaatgaatgatcaaatatatgtcgaaaggtcaactgtgttaaacatagaaaaacggatagagcatgttcacatgatgctctctagctactactggtactggttttccagcctcaattaaatgcatgtagatgtaaccaagacaggtaggcttccaatttccctttatatgaccatatgaatgcatgttgcaggctggtttggtcgaaacaagcaacaaggccaatgcaaaattcagctttggccccattcggcttgacaacttgtaaagcccccagcctacattgtttggtactgaaagtactgaagatttggtagatgaatgcgactgggcattgtccatttgataagaattcacaaggagggggacattggatcgaccctctcgccaacaataggacatatgtgcagcttcttgatcaggccttgatgaacttgatttcgttgcagtacaactagctagtagacaacaaagggatatatatatatatatatatatatatatatatatatatatatatatatatatagccccactactgaaggccatactgacaaaatagccccactactgaataggcgtaacggtatcaggatacgaatgaagcaaccaaagataatttatacgtacaatattttttttaaatagatatattaaataattgtttgaaagctcgggttgaagaataaagcaatgaacgaaaaaaattcccaaactcaaattaaaaaaaataagttttaaatttaaatttttggtagtcattgataagctaactagcaaacaaaagacactgcagaggcttttcgtagctaacacaactgtgtgtgtgggctggctttccaagttccaacagagatgacacacctagaatatatcaactgaaatttagtggtgatcgatcgaccagtgtctattcgaattgcgatcaggtacagtcactgtacattagcaactgcacacaacgtggagcgtctatttttatgatcaacggtccagatctaagctacagtagctatgtgaatagtacctgcgctacagtgttactgctacagtaaccatgaacagtgctatgctcgatccaagccgtccgatatgtatccgacgatgaaactgctactgcttaggttgcagtcgcaactattgcgactgcacccgatccaaatcctgtctattcatggctggaatgagatgatctaactcgacaatgttcattccctttttttttttgtcacggtacagtatacgtggcatcagaaatacagagtcacgtacgtgtaataacgtatataattaatcgatcgcgtatagaagacgaaggacacgcgctggtagggatgggcaggcaatgtcgtccctcaccggccggagaagatcacaacgacgcaccgactgacggcgacgttatggccggtcggtcgcgcgacagtccatccgctatctctctttttttttttgaaaaagtacggattacccatctaagtatcgtggtcagccaaatttcccccctgaacccagaaaccagacataactcaccatgaactttcaataccggacgaattacccccctcgacccaatcaagagcggttttatcctatgtggcgtacgcgtggcaacccagtcagcattttcttttcttaaaagatgctggggcccacctgtcatatactctctcttctcttccccttctcgcgctctctctctccctctctcggcgaggacacagcgcggcggctacaggtcgtcgtcgtcgcgctggacacggaggccgcggcggcggcggtggcgtgggaagagccggcggcggcgagggacgcggaggccgcggcggtgctggacacggaggctgcgtcgacggcggcccctccatgtgccccccgcgagatggtcgtagcctgcgtccacggcggccccccgccatgtgcccgcccgcctgcacgaccacggcactggcagccacgccaccataccgtggagcgctagcaagagagaaggaagaaaacgagcagaagtagaagaaagaagaaaaggaggaaaaaaacgaaagaaccaatgagcagcagcacaagccgtcattttggtccgctacatcgacatgaccgctgtgcatgccgtccggctgccgcaccgcatgccgtcctggctgcgtctcgccgtcgctcaaccacgcctcgccgatgcacggccgtgccaagcgccatccggcggcaccaccaccgtcaagccgggggaggaaaggaacaagaaccagaaaaagaatatgaaataaaaaggggaaaagcggggaggcagtcagtgcccgtcgccgtgcgtccgcgcctagcgccacaggagcccagccgtctgccgcgtcgaccgacacaaggtcgtccgtcgccagccaccgcaccatccgccgtgcatcgccaccgccgactgcaccgacgcccgggcgcgccacgcgacgctcgccttccaccgctgcacggccgagcgacgccctttcgcactaggaccgcgcccgcgccgtcttcccgcgtcccctcacgaccacccgctgccgcttgacctgcgtcgcgtgccgctgcagtgggccgagcgccgccgcccaccacccgccccagcacgccgccgtgtgcgccgagagagaggaagtggggaaaaggggaaagtggagatgagagagtatacatgacaggtgggccctaccattaaaaaaaagaaaatgctgactggattggcacgcgtacgccacataggccaaaaccgctctggattggatcgaggggggtaattcgtctggtattgaaagcttagggtaaataatgtctgatttttaggtttagggggtaattcggccgaccgcgatagttcagggggttaattcgtactttttttttctttttttttttcccatggaacaaagatgtttgtcaatttaagtatttttttctcataggttaattggatccataccat

SEQ ID NO: 64624 - DNA, 7105 bp, Oryza sativa
aacgacaatgataatatagtggttatgttttgtgaacccttactgtatatgatcagtatttggtagtttgtagttgtgggcagtatactgtaactgaaagcgaaatattaatgaaagttatatatttttaggaaatacagtacaaatacatacgctcacaacacgtgcacactcacttctatcaatacacatatgcatactctacttcaatgaaccctcgaaagactgggccgatatatatcctgagattacgaaggtatcatgagtacctcgttgttaacgggtgtgtcgtctatcactgaaagaataataagtttagaacttgaacttagggtgtttagatcacaattttttttttgccaaaaatgtcacatcaaatgtttggacacatgcatagggtattaaatgtggatgaaaaaaaacctattacacaatttgcatgtaaattgcgagacgaatcttttgagcctaattgcgtcatgatttaacaatgtgatgctatagtaaacatttactaatgatagattaattagatttaataaattcatctcgcagtttacaggcggaatctgtaatttattttattattaatctatatttaatatttcaaatatgtgcacgtatactttaaaacaattttggccaaataactaaacacggccctataggtggaatggttccaccgcatgtagaatctaactagttaaagattaaaattttgaaagcacggaaccgctaattaccacggcgttaagggcgctaaatggtggatctatttaattaaaatcgtttataccaaaaataaaaatgctgatcagtactggagacttgagtaaatccaaatcaaagaaccttgaccggataaggtagtaaggctcttgctggtaactgtcaccaaccaatacttaattaattgtagttgagttatcataagaaccaattaactaatgccaaccctccataaactgctcccttttgcccagaaattgtgtgtcgcacatagctttcccgatttctgttgataaagcaaaagtagagagagagagagagaggaggcttggaaaaaaaatggacatcacaaaagcaggagaagaattgcaggggaaagttcagaaatgaaaggagtgaagcaaaaggaagataaaacaaacaaaacaaaagcccagattcctctccaaacatgccatgcccatttcccctccaatctctctcatctcctctctctctctctctctcttggttctctctctctttctctctctcactagacccatctctagaaagataaaggagctatgaaagaaagctctaaaaaaaggccatgagagaccttaaagattgacctgagatttgcacaggaaatttgcaacaacaacaacacaacgagatatatcaccttgatatatatatctgttgcaattgcaagaaaaattcttttctccccttgcaattattctgtgctcatctcaatcaagctagcatgctgagtagtggaggggagttgaagagctcctccttggtgcagcagatggtgtgggttggcacgggcaacagcagcagcagcagcatcatgggcagcttgaggcagctgccttgttctgaggagcaagatgcagcttcgtcttcagcctccatgctctttctcccccagcagctgctgcttcatgcatcttctaattcatcgccatgtctgaacattcctgaggtgaatctcagcactggtcttcatcctcttgggagcttccatggcgatgtgcagcagcaggagatcatcagcggcatgccagatcagtcatggagacaactgcttctgtaattaattaccctctctccatgcatctctgaattaattctctgtggtctagtcatgaaattgtaggtgcactagctaatttgattgttaaagtaattgtaggttaattacttcaggcgaggaaagtagttaaagcagttgtctgctgcttttattccgcttttgggtgctttgctaatcagcaattaatcacatgtacatctcacacatgcatggcactaacttgacactaattgtttcttcctgcatatgtgtgtatacatgtactcctacttgccttgggaaactacaaatcataagcagtggtggattagttggagatcacgagaaatacagtgtggccacagctctcctgtccaaagggctagatgatgaggcctctatgcctcacgaggcatcagctgctgcttatgatttctatggacatggcggcggcgccggcgatgggatcctgcaggcatcgccggaggccagcagctgcaagtcgcagctgagccagatgctcctgcaggcggcggcatcctctcctaggtcatgcgtcaccaccagcggcctcggcagcagcatgatggatttctccaacaccgcggcggtggcgccggcggcggagccggagttgacgaggaaacaccatgcaggccagtcagataactcgtcggaggtgagaaaaaaaaactaatcaagactgtactgtgaaaattcattttgtaaatttgtatggaaatttcttctttctttctacattctcacagatgtgatctccttggtaattgtgcagaatgactcaattgagctttgctataatttccctcctttggtgaaaagctactacattttccatgtcccttagggaaaaaaatcactttttgtttgctgcttatgcatgtacatgtgccaaacctgatcccatgtttcaaacttttcatttgggatcttgctttcatgatgatcccttgctaaggttgtagagagatggatacactttaattgcatcatgccacacgggcaaagttatttatttttacatccataaagtcagtgtgtactgagctagctaagctatatatattttcgaccttattagctagctatatatagttgctcatcttgggacaaggatggaatggcctcatgatggttcttgcttttgcattggcttgtttaatttgttgtttctctgctgctgcagtgtaacagcacagagacaggttcagctcttaagaaggctagggttcaagcctcttcttcagcgcaatctaccctaaaggtttcttcacgcactccttttcatatctcactttatcatctttggagtatatgttcatcttgtgcctagctaaccgcattttggaatctgtctcgtatatacaatctagcctgtaaaacaaaagatgtaagggaaattaacattaacactttaagattctctggtttctgatggatttaattttgtcgtaggtcttgtgtatgtggtcacgtttacatttagaaagtgtacgtgtcctcgcagaacaaatacatcaatggaattgaagatcgtagcttgctacattgcatgcattacaatacataatttgtatctcttctataccaaacattttatttcaggtcaggaaggagaggcttggggacagaataacagctcttcaccagatagtttccccatttggcaaggtactacagcaacttaattaaccacaaatcactagttaatgtaatactacctctgtcccacaatataattatattcaaatttgtcttaaaataattgtcactgtacattactaattgttccatatcattttttattcagatttattcctattttatcctcaactaccttcccactcttacctatacatcatttaatgagaagtaccatagtctttcatcttaaaccttaatatatgctaaataaattagaattacaattattttgaaatggatgtagtagtgcactgcattatatttgtaaactgcacacaaagaggctagcctagctagcaccaaatatatctactaccagtagattttatactttgcatgtgcatgcatatattctagtacctaggtagttctagttcatgcacaacatgtcaaaaatattcttacgcatggttgtttgtacatctgaatctcttgtgcatgtataggctttgaactctggccttttcctttttgcaactgttgttaacacacacacaatgacacaaatgtactgctaacaccgtaacacgtagtacaaattaacaaatgtactactggagtagcatagtgtagtttctgcccatctcctcgcttttgagctgcatgcagcagcttctttcactttataggagtcgtgtgagtgaaagtaaagcaagtctctgacatgtatacgtgttccttcttttgcagactgacactgcatccgtactgcaagagaccattggttacattagattcctcctgggtcaaattgaggtccaaccccttctctcaccctggctaatcaattagccactccatttctatcatttccatccatatatatacatagagagagttctaattaacttcagagtgcatgtgtgtgtctgtctctgatctataaagctatatatgcatatgttaataatttctgataattgattatatcaagtatgaatgattatatatcgcagtaccaagctatccactaattaatgcatatgcatgttttctgtcttgataaaaaaggaaagctcaaaactttctgtttcagttttgatttgtctctttgaatcattcgtttgtgcaattaattaacttctgaagcaatgcaagcatatttggatatatatatatatatatatatatataattaccaaatgtgaggttagcagcaggatgtggggcttacacgtatacatgtgacagaaattattatgtaaataggtgaacccccctaaaaaagaggacttatattgaagggtactgcatgtgtggggctgggtgtaagagcacgctgttaaagctcgtttgcatatgcatggcatggctgggtcatcgtagcagctgcagcctgcgcatcaggctgaagccacagcagcaagttgcacacatgcatgtacccttcagtagtacatgcaacatgtgtgatgtcttgttctatagctagtaattcagatacatcagtaattcagtagttctaaaaaaaaatcagtaattcagtaatactgtagattccctcttgttgattgcatgcattgacatctgccctctctctctctctcttaaattaaggaggagaaacttgatgtcgaataataataataataaaagtatgattgtacgtgttaagaattgaacacaaaattgatcttggtgttggaaccaaacatccttcatcgttattatttcagtggcaaatgcatctccataatatataagcaagtacatgactagtactcgttgtctaatttgtaggctctcagctacccatacttggggcaatgctgctctgcgaaccccatgcaacagcaaactgtaagtctctctctcagtgatgcaagtataatatatatagacgcacaatacttaggtacgtgaaagtgtacttgcagttaattaagaagcttagttgggcacgtgcaactaaaggttatgtgccttagaaataagggaaaattggttccacgccaccgaaagttgtccagttttgctttgtaccactaaaagatgccagtgcactttaataccatccaaaatttgctccgttagctttcataccatttccgtgtaagtcagagtttctcccgttaagcatatctaaaatgcccttgtttctggtcaacaaggtcaagcctcaagcgcaaccaatccatacatggcgttggcctgtatgtatgtccgccgccgcgcatgatgcaaccggagcacgaagctgtgcttgcgccgaagccgctcatcgtcctggccacagcgtgcgcctgtagctacgcgcctcctgccggagtcgctggtcctccctggccgccgaagccgtgcagccgctcgtcgtgctatatttttatataaatttagcaaaacttaaaagaagtttaacttcaaaaaaaactaattaaaataacttatagagggtgtagaaactgaaaacttggcaggaaagcactagcagtggtggtgacctggtgggtgcacttaacatgtcgggaaattaaaatggaatagtgtggtctagcttatcagtccaaatctggacaaacactgacagttacttatgacggagacgatgagctaatccttccatggacagtcatcaagaaatgtctaaaaaaataaagcagtggtttatctcgaccgagcaatttttttcccacagattactagcgatcgacatgtcacgcagatgcatatcatcctcagggagaaatcggggtgggaagtgtttatcgatcgtgcagtggtggcaaagctaagatgaataggacatacatatatttggtcacgtttattttcttcaagggttctatgatcaagttcagtgtactttggcgccattggttgtcaacgtacgtgttgggggtttgcacatcagtttctgatgttgcatcaagtgaaattaacttgtcttaaaaaaagagaggtggaattaacttggatcgtgcatgcataccggctgtagagattagagagggtggcttggctgtggcctgtggactgctacggtgctaccacatgttgggaaggactggcagatgctgtaatccttctctacaaatttctctccgtcctataataaatcaatctatcatctctatctaaaatataagatttttttagattaaacatgttaattaaaaagtatgtagaattaaatatatgaatgttataatgggatgagaaatgaaggtaggtacgaaaaatgaataatgcatggttataatttattggaaagaaaatgttggtggaaaagttacttatatttttgaacaaatcctgaagaccgaaaaaattattatattttagaaagaaatgagtaatacaaaaatgtaacaaagagcttaaaatgtactcacatctcatatagaggagtgtttggattcagggtgtaaagttttggcgtgttacatcagatattatatatatggtgtcgcatggggtgttcgggcactaataaaaaaactaattacaaaatctatgagtaaaccgcgaaacaaatttattaaacctaattaatccgtcattagcaaatgattattgtagcaccacattgtcaaatcatagagcaattaggcttaaaagattcatctcgcaaattagtcacaatct

SEQ ID NO: 64625 - DNA, 1121 bp, Oryza sativa
tttggccacctttccggccagagccaactcggcctgctgtttgttgccccagaggaggacaacatggagacgatcgtcgtgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 64626 - DNA, 7118 bp, Oryza sativa
  unsure (1)..(7118): unsure at all n locations
gcaacattgtcgccgttatccatgtatgccggcaaggacgtcttttggcggtgaacatcgtgatctggcagatttgagcaagcaaagccattcgatctgtataaattgcaggggaatcgatcaggttgcgtgtcgctgatagagttggttacaccctctcctctactagtagtagaactgaatttcttgtgaatatgcaactctggagccaatcttcaggacagaatgcagaggtgactacatgacatatgacaccttagtggacctcactgtgatttgtctccgagcaaataaactgattacgatgaccaggtaaacttgccatctgtcgaaccaggattgctcaaatcgattgatcttttcctttccttctactgatccaaggccaggagagcagacagacagatgcaaataatctcaattttctctccaaagattgaaaggaagaaaagggaatacgaaaatgaaaatgaaaatggaaagggacaagaaatattctgacgttttgcttccactctgttgagttctctgaatctgaatccagtgagtcgcgctcctcgtactcaagcttgctcgcacgtctctgcttccactcagttgaattctttcgatctcgacgtcggtctagtgacgttctcgatcgtaatctcgttgtcaggcactaattaacctgttccaacttgtcggaagctgatatacagtaacatagtagtactatagactacagtgtatcttgttgagatatcagtctttgattgtttcggagctcggcgagatcgaccaatcgatgcaagatggagtagtagtaatagctgcacgaatgaataagcttcaatgttcaaaaaaaaaaaaagaatatgcttcgagtactggtgatcgtcgtgtcactctccactggagctagattactgctgacagcaaccggataggccaatttggctgcatgggcttcatgtcttgtccttctgctgttaagtgcctggatttttcacattttggttcttctgaaaaacttattttataaatggacccttaaaaaaacttatcctagaagtggtcctttttgaggccgctgcatgtgcttcatgtcctgtccttctgctgttaagtgcctggatttttcacattttggtccttttaaaaaacttatttcgcaaatagacccctgaaaaaacttatcccagaagtggtcctttttgaggcgccagagtggctggcgccgtcattcaacgggacggcgcccgttctcctgccaccgtggcacacgcgaaccgacgtggcaggacgagggcgccagcatggctggcgccccccacccctcgccttcattcctgtttctctgtatggagttgcaacagtatcatttttgttttattttttcggatgttttctcacacttaggatcacgatacaaccaaccacaaaaaaaatttaaactcgaactaccacttagctaagtctgaaaatagctagcataccacttagtctactttgcacattcactaaaattagaccataactcctttagtaaaaccctttgatcaacatgttacacataattcactctatcactatatgaaattacttaatttaattcaaaatataaccacatgaaatgatagccataagttaaacaatatacagagatgcaattttttttatttttatttcatttttttgatatttttttcacacttaggataacatagaaaccaaccatataaaaaataaactcaaacggacaaaatatgtgacttgtagaatttttcaaaactctaccgaaatggacaaaatatgtcattcattaaaatatgcgtaactttctcatacggactcggaatcaggaaaataatatatccactgacatacatatccgggttcgacgatattaaaacctccgaattccgcttgcaagattgtgttttcgaggagagaagtttttcggtagagctttggaaaattccacaggccacatatttcgtccgtttgagtttattttttatatggttggttcttgtgagttcgtaagtgtgaaaaaaatatcaaaaaaaaaataaaataaaaataaaaaagttgcacatctctctcctttgcactagttcggagagaggagaggagaggaaaaattctacaggtcacatattgcgtccatttgagttcattttttctatggttggttcttatgtgtccctaagagtgaaaaaatataaaaaaaataaaagaaaaataaaaaatatcgggggaggggggaggggcgccagccactctggcgcgctccccctagccacctcagcatcgccccgccacgtcggcagggagacggcgccagagaagctgacgccgtccagttggacgacggcgccagccactctggcgccccaaaaaggaccatttctaggataactttttccaggggtctatttgcgaaataagttttttaaaaggaccaaaatatgaaaaatccaggttaagtgcagtagcaatgtttcgttcttatctaattaagatgtacccctctgtcaaaaaaacctaatcctaacaacgagtctggatacatgcgtgttcagattgattgctaagattagttttttttggacggagtagtatattttggtttccgttagaatttttttaaaccgctaaacgattcattttcttcgaaattttttatagaagttgctttaaatcagcatataatttctttttaaaaataatataacaactaaaaatcaattaatcatgtattaacgttttgttttccatgttttaactttatctccagtataaacgaatgctatctacgaaaatcgagtggtggaccgtctccgtttagctcagctgttggatcagcccgtgcgtcggtgcgtgcggacaaatcgatatgaggaattctcctttttcactgacacggtgtcacggtgacacctctatagctcgtcaatgttcttcagggactatcaagaccgattccgattgctcaactatatatacggccttcattaaatgtttccaccgttttacgcgaaatgaaattatagtattgaagaaatagcatataggcttatagctgcagttctttctttttaaaaaatggcatctttttgaaaaaaaaaatcaaatggcacaacattggttcatactagtagtacaggaaactcaaatagagagtgataaagacggcccaatttcacagtccaagccggacctgcccttttaagcattcttagcccaaccaatggaaggcttgacccagaaccaaatctagcccaaatgctaattatttaacctaaaattcttattcaataatccaaacgagtagaaattacatgcacctaaaaaccaatcacttctcatacattcattatttttactagctcgagatcaaagttattattaaggcctaattaacttagaagtcgccgtcattcctaggaagcggctcatggccgggcgggcccatgaagaggccctcataaaccagcccagccaaaggcccacctataagaggcccaacccaatagatccagtggtcggcccattcgccggcggcgagggccgggccgaaggagcgggccgggttcatggaggcgccggagtagggcccgccggcgaggatgttggcgccgacgacgaggccgacgaggagcgggccgagcgcgccgacggcgcggcgccggtcgacgacggtggcgtagacggcgaagaggagggagaaggtgagcacggcctccatggccacggcgcgcgccgcgccgacgccgggcgccggcgcgtgcaccgggacggcctcctcgccgccggtgagggcggcgaggaggaggcaggcgagggaggagccgagcagctgggcggcggcgtagagcgcggagcggaagagggtgatgtggccgccggcggcgaggccgagcgtgacggccgggttgatgtggccgccggagacgtgcagccccgcggagaccatgacggcgaccaccagcgcgtgcgccgccgccaccgccgtcagccccattatcgtgtcgccgccgccgcccagcttggctgcaccgacgcaaggacgacaatgtcgatcttgattgagatgagaagaaaaactaggagaagaaatgaagtaggcaggttaccggcggccatggcggagccgacgccggagaagacgaagaggaaggtgaggaggagctcggcgacgacggcgcggaggcagccggggtcggtggcctcgcggtggtggccgagcgcgagcttcgccatgtccgcgccgtacgtgcgtgcgtgcgtgtgggtgacgtgtcactcgcaagctagctaggtgaggtgattcccgcgagggaggacaggaggagatggtgagttggatgctggagtgtatcaattgacgcctagatatatagtgctagcaaggttggtgactagagaaactaaacatggtgaggcgatgagaaaaatagaacgtgcttttcgtcgatcggtagccaaacgttagattcaaaacatattatcttagggacgttttaatcccacgaatgaaaaaaaacgaaggaataaagaattctgatagaaatacaaatgttaaacagaggattgcaaaacgcatgaaatacatatgaatgttcgtttgattagactgtatgaaaagattgacgctcaatgaaaatttttcgagattgacgctcttaataagttttctctaaaatctctacagaattatctattccatattaattttaaaggataaggcacgattcaatcctctgtatcaaagacgttcatagaaaattttttcataggattaaagtcctccataatgttattcctacaaattaaagaagcccttaaattgaaacacacaagtagtttatctgtgctaacactacggtaacatttgataatacaactcaaacaagcaatggtatatgttttagcgagcatagaatgaggtgatggaataaattgatacataaaattattatattcagtaagcctagctaatatttatcaacctacagcttacatacagatttgtgtccaggttacaacgaacatattttatagcatcctcgagttgtccagccaaatgccaagagaaactggaattattgcaataagaaataatatgtaatacaataatcagacagcatgtcctatggatatcacaggcgtgcttgcaaactaaagaccgtagtgggcaccatcaaacagaacaccatgcgcactgtgttcacatgtaaagaggaaaaaacggaattttcgtatgcgatggtgtcacccgcatgaaaaaatcgttatttccatgcaagacagttgcatgaaaaaaaatagtttttaccgtacgtaaanatgctttttaatagtgcgacggggcaattaatttacaggaccgatcgggctagcactagcagatcgacgtcgtccaagaaccatgcgtcactccgctcaatctcggcgatctctacccgcagttcgtgcgaaccatgtattatccgattgggtttcatcgttcacgaacggattgctcgatatattgtgtggtgagatcgaaagaacaccggagaaaacaccaatgtctccggtcattttcgaggcagaaaacgagagaccacactgacagcagcatgcatatatattgtggatttgtggtggcatacaaagacggagaaggcatttgctgtgtacgtgcgcgcactagcagctctgcgtgaggagataagttttcaatggatcaggagtaagtaggtggtatgtgatatttttattatttaaacccttttgttttaatattttttttaaaaaaaaggtccccctcaaactttattttaaaatctgaatctttttgttggcgtggccaattaaccatgttatacaacaacaacatgcaccggcgttacagaagacatgtagccacgtcagcatgctaccacgccacttatattggagtaactatacttctaaaagtgcaagaggtgtttgtgtgattaaatgtttaaaatgcctctcatctccacaacccttcacctggcatgcttcctatcgaccggaacaattaataaagaacaatatatttagttaacccctctccttaatatttatgaaagctactaaaaactcaagaaatagctatattttggtacatagctcagcctcccaagttgtcaaagctactcttcctgaaactacaatacaactacacataataatcgtatggctaggcagtctctctcaagtcagagaccatattggcaacaaatggatcagaccctgtttagatgagactagaacttttaagtccctatcacatcggatgtttggatactaattataaatattaaaaatagattattaataaaacccatccataatcttggactaattcacgagacgaatctattgagcctaattaatccatgattagcctatgtgatgttacagtaaacattctctaattatactcctagattaattaggcttaaaaaatttgtctcgtaaattagctttcatttttgtaattagttttgtaagtagtctatatttaatactctaaattagtatctaaatacatagactaaagttaagtccctgaatccaaacaccacctgtcaattaactatcacgaagctgccattatattgcgccatggtcagtgaggctgacattgaccggacatgcaccgcaggagggtgaagctgcgatggatggcgtcgtccatccaaatcctcaccgttgtgtggcgcacacactctccgtttcgccccgtctacttagggcagccacaatgtgaacataagagtagaccttaagcctctaaagtgaccttatatattgtgagagtagttcttataggtggcatttgcttgagctagccatatgtataaaaaccacccacaaggaataaaaaattatattactccttcctctctcatggcagtgttactttctctccctctctcaatggctaatcttgggtttgtagggtccaccttaatatccactcttgacatatacattgtggacatgataacatgttttagtggatcccaccataatactaaggtagtctatattcattaagtatgctcttagtgaaatagttctcgtctacgattcgtgaaatgaatctcgtctgt

SEQ ID NO: 64627 - DNA, 552 bp, Oryza sativa
accgttaagttggggccatggtacagtacactgtacactgatcagaacactatgtatacatgtcttcagtaagaccctgtttagatgagactaaaacttttaagttcctatcacatcggatgtttggacactaattataaatattaaacgtagactattaataaaacatatccataatcttggactaattcgcgagacgaatctattgagcctaattaatctatgattagcctatgtgatactacagtaaacattctctaattatggattaattaggcttaaaaattgtctcacaaattagcttttatttatgtaattattttttaagtagtctatatttaatactctaaattagtgtctaaatatagagactaaagtaaagtccccggatccaaacaccacctaagcgagtcttaataggaagaagaagaagaaaggaagtaacagattaaacatgcgcactgtgcaggtagccgacacaattatattatgcattggcgtcatggcggagcagagaagcaaccctaaagttttggattatgtcctcgttcc

SEQ ID NO: 64628 - DNA, 1318 bp, Oryza sativa
tgttgtagacatcgataggttaattagcatgtatatatggagaagcttttgcaaaggaggtatgcatggtatatatgagtagcaaaagtaaataaagctttctggtgtcctctcaaagaactatacatacacgttaacacgtaccatttgttttcactctttttgaaaggaatccctttgtgactcaaaagaaaaagaaaggatataagcagtactagtatatgataattatacagtatatacaattatctatgagagaggagaaattacatgcaatatatagctaggaggatatatatcaatattacaatatatgtactcatcagtactacccaagaaacagaaggaataattagtgtgttttggctgtgtttagttcagcgcaaagtttagattttagttaaaattagagatgatgtgactgaaaagttatgtgtgtatgacaggttgatgtgatggaaaaggactgaagtttggatccaaactttggatctaaacacagcctttgtcgaaacctgaaaggaatacacgtactagctagctagcacgatgcccatgtatgcttttatatattctcacaaataacactacaacaaaaacctggtatagaggaacttttgtagaggcgttttgcaaattgcttctaagatcagaagttttatagtgtagagacactttataaaggcactttacaaattgtctagaaaacttttactctagagacatttttagctcagtttgttagattttatcttgtagaggcattttttcggcactataaaatgcgtctaatatgtaaaggcattttgttgagacattttaaactatatagagacactttttagaatgataatgtgtactaaaggactaaatataagtaactaaaggaactaacataaaagtaatgatatggagtctagttggttagtgcatttaagataaaaatgatttaaccgagagatcgtgagttcaaggcttgacaaaagaaagaaaactattttattctcatttttggattggttttatatgtttgtggtacaatttaatgtctctagaaaatgcctctaccatcttatagacactttataaaatgtccatttgtttacagagacaattcaccataagacacttattagacattttttaaaatgcctctacattgttgtaaggcatttgaaaagtgcctcgacagcactagaaaaatgtctctacaaagtctttttcttgtagtgtaataaaataatatatgcaccttttttactcattacacatattggacaattatattgatcgatctactgtacacaatacacataac

SEQ ID NO: 64629 - DNA, 7758 bp, Oryza sativa
taagggtcagtttggattaagggatttggatccggatatatttacaaaatccaaaactagaccatttatttgagaacaaatgtccatttaaggtggatatattattcacaattgcgtactccctcagtccaaaaaaaaaagacaccctggtttccgtgtccaacgtttgaccgtccgtcttatttgaaaaaattatgaaaaaattaaaaagataagtcacgcataaagtattaatcatgttttatcatctaacaacaatgaaaatactaattataaaaaaatttcatataagacggacagtcaaacgttggcacgggagcccacggtttgcctttttttgggacggagagagtatgttttatagagtcatcctaaccatgttcacgccctattgcacaagcccattgggtaaaagaaatcatttggtgggggcaaagtcctgaaagtgcaaagtgtgcaactctaaccaccattgtacatctttgtattaatgtatttgcaaagccctaacaacattactacaataatgaagaacatatataaacattcaacaaaattgataatctcattctgactccttcctctctttttttcccaactgaatggataattagttatcttctcttgcaaagattgcaagagtctttacaggaattaatcaactgctataaaataacaaaatgcttgttttcaaggagcatttgcaatagaagaacgtccacaataggttcaatccgcatctcttcttttcttttttctatcattaaagaagatccacagtaggttctcttcattcgatgagcaaaatgcttcgtgtgatcgagctgcggaaaacccggattgcaagtgaataatttttgccttacaaattggaataaatttctctgattaagaagacagataagaaaaagaagacctgaatcattatctttctttttgaactaaggaatcattatctttccgtaagcataccaatcatgaaccatctttgtatcacaactcctggggttgaagcagacaagaccgtgtgatctgattaaacgcgaaattatctctagtttataagctagttggagaatcatcataaggctggctaattaaactgtaatgcgcttattgcatgtcttggggcttgtccatttctcttttctttctttctgatgttctagatgatattggctcatatcatgggcactgcactttattctagtatcttgttgctaccaatgattcagattatgcttgcgcacgtaagagcatcatcacccaattatatacagtagccgtatatacttagtatctgtaattaaagtattacaccatgcatttgatcctgagtgaaaaaggcccagtatatggaatgctttctttcatttattctgttttctcatcaagaatgatcattcagtaacttgggttcagtctttcagaattcaaagaatattttaactgaattctgtgaattctgtgaattctgaaagagttctaactgaaatcttgaagacagacagaaatccacgttggacttgctatgctaattgagttgctaaccaaaatggtcacaactacatgtcttgctcagctattcctgtgataattataataaaacaagaccgcatttctcaaaccaaaaggcacaagacaccaaggtctccacagaagagcacactagaaacagtccgttcttccaaaggcaaactttgagctcttttgtagagatgccatggaaatgcaaaaaaaaaaaaaaagtgacacttgattagaacccactaactattgcatgatcccataagcacaattaatagcactgcctaccccctcttgtctttctcctagctcccataaattggacaacctgacagtgtcctccccctgtacttgtctgaacttttgatttgagttacttctgaaagtgagcttataatttgatgctaatctccatcctacattcctacctccaaactcagtcctaatcctatcaaatctactcatctaccatcaatttctaagtgtgtgtaagtttgctaaaatctatattctgattctcctccttaatttgttcttgatatgatacacttttagctgcagttcattctgcataaaggctactaattaacttgttgacatgtagatttaagctataatcaccaaacacaatcaaatggttcttgctaatttcctcttcactcttcaggcaatggagcaatgccatcatcatcagcagcagagcaatggccagcagctgcagaggctggagggcattgaggaagaaggcggcgccgccgagaagtggccgccgccgacgactgtccggccgccggagacgccgacggagacgatggagttcttggcgaggtcgtggagcctgtcggccgccgagatctccaaggccctcagggtcctcagcggcaagggcgtctccgacgacgtccacgacgccgccgccgccgtcgccggcgacaggaaggagcggaggtcaccggtgaccatggacggccgccgccatgaacaggcaagcgaggagaacgaggcagcatctatggtgaaagaattatgaatcatcaggtgacgtgacgtgctgtgtggtgcatggcatgcagagagcggacgcgtcgtcaatggcggcggcggcgcagggcggcgcgatgagcccgcccatctctccccgtgccaacctggacgtgaagcttctccgggcgacggctacggcggcggcggcggcgggagggagaggcgggggcggcaagacgacgatgggcacgtggatcaaggagcagaaggagcggaagcgcgccgaggcgaggtcgcgcaacgcgcaggcctacgcggcgacgtccgtggccggcgtcgccgccgcggtggccgcgctggtcgccggcgcggtgttctcccctcctccggaccaccccaagaacggcggcgccgccgcaccagcaccggcacccgcacacgccgccggagcggcaggcgcgaagacggcggcggccatcgcgtccgccgccgcgctggtggcgtcgcactgcgtggagatggcgcaggcgatcggcgccagccacgaccagatcctcggcgccatccagtccgccgtgaacgcgcagaccagcggcgacatcatggcgctcaccgccggcgccgccacggccctgcgcggggcggcgatgctgcgggcgaggctccacaaggagatccaggccgccgccctccccggcggcggcgccggcgccggcgacatcagcggcagggagcccgagagggacacgtcgccattcgccttcgtctccagaggcggcgagcttctcaagcgcacaagacaaggcacgataacagtacaaattctcccaaaaaagagcttaaactttcagagatttttcaccaaaatccaatccaaataacactcccatacgcgtcaaattgcaggcatactacactggaaattggtcaccgtctacatgaactccaacctgcaggtgatcatcaagatgaggagcgcgcatatggccggcaccttcatcaagaccaagaaatgtaagatcaaactaaacaccatgatcggaaatggattttaatcaatcgaggaaatatttattcctccatgttgcatgttatccaaatatatcataaaaaatttaaaaaattgataagatatattaatatgtaataatatataatataactttacaaacatgctttaaaaaataacaaatttaacagtaatttatatacatgtgcacatagtcatatttgttttgttttttaaaatttaaactcaaatgtttgttgagtgatatatcacatactaatttatctgttattttttttacttatttgaataacatgtaaataaacgatgggatctttcttcgagagattagaagtgtttgcgatcatatcctcatttgctctcaccaagattgatacgatgattcatgtgtgtttgcaaattatttgcagttgttgtgcttgacatctgctcggagatcccggcgtgggcggggagggaggtggaggaggggagccacaggaggggatacttcgggatcaagacggtggagaggatgatcgagttcgagtgcaggagcaaatacgagcagcacaagtgggttcaagggatcaccgagatgctcaaccgccgtcacaccatgaaaaattagttaaaatgtttccaatgtaaatgtcaaaggaaacaatcggtagtagtaacattttgtgtggtttgtgtgaggattgggagtgaagatttccatgttctctgttataactgacattgttgttattactgcaaatccatcatcaagaaaaaaaaatgttcccaggatcttcgataagcataagaattctttccctaagatcaaaccagacgagtaggggggattccatctcaatcaagcgatcaaacagcaaatcactgaactggtactccaccggaatcatgaagtaaagaactaccgtgatctctcatggctctgaaagatcatcagtgcacggtcgatggagaagttatcagagtgatgtacagcagtattatcagcgcaagttacctcgtgttaatggccacataatttttcaattttcatcaacttcgtgtctttatcagcggcgtagttgcatgttaatagaggacgcattgcatgtacaacacccattaacattacttgattacgtcaagtcatcaagtctctaatttagcatcctacctcagtatgcacatcaccgctaaaactccctcatcatatcagcttacaaagaacaccgtttttcagaccaatcactgcttgaatatctagaagttggtactccatttttttttaaaaaaaaaaggattttccatgttctgattttcgcatcacttccgacatctgcagttgttgctaaatataaatcaaacaaaaaaaaaggagttttcatgttctgattcttgtgtttgactctgattacttacgttgatgctaaatgtcacatataaccaaaatctcaacataaactgcaagtcacacagatatagccaacattcatgaccacaaattatcttatcatacttagcaggttcacaaggccttctggttcatgagcatcaaacaccaaaactactgcaagagcatgagcatcaaacaccaaaactactgcaagagcatgagcatcaaacaccaaaactactgcaagaggaccatgacaaatttgctggatatatgaaagcaaaatctaatcaaagagggagaatccaaggtcgtcttcactttcttccttctcctcttccttcttctcctcggctttgggggcctcggcggcagctccaccagcagcggcaccgccagcagcagcacctccaatggcagcaccaccaccaacagcaccgatgatcacctgcgaaaagtcgaggtcagcactacataaaaatcggttacatataaatggtatgaccatatgttgagtgtcaatgcactccacaaaacaaaggcacacaaacctaccaatggctacttcgcatatttatagattacttcctggcataaattgtcaactaacagcaagagaattgacaatcgtaaaaatataagatcacagagccacaggctgtaatgctaagaaacacaataaatatctgtagataccaatttctatgtcatagctagtagttaggccagatagataattggcacaaccaatgccaacaacccgtttatctatttcaaatgtgaactagcagtaatctggaaacgagcacgatgtctatagatgaaatttgggctagcaggcaataccccaaaatatttcttttgcacacacgaattgaaaaactagaaacattgttatctgctaaattccagttgcaatgagatgtgcacttgacgcctaactatcgaggccacaacagcaccaaacatcaatcaaacatggtacaacaaattacccatcaacaccacatatctgacactaaagcagcttaattattgcctatttagatctaaacagaacaatataaacagtcaacacacatggattacaatagatggatttatacagaatatcgagaactaaagtaatcaacgcatctgacgaaatagcgccgtggcgacgtagatcagcaggacaatggcgaatcgaacagcagcagcagcagcagcgatggggatgtggtgggggggggaagcagacctggaagacggcggagctgggggagaccatggcgaaggaggactggaccccggcggccgagtcggcggcggacgcggcggcgacgaggcggcgctgcagctcgtagggggtggcggcggaggcctcgagctcgcccttgagctgcttggccgtccactcctcgccggagctccggcacacgaaggtgtagacgcccatgacgcggcggcggcggcggcggcggcggcggagatggaggaggcttcgggaaggcttgcgaggcgagtggagatcgaagccctaatcgcggggtctcccgaggttatgtagtcttctgctgctgggcctacttgggccggcctaggaaaagcccatgatgagaaaccgttacaactcggcccggcccatataactatgggccataattttcctttttttttctttggatttgtcatctggatgatcagcttctctcccaggattattagtgacgccgtgcttagttctaaagtttttccttaaacttttaactttttcatcacatcaaaactttcctatatacacaaacttttaacttttctgtcacatcataccaattttaaccaaacttccaatttcggtgggtcctaaacacagcctgaacactgatggtttgaggacgaaccaaaaaaaattgcatctgttgggattactaaacactgttgtgctaccaaaatgtgaactagaaatgctatgcctcgtgaacccaaaatcatcgaacaagccctgaaaatacataaaccttatcgttcacttcgtttatgggcatgtttggtacagctccaactcctaaatttagcttcagaagttaggtctggaggagagttgtggagctgcctaaacccagctccgcaactctagttcattttgtgagagagctccacccagctccactctcagttttggtaaagctgaacctcctgtatgactgaactccagctcagaaggggtggagctagagctgtgccaaatatgccctatgtatttcttttagttaagatatacattatcctgttctttaattaaggtttttatcttggcattgaaagtgcaagcaagcagatatatttttctacagaagacctcaacaacttcatgcaataatcatgaaaaaggaaatatattaagggcctgttggtaaatacacaataaatcctgctaaaattttgataatattaccatcctactaagatttattttgactataatctaaacaggccctaatatcacaaaacatttagacgatcagtcaccatcccaaacaagaggtgcttagaaagagagaaaaacaagatctgtccacgtgattaagcatccgtgtttctccgatgcatgagaactcttgagaaagttttaccatgactgacaagagcttcagttctacgatcgatttcctaatcaaggctgtatttagtttgtgtgccaaaattttttaagtatataaacacacatttaaagtattaaatatagactaataacataacaaattacagatttcgcctgtaaactgtgagacaaatttattaaatctaattaatccgtcattagtaaatgtttatggtagtacaacattgtcaaatcatgacg

SEQ ID NO: 64630 - DNA, 903 bp, Oryza sativa
  unsure (1)..(903): unsure at all n locations
cccccctctctctctctctctctctctctctctctctctctctctctcacacacacacacacacacacacacacacacacgcacgcacgcacgcacagaccaatttctgattcattgtcgtcttgctaggtttagcctggcagctgtttgatccagagtttgtcagttgggagctagtggtggtgggatttttctttttttttttgtttttatggattttgttgggaaaagattatgtttggggttacatgttataagctgattgaatcaactatgttatcatgttaaaaatgctagttatgtcagctaatcatgattatcattctggaccgatgaactcattctttgtttcaggctgttgacagtccaatgtctagcttcactcacttcatctcgcttccgttgggtatccacccacaacttgttgataagctgaatgaattcaagaggtcaatcctgacttctaatgaatataaaggtaaggatagggacctaagtgaagttctatacttctatagttctatggatgaaatgtactattaacacaagcaattagaaaggcctagtgtttcaatagaatgcaagttcaagcataggagtctgtcagagtaaaagaggataataagggcttctgccctggtctaaaatctttgctgattttgcaagtgctttatgttccatttttgatcccccccccncccccccggatttctggcaactctagaaagccacttttggactttcctagtgttgtgtctgtgtcaataatgcatttttatataagtactccacagcccacacatgtgtaggttgtttgatgaaggaacacacgaccgttttaggctaaatagaaataatagtaaagaagtttatatgcatatggatttttgtaaataccctcca

SEQ ID NO: 64631 - DNA, 958 bp, Oryza sativa
tccagatttggactgataagctagaccacactattccattttaatttcccgacatgttaagtgcacccaccaggtcaccaccactgctagtgctttcctgccaagttttcagtttctacaccctctataagttattttaattagttttttttgaagttaaacttcttttaagttttgctaaatttatataaaaatatagcaaaattttcatcagaatacaaaatatattgaatatgtacatttaatagtgggtctaatatatgaaattaatttgttggaattgtagatatagccgtatttaatagaaacgcagtgtcgtatgacatggaacatttggagttctaatggttagtaatgtgataagattcatgtacagatctgagaaacagcccacttaacacgcaacggcgattgcatatctcgatcagtttcgtcagttaattttctctgcaacttcctgaacttctgtttcatttcgtcatttccctgaccaacccaaccgatcgtcatcagcacgttcatcacggtcagcgtctagaacactgtggatatatgcttgatagtacagtagtagctatagcttggcgtgatcccaaattaaatcatccccatacctgacgcgagaaactccagagactagcagttcgtccagcccttcaagcaactgcagccatgaccatgaacatattcagatatatatgccctcctagatagctgcagctacagctagcaccgcatgtggcgcacatggagtgaagctgttcatccgcggatgaatccaagcgacgcccatgcatacgattcgatgcatctcggccggcgctctggtgctgatcatggttgtcaatctcaacctgaaagaggagctctatgttgtcgccggatccaatcagtaagggcctgtttggtacagctccaacttctatatataactccaggagttgagtctggagtggag

SEQ ID NO: 64632 - DNA, 4810 bp, Oryza sativa
  unsure (1)..(4810): unsure at all n locations
atatatatatatatatatatatatatactccctccgtcatataagggatttcgacattttgcttgcactatttgaccattcgttttattaaaaaaatatgtataattatttattttatttgacttactttattatctaaagtattttaagcataacttttcgctttttatatttgcacaaattttttgaataagacgagtaatcaaacgtgacgagaaaatagtgaatatctcttatgttaggggacggaggtagtatattaattggacataatgatatgagtccatatgtgactgtaataatgacagcattaaaagtctaattgcttgacgtacggttgataagtcgtaagaaaaaaaacgaatcaatacaaaataatttataggtacattttttatatctatattatatattatttatgatttaaaagtcagtgttgaaaatagactaagataaaaaaattcttagaattaagttttaaaatttaaattttagttgtagctgataagctaataagtaaaggatgagctgtgcacccagtgttgatatacactcatcctttcctaaatactgggtaccagacattattcatatgcaatttttttgtcactcttattttagcaacaaatttacaaatatttgaaatataacatattgtcaaatgatatcatgtgttaaatatataaccatataatttctcgcttagaaaacagggatataatccagaaatactgatgatcatagttgaaacaaagttggcgagcgacagatatcacgagaagaaccgcataaattgaagaggagtttctttgagagattgcgaagaaaattattgggacaattgcatccatgcccccagttttaaacccaattactgttttacccccactttttagggtttgtagttttaccctcaccttttgaatctgaatcatccgtctatcctcacttgtaacggccgtttggtgggtcccatgttttgtgttaaagaaatacaaaaggaaataaaaaaaggttttagaaaatatgaatttacctttatgcccctgagggaatggataaggtcctcccaccccgtgcatgaatcgaaatcgaaaggggacgcggcgagggcgggggtcggcgagggcgcccggcggcggcgtacgcggcgagggcgtgcgcgctatggcggcagccgcagcgagggtgtgcgcccggcggcggccgccgcggcgagggcgggccggcggtagctaggcgccgcggccagtgggtagccagccggcgagccattcacgtgatgcctttcccaggcttccacgcggtggcggccactcccaggtgcggcaggcgacgaggcaggcgacggccacaggatgcgacgaggtaggtggtggctggatgcgaactagtaactaccatttccttcctaactcctccaattaactatattagcatcacttgaatggagtacatagacccaacaatatgtatttgataattgacgtttattgagaaagtagctaatgtactatatttgtatggggacactttgtaatgcttgctgttctgttaatcacacaagctaaaatcatacaatgggggcaaaatcacaccagctgaaaaaaataggagcaaaaattacaataaccaccaaggatataaatgtccttttgctctacaactaacaccgtcaaaccgactgatacaagtaggggcataaggctggttcggatttaaaaagtgggggggtaaaactgcaaaccctaaaaagtaagggtaaacaattaattgtgtttgaaagtggggtaatgaatgtaattgtccaaaaattattagtgtagccactagtgggcttcgagttcgatcgacaggatttgctgcaattcatgccagcttccactttggcactttgagaatggaaatactccctcgtctctaaatattagacgccattaactttttccttatttaaaaaataagtaatcattatatcttttcctataatttgattgattgttaaatatacttttatgtatatacatagtttcacatatttcacaaaagtttttgtataagatgaccggtcaaacatttttaaaaaaagtcaacggcgtcaatttattttataactttcctcaaaaaataactctctcgctgaaaacaacttgtccagaaaaagaccaagtggtgtcatagcctgtccagaaaacgaccaactggtgtaaaagctcaactgtccctacactgactcacttatctgggttcgatcctcactacagtcccttatttcgaaacgaggatagggctctcgcggaacgaggtgtagattaagaagaaaaatgagcggactgaaacatgccactaaaagactccatgagacaaaaagatgggctgtcaaagaggtaaagaaggtaggattttccattttcatttctatcgtccgtgcaaggtactaaaataagaaggggatcacttcactcgctagcaagcaaatgtgttaactcatgagacaaggccaacgatatatatgtctatagcgaggtttgagtacctaatcacaaggatcctccagaatcttttcgagtgcttgttcgagaactaccttcccttcccctggtcagagtgttgaatcaatggctcttgcaacggctgtcttctttcttttccactttgaacgtatccctacatactgtcgtgctaaggtaatcgggatctcagatcatactcaatgaggggtggctagtatcccccttcaggggtatcatcccagtaagctcgtgtctttcataggaagggagctgactcccgctcccttccgtccatcagagacttcttcaagttttacaggaaaaataaccgctccgttctgtgggcttctttcgctgctctctaggatttaaccaaagcgacataattgaaagctctcgtctcagtcgctcgcctaagaaaaggtaccaggttactccgtgatgacgaataagcagcccagaaatgaggggaggcccgaggtagagcactcaatgggctagggtggcccccatttcgctttaccaaccccaggggaaactcaaaatacaggctatcatccttagtacagacagactgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctccatggcaccgaaaatgtctcagggctcaagtgattcaccgaagcgcagtcaaatgtttaggacagagggggtatatatgtgcagcgtgttccagagtactgcagaaacgaaatcactactacgacagaagatgaatgaatgattgctgtaatcgctcaagattcatcgatggatcagaagagtagtgtttcgctcgaccatcaccggcagcacactaaatatacacaaattaagttagcatgggctcgttatagatgtgctggttcacaaatgggctcaaccatggtccatttagaaggcccagtcttcacgtgaactggactgtaattccgaaagaattgggccgccgaatcatgcgccgacgtgggtctcccgtaaacatgggccgaaaaagcacaggtgctctctcctgcttcgtctacctatgctatgaaccttctccgagaattgatctgacctatacaaactacaaaagtcctaaaaatgaaagaagtaaagggataaacactcacttgcaacaagtagtgcttatcagttaagccaaacgatcattaatttggtcaaattaatcaagattagctcccacctgatcaatcgatgtgtccggccggcccgtacataattaacaaaagtataatgccaactacgagagtagctagccatgcatgttttttttaagggtatttttttacccggcttttatatccaatcgcatatatgcaacatttgtttttttttaaaaaaaaaggaatttagcctatggaatatgcaaccactaggttagccatgcatgtaggagtatgcatcatctacaggggattagtaggttgcttcttcttttgggcaattagctagccaattatgcatccatgctccatgtacacgcgaccgcccgatgcatgggccaccacacaaaatacatagattcgattcgattcgatcgatcgagagaattactaatgtcgttctccaagagtccgaagacgtacgcagggagcaatcaagcaactaacagaggaatctcacccgtacaaatcattcctggtttgaccatcgtttgctcgagatcagcttatagctgtagctaaacgtgagattaaaattttaatcatatagttgattttgattttttatcgtaattttatttgtcagctttcgacttttaaagaactaaaatatacgagtatttacagaaattttatctacaattttgttttgttttgttcgcaatcaatccatcaatcacgcatgcacatacatatgcttctcgaggcagcaagatcgccacgtgtgcgtgtgtccatccatcgacggccacgatcgatagcgatatactcctatatcgatattgatcaatcgatcgagatcgatcactgcagcctgagtgtgtctcagtgctgaattgtcggtagatgtagctaattaagctaagctagcgtctacctcaagtaaatctatcacacattgcatggatggaataattgatccaaagggccggggtacgtcgtcgtcggtaagtgtgtaattaacgcaagctaaattagctataatat

SEQ ID NO: 64633 - DNA, 995 bp, Oryza sativa
ttttgttttgttttgtttttgttttttttttccctcttgcctgtactgattactgaaattcagatttttcttgttagtgtttcttagcattaccttgtgtgactttttcatgatataggacgtactctttaggattaccttgtgttccctacatatcggtatatcaagtgtatgctggaggattatatatttcaaatataacccagttttgaacactgtgaaatcattttttctgttctttttgttgtgacaggcacggatcaaaaagatcatgcaggctgatgaggacgttggcaagattgcactagctgtacctgttttagtatgtaagttttgacaacagcctgtgctacttctttttgggtattgatgtagccatgtagtatgtaaacagttgtgttatcgctccattctctctaggggttggtacttacaaaaaaatgcaatcaagaaagcattctgccaaaagtttgtcttacattcagtaagctgaactagcgacaagtttgctctgccacatggagaagaacccaactcgcctttttatgccaagtcactggtcacatattttgacatcggttgttgcccattagaaaaataatcgttttgcatttcatttttgtttcactaactaattgatacacattttcttgtatgataatatatgtgttttggagtaccttttttggtttgttttgcataatgttacagttctagttattgccatgataaagcatacaacctgagtgcctgacattctgaatttgttctttacgtgcagcgagggcccttgaattgtttttgcaagatttaattgaccgaacttacgaaattacactgcaaagtggtgcaaagacattgaattccttccacctgtgagttctataccactgcacttttaaaattttactccgcattatgattttgtgcttttatggagtgatgtactgtttatcctttcatgtttttgtgacctatgaaaagcttgtgttgag

SEQ ID NO: 64634 - DNA, 1190 bp, Oryza sativa
ccgaatgaggccacataaatatctatatgagtctttcaaaccccatttagttttaaaggggagattcatgagctagcaattatatatacatttctcaaaatcttacccctcaaaatttcacttgacatgctgatggctttgatcacatgcggacatgcccacatataacttaggtaatgaactcaaaatttgagacagaatacagatgaatgttttgtacatcgcacgggttgtgaaaagagggtgtagagagctataaaattcacctctgacctcttcgttcccagcttcccaaaaaaccagaagatgttggagtatgccacagctaaaccatgtgtttccaagagtatagcatagcaaactccaacttgaagaacggtcattggcctcgaggatactgacccactcaaatctgagcagctactagtctgcagagtgaccttgtcccttgcagccgctatgcaaaaggagaaacagactccaaaccaggtcttttgcataataggcaccaaacgacctcctaatcccgctaaaagataacggatggaatatgtggagatcaaacctttggtatcagcattgtgatatacccgtaacgccagacagaagctccacacggtctctctttagatcctcatgtgagcagtgagctctccgggatcattgacagctccaaaatcaacactattaatcgcggcagttccatccgcatgaggtagtttcatcaaacacgttatgaagggcagggcatgggggcattccgatggctttctgcaaagtccctgacaatacgcttaagggttcttccgcctttcccttgcatgtaagcatggttgtttctgacattatcaccagtcctactgtgaagatagtctgaggctgcatcatgaagtacgctgagccataaaggaactatcatctcagcttccccttgccttaggtactctgagggcatagatttcacctggacaagattggaaaaacgttagcccatgatggtgttgcaacacgtcaaagttaagcttcatgcagaaaatacattagtcggaaatacttttcaaatgaatataacacgtcaaaacaccagaaggtagctcaaaatgttcaggtgtcaacagtacttgttactagtccgacatgacaacaatgtctgcctacaatcctacatatatggattaatggctagtatg

SEQ ID NO: 64635 - DNA, 686 bp, Oryza sativa
cccccacgcctgcggcgaccgctgcagcgcgaggagccactggttggccgcgagccgcgccgacgggtcgtggtgcccgccgccgccgtgattgagcgcgtgcaccgcggcggcgagcctcgcccgcagctccgacgcctccgcgtccatcgcggcggcggcgacggcggcgaggtggggcgcgtggattcggttggggagaagggggaggggaggaggggacggaggggattgggccgagtggcaggcagcgcacggatgagcgagttgggtgggatgcgatttttttttcctttttttttttcgtttcgcctttttttttactccttttttgggtcattttccggagagtacgacggggttggtggccccactagccagtgcattaatgtggatttgtttgattggtctttgcttcagattttcaaaatttaaatttggaaaaaagtcgtacagcgaggtggtggccgttggttgcccgtataaaaacaaagggtgtgtttgaggagaagggaattgaagagattgagaagatacgtaaaacgaggtgagccattagctcatgattaattaagtattaactattttaaatttcaaaaatggattaatatgattttttaaagcaactttcctatagaaattttttttgcagaaaacacaccgtttagtagtttgaaaagcgtgcg

SEQ ID NO: 64636 - DNA, 4391 bp, Oryza sativa
ttttgtggagcaacgtcttttaagaagaaaatgttgctgcagagacatcaccgtcgagtcgaaacgatgaaggctagattcggggaaatatactactaccttcgttttataatatataagttgatttgacttttttctaataaaaaatttctaagattcacctaatatgtaaaaaattttagcaacgtctataacaacaacttagttttattaaaaccaatgtttactatattttgacaatatatatttgatttgtgttaaaaatattgctatactcttttttttacaaatttagacaaacttaaaaatgtctgattaggaaaaaagtcaaaacaaccggactgacgtacactactacacaaataattttctaatacaagcacctcaataggttgcatacggatcacatgtgaccgcgtctgcaaaaatcgaactctattttcgcatatgacttcttaagagactcgcacaagaaaatctattttcgcagtcggccctcttaagaagtcgtatgcaaaaatagggctatttttccagacgggcctcttaagtggctggagggaaaaatatttttttcacatacgggtatcttaaaggtctacccaaaagtctgagttacctcctctttccctccttaacacttcaagatttttcaactcacagcatctctccttacctcatctttatctcctctcctctcctcatactcccccctctctctcaaactctctcccggtcgaccgagtggcggcggccggcgggcgtggggcgaaggtggctaggggcgatggcggcagcggcggccctcccccgcccaaatctgcgcggattcggtggcggtggcgagcgggcgggcgggtggcagtggatccagcgtggcgcggcaggagtcaaaagcggcggggctggggtgcgcggtggtgggcgagtggcgcgatggccgtcccctgcgcagatccgacggtggcggccgtcctccacccagaggccggtggcggtaggagcatagcggaggtggtggcgagaggagtttggcgatggcgggaggaggcggcggcggcagccatcccccgcgtggatctggcggccgatgggtgtgatttttactctctttttttcagatttttttcgcgtgcggacgacataagcacccgcacgcggaaaaccgatttttccgtgcgggtgcgccacccgcatagaaaaattgggattttcacagatccttccaggcagatgggctgaaggtccgaacgcgaaaaccacttttgatccgtctaaaaagaattttttcttactaaaatatacttattttaggacggaaagagtaaagactttacaatataatcaaaccttaccgtttgatccaacaaattaagaccaaatcaccatacaatccatcatatgtaaacttgacactaatttgtgacaagtcaaacttgacgacatgtttatggggcatgtagttttcattatctaaaaaacatatatatatgggccatttgagttctttgccatttgtaaccttgtctcagctctcttcttcttcttttttcttcttgtttttttacaatggctaaaattggaattattttctttttggtacaaaaatttggctagactttttttcttttggtttgctatcaatgttatattttaggtagtagaactaagccaaataattttacaatgcctttttttgctacaactagatagatagatggctacatttttagcgtgccaattttttttagtttggttgagtttggccacaaaccaaaaagaaacccttaatcagctctctgaacattccccaactgcatgccaggatcaacgcacgaggcggtattaacgatcaaattatgcctagttttttttccttttttttgagtggaaagtcatgcctagttggttcacttgattgtggttaaatttcaaccgattgcaagttggaattagcggcggcagcagccggagaatcagggtagtggtagcgagagacttggaagtcaacgaaaagaaatttagcacttcacgagagtatatatatgaggggaaatccttatctttttcaacgtccacgtcgttcgttctgatcgatctatcatgcacggcggctgatatctgatcaaacgatgacatgtataatcgtctcactgcaatagaggtttgatgcagagaatgaacaatcctctacattttcttttgaggaaaaaataatcctctagagatgcactttcaagtgcagtgataaggaatgtgtggtctcaactctaaattaagttaagtgttcaatatctaacacactcataatttcttcttaaaaatgtttagaggaacatctttccctacaaatatcactttttttagaaaaaaaaaatcctctagaatctatactgaaagtatcacatagccatccgactgatgaaacactcctatctatgctacagtaaatttgttgcggtgcatatattgattagattattgttgatatttcctccatccctcccaaaaatatatttacttctgctgtacacctctgcgaaaaaagtgcagagaatttgcatcccacgtctttacggatattattacaatatagattttaccttgatttttgttagtatttgcttttcaaactgtttaacgatgtgttttatacggaaattttttatgtaaaaattgttttaaaatatcaaataaatcaattttataagtctacaataattgaaactcaattaatcacacactaatatctttattgttttacatgccctaacttcacctttgtgaattcaaatggacctagatggatggtatctcctccaccgggcgatccgagcagatcgagctcgccgcaccaccatcgtcggcgccggcgtcggaactcggaagccatccatccaggcgacaccgtcgtcgccatgattttgggacgccggcctagctacaaatgggctttggttcagtgcacagcacaagctagtacacgtccttatcagagagcacctggtcgatcatggcgtgcagccgagatgctggctactttctctgtttcctttttaacttgacaccggatataaaactttgaaggatcatcttttccaacgtgttttgcatgctacataaaactattacacttacattcacggattcaccaaaacatcgtagttttaaaagtctttattggtataaggtaaaatcacaagtgaaaggaggtgtaacttagtggttacagtgacctccttagtagtaccctaaagtcctaagttaaaatcttcataagagcaaatttcagattgggttatttaaaggctaagttcctaatttaaaaatgttgcatatatccggttggatatggagactaggtaaaaaaaatacccttctccaaaaagaaaaaaaaaaggtaaaatcaccttgatcagcagtgtcaagtagtaacaaggaacatgctttgagagcagggattgcaatttcgaaactatgtttttttgctggagagagccgaaagaaccgaaattatttgaaaatttcacaaattttaaatggatttgaataaactttgatcaaattcaaaaaatttagaaaaaccccaaaatttcaggcgaaatatacgcttgccagtgggggggggggggatttctgaaatttcactccaaaatttcaatcactgcatgagagtaggcaagctgcactagctgcagatcatgttcctgcagctgcagctcctccagtaccaccactgttggtgtacaatgcaacatggcattggagcctctgtacccattgatcgacaagctagggttgctcgtgtggcccagctagcactgatcgatggacgatgggcctcgatatgaacatgatcagtcgaatcttgcaggtgttgaaaaacggtcgtccgtcgccgatcgtcgagatggatatctgaagaatgtcggtgctacaacatctatctataagatcactgcatttttctgatacaaaaaagagcctcgccatgtgcggcctgccggcacattttacaccttctagatgcaagcagttcatgcactgagtgatctgcagttctgcacacattgctagtatatatagctagtggattactagctacttgtttaaagtcactttgcagctagcatttctcaaatcttactactgcattatgggtaggtatgttccttcagttgagaattactaagatggagcaaagtgctttattaatcaattgctagtgagaagtgaatagataaataaataaatgagatgcatgataggagaaaagtgaaacaaaaggccaatagagggaatgacgaaaagaggagtggataagttgaccgccggaaacttgttcccgacaatagaatgtggaggatacactcctcccctagaataactat

SEQ ID NO: 64637 - DNA, 3067 bp, Oryza sativa
gggcgaattcgagctcggtacccttcttgattgcatttttttgtaagtaccaacccctagagagaatggagcgataacacaactgtttacatactacatggctacatcaatacccaaaaagaagtagcacaggctgttgtcaaaacttacatactaaaacaggtacagctagtgcaatcttgccaacgtcctcatcagcctgcatgatctttttgatccgtgcctgtcacaacaaaaagaacagaaaaaatgatttcacagtgttcaaaactgggttatatttgaaatatataatcctccagcatacacttgatataccgatatgtagggaacacaaggtaatcctaaagagtacgtcctatatcatgaaaaagtcacacaaggtaatgctaagaaacactaacaagaaaaatctgaatttcagtaatcagtacaggcaagagggaaaaaaaaaacaaaaacaaaacaaaacaaaacgttcagtaatcagaggtctcaaaaaacgcagttcacagtgccatgtcacatggaaaggtctcaaaatagtaatgaagacgggagtattcagctaaaattcataccagcactctcaaagaagatagttctgtgtaaatttgaaattctggctgatgcccatctcatgacaatttgagcagtataaaacgtagaacaggttcccagcagacaatacagctcacgatatatgccacacaagtagaactctactgcacaagaactccagaaactgcccgagcaggccataatccatttcatgcctccagaaacagtgcgatacaagctcgcgtgttgaggagatctcatgagaaacaaactacaagatgagaaatccagccctctttacacgcatcctggaagcagctgcaaccaattgcagcccatcctagctagctgcctgctcagctttgcacctaccagaactaattgctcattcatctcgccctcgaattcaagaatcttttccctccaccaaacccaaacccaaacccccagtagaaccacttgccccaccacctcgaaccaccttcatccaccaacgaaccgaaagaaaactcaacgagagtgagtaaaaataaaatttcagctaagctcactggcgaggcaacacagacaaagagccccccaccacaacctgctctcgattccgaatccccacaaccacccggcgacgaagcgcgaccgcacagagagaagcgcaagtaccccgccggtcaacggcgatatccgccgccgccgccgcgagatccgcgcgcgccgaccagatcggatcacgagccgccgccgccgcagcgcagatcgaggagaggaaagggaggggaggggaggggaggaggggctacgtaccgcggggaagcgggtgcccagcttcttcctcatcttcgtcttcctcctcgcgttcgcctccgcctccgctcctccacgctatcgcagtcgacctttttttctccttttctttttttttttggctcgatttttttttctttcttttgggacgcttcggtttcttcttttgtttttttcttcttgctgcgccaccacgagagtcgagaggagaggagaggagagcacgcgcgggcggcggcgacgtctcacgatccggatccgacccgacacgagaggcgttcgtgcgtgtcatgtgtgcggcgactgtgttcctttcgttcgtcagcacaaaaggcggggcccgggttggcgggatcgatccggcccgttaggcctggagaacaaggcgattccgtgtgctttggggcccaacttggcaatttaattctttttatgcaaggagaaataatccgtacatacgaaaatttgtcttacccagcttctcttttttaagaaccacgttacagtacacaggcactcataccctcataaacaccttctagagactaggccaatgtatcttgaagttgacaaaatcaccatgaatatctcactatcgatagttatgtcgcctatcactaaaagaataattatggtaaatacgaacactcacattgagtgtagaacttaaacccgaatagactgattccaccacaagtacccttagagcaggtacaagccaactataaacatatcgagaagataaaaaagtagagaagagcgacatgcaacatatttgtagccaactgcagcacagactccaaaacacaatgtgtgcatgacagatgggaccatgaattaatagtgtagtacatgtttataagtaactattatataaattagctattaaatttaatatagataatttggagctagtagctaagtatactattaaacttgcttttatagtcaagaaaccttagttgactatgctcactttttacacagttcttacaaattcttactacactgatgtagcactgtgtaattaaatttcgatatcctataacctacatttaattaaatcaaacggtttgagaactttgtttgattttccaagtaagcctatcagatcacaatatgaaactttgctaccaggagcgaatagttaatattaagtgaaccttgctaattataaaaaaataccaaatagattttgaaatagtaaaaaaaaaagctgaattcctcctctaaaataacactataagtgatgaactaataaaataactgtccgatacaggaatgtcacgccgctttcaaactagagtctacaggaatacacgatcgaaaattcagataacaaacctgatatatattatacataataatgagatgggagctacaagaatcatctgcgctaatgtttcaccaacgctagagctaaagaatatgtttcgaataaacagaataaactcataagttaaacttctgaacaactgcctccatccacgcacggacagccaactaggcgtctaggccaaatcaacatgagatgaacttgcatggtcagaattgcctgcttccaccttagaaaccgcaagaatcaatcactgtcgtgctcagcatctgcagaagcatatggattttattgagaaaaagagatatggaatcgcttggaatgcgaaataacactgaacatgctgtaaatgccactggatattcccct

SEQ ID NO: 64638 - DNA, 655 bp, Oryza sativa
tgccagttggtggcagcaaaatccacaggccagccttccttagccatctcctcccatgtcggagaggatgacatgttggtggtgaagttggaatcgaggagtttgggttgtgtctccaacacctgcaatccatcaccgcgagggatctagatgaggaaggagaggaatacaagcttacatgttgggtgaataattatttttttatatttttaataatattattgactagattgccacataatcagattaatgccacatgtacaccagctaggaccaaaacccctcttaggttgaggggtgtaactcatcgggtttgaaagattttgaggcacaaaatctttggtatttgaattgaggggattgtcgacgtgggatacccctagaccggataaatagggtattggggtacgttggtacgaggatctacacgatacgacgtcaagcaaacaagaatatagagattatgctggttcaggcccctcgtaatgtaatagccccaatctagtttatatgagattgatatggaaaaccacagagtacaaagagaacagatgaattcggtgttaccagcgagatccttgtcgagatgattcgacgagatctcgggtgagtaggttttgcgtcctccagcccgtagactatggtggatgtgttg

SEQ ID NO: 64639 - DNA, 565 bp, Oryza sativa
gatttaacaacccaaactgttgagtttaggaaaaaaaatcaaatgggaaatagaaatgggccagtgtgtgggcgagcgcgccttgcgggccacgaaaccgtgaacgacatgttccggcctgcccacgagtcccgcactaatcgatgtaccccttcgtctcggcccgccgccgcctcctccgctcgagccgcaccgcgcagccgccggcccaaaccctatggctcgcaaagcgcgacccgcggagcctcctacaccggggcggaagggcaggaaacctctcccctcccacgcgccgccgaccgaagccgccgccgccgccgccaccgccgccgcctctccagccgcagccaccgcctctccagccgcagacgccatggaggccgaagcgggcggcgtggccatcgtgtacgacgcgctcccggggctgacactggcgttctcgccggaggaggaggagcacctagagggtgcgactgccgacctaggcggcgcgtcgacctccgcctcggctgcggtggtggaggaggtggaggacgccaccgcggcctactccgtgttccgcaac

SEQ ID NO: 64640 - DNA, 711 bp, Oryza sativa
ttactcactctcgttgagttttctttcggttcgttggtggatggaggtggttcgaggtggtggggcaagtggttctactgggggtttgggtttgggtttggtggagggaaaagattcttgaattcgaggcgagatgaatgagcaattagttctggtaggtgcaaagctgagcaggcagctagctaggaatggctgcattggttgcagctgctttcaggatgcgtgtaaagagggctggatttctcatcttgtaggttggttctcatgagatctcctcaacacgcgagcttgtatcgcactgtttctggaggcatgaaatggattatggcctgctcgggcagtttctggagttcttgtgcagtagagttctacttgtgtggcatatatcgtgagctgtattgtctgctgggaacctgttcttacgtttatactgctcaaattgtcatgagatgggcatcacccagaatttcaaatttacacagaactatcttctttgagagtgctggtatgaattttacctgaatactcccgtcttcattactattttgagacctttcatgtgacatggcactgtgaactgcgttttttgagacctctgattactgaacgttttgttttgttttggttttgtttttttttccctcttgcctgtactggatactgaatttcaaatttttcttgttagtgtttcttaccattaccttgtgtgac

SEQ ID NO: 64641 - DNA, 658 bp, Oryza sativa
ctgcatgcatatcgaagttgattatatcatgattaaatccataattaaatattaaggtactgaaaaccccattccaggtttccccgacggctcaaaggagaaaatgccgtcaggaaaatgattagttaccttgaaatggacaattacatggccaatctggagaccgattaagcatgtcacaatcgccatcaacgagctgcacattttgtatgtgtccatttatatataaacaggccagcatacaacatttaggatgcatttatgctgtactttttatgatttaaaattcaattagagaactatataaaaaaaatctgttttgttcacctaagaagcccttcaggatcaaatggagcttcacaccatgatggggcattaggtggaagagggccgttgcgtggagaggccatgctgcattgctgcaattgtcaaaaaaaaagaaagagaactcgaaattactcccaatatcttagagggattggaatcttctcacataaagacgtgatcgctgatatgtaggccccaccacccttaaacccacatgtcagggatcacgtactcacattaggtgggaagttatgtgagatgaaccctctccatcttagagacacaaaaaaaagaggaagggaggtgcctttgcgttcataaaaatttatgg

SEQ ID NO: 64642 - DNA, 3695 bp, Oryza sativa
taattaggattaaaagattcgtctcgcgatttcccccttaactgtgcaattagtttttctttaaatctatatttaatgttccatgtatgtatctaaagattcgatgtgatgtttttagaaaaacttttgggtaactaaacggggccaaacacagccaaagatcaacaatgtttcggagatgacagaacaaagaagctgggtagctactagctactagtagtttgggcacgccatccaaatgctcgcgtcgacaaccataacctcaacccacgacgctacccccgtgaccttcctactattcctcccatatctcctccaaatgttaacacgattatccaactgaaaaaacacgtttccaaggccaaaactatcacaaccaattcacacatattccttcacctcgcaaattaatagtaaaccgttcgttgatttccctctaattaatccgatcgaaatcgttcgcagttcacacgcaccacgtcatttatttcttgatctactactagcagtgtatatatgtggcccccgacccctcgctgcatcgtggccgtgggagtacccccaatacacggacacacagtagtacggtgtgatgccgttgcctacgcacggtacagtccaatacagtaatgcatgtttcccgaaaccccagctacgtactgagccactccttgatttccatcggttgtttgttgctgattataagccgtaacagcttattactggttaaaaatttaatttacagataaaatttttatatatttttatcacctattagaaacgtcagaaactgatgttgaaaaaaaaactatgttaacaaaacattaaaatcgactacagaattaaattttaaaatataaattttgattccgacttagagcatcaccaacagtctattatctatatgattcccaaaactaattttgagggattttagtccaaaacagcttcaacagatcccttactcttctacccgagttttgaagttccatttcccaagttcctcgctctgtttatatgcagacacgaaagtcgctcccaatcacgcaatcccgtctctctccttcgttcccgcacgtgggagatagcgatctttctgtgcgtgaaagaaaaaaaacggaattttctcttggtagtttaatagaagggcccacttttaatttgtgggattgaatttaggctatctgttggagggatgaggtttttcacttcctattttcagtttaggaaacccaaaaatatttttttaggagaaaattatagataatctgttggtgatgctcttatcacgtataatctctccccaaaaatttgtttttggttttctaaactaaaaataggtagccagaaaacagatcacaccaagagaaaacctaaattttatcccaaaaattaaaagtgggtccttttgttaaactaacactagatttttccgttttcgtctctctcgcgtgcgctcgtggcgctccctccacgcgtatcgcagtccccccgagaaaaatctggcgcgattaggattcggataggagatctgttggaggtattttttttcattaaaatttcaaaatattaggatcgggaatgtaataagagaattgttggtgatactctaagtccaaaagaggcctctacccactcagggtggtcgcagttcgccagttcccgtattcgtatgtatgtgtgatgatgcttctacgcgcgcatgctcctacgccacttctaccatgactcgatcagctagcgtgatacgaaaacgttaactcctaggcatagccacagctagcgatgcaagcggactaacctgcgaaaccgcttatagattaaattagtgagtaacccgtaggttaactactaatttaatttataaataggtttatgggttgacccacttgtttttctacgacgcgacaagtccacggattaccttttatttaatatatataaaaaataaataagtagcttcgcaggtcggtccatttgcatctctgccacaggctaccgtactgtcgattacctatacgtaggcttgttcttaataaaaaaacgctatacatagtagtccggccttttatcttggcaagagatctaggctcccatcggattacctattcagccaaagaaaaagtcaaaatttaaattttcaaatttaattttgatattaattttaagatattttcaacgcagtttttttttcagtattggcttttaagtcaacgagaacacatatataaaagtttttttaaaaatagacaaacgatggagccctacttgacgtgctaatcttcgcctactccacgtgtggctgccatctctgcttgtgaattttgtttatatattttaattttttaagtttaatagtaaatccttttaaaaacttattttcaaaatcacttggtagcgttatttgatcctgctgaactggctattttaccacgttagatgggacaaaatatttattgaaaataagttttgaaatgttttattttaattaaataaaaaaatcaaaaaataattaaaaaaatctctgctcgcggctccacgatcaactcgtgcatgtacgtactacgtgctgtgacatgatgtgtaagtctagtactccgacgcatggatccactatgcttgggcctactaggagtgtacattggcacggctctagctgtagcgcccatgggcagatgcaatgcaaagcacctgccagctcaacagtattaccactgtacgtatacgtcggactagtataatgtacagtacgtacacaggttcatagccccggactcacgtgcagaccaccaccacgagtacgtacgtactccctccatccttaaaaaaaaaaagtacaacaaaacgtctaatattagtttggttttttttcggaggaagtatatctcgtgcctgtaacagtagtatgtttttaaccttgtccacggaccgttagatctcctccacgcccatccaaccgagcgatcacggccatcccgtccacaacacggtggcccgtggatttttgccgaacacacgagcgcccacgtgagcagccacgcgcgggccgctcggggcaggatgtgtgcgcaacaaaccaagagaaaaatgcgtgcgtacacgcagatgcgccgcgcgcgcgcgcgagacgacgacgacgaggggggaagcatcgcggcggtggggggcgaggcttttacgctagtacgacgtacaccaccgcgcgcgcatgagatgggcgtgggctttggctgttgcgggggtggggggtgtggctcggtggtggacggacacgctagggacccgtgcacatgcatgcctgccgcatgccacgcccgaaggaaccccaagtccccaactgcctttctagctaatcatcccaacaaagctcaactaataataataatcaacgatcagattattatattagtactccctcagtactagtaaataaagtcgttttgtacagcgacacggtctccaaaacacaactttaacttgttgtttctataaaaatatttattgagcatattttttaagcataatttttacattttcaaactcaacatctagatagttatttatgacttatattcctaagatttaacttaaacattgtcttaaacgactttctttacaagtacggaggaagtatgtgcgagtcctatagtgatgttttttttcttccctttcgaaatacggtataaacgaaggta

SEQ ID NO: 64643 - DNA, 2976 bp, Oryza sativa
  unsure (1)..(2976): unsure at all n locations
taataatcaacgatcagattattatattagtactccctcagtactagtaaataaagtcgttttgtacagcgacacggtctccaaaacacaactttaacttgttgtttctataaaaatatttattgagcatattttttaagcataatttttacattttcaaactcaacatctagatagttatttatgacttatattcctaagatttaacttaaacattgtcttaaacgactttctttacaagtacggaggaagtatgtgcgagtcctatagtgatgttttttttcttccctttcgaaatacggtataaacgaaggtactcacaacactgtgtgttcgctcactcctatgaacacacatgctcattctatctttacgagcacatcttaaaaactaaaccgcgatatatcttaagattgactaagtcaccacgtacgcctcgctgttgacgggtacgccatctatcactaaaagaatagtgagctgtgaatgatgttcttttctataataaagataagccagcacacataaactaccgtataattaattaagttttaattactataaatttattaaatatttaaaaataatttctatacagaaagttttcgcacgaaacgaaaagtttaataatttgaaatacatgcaactaaaatcgatgcaaaatctatatcttggtttcaaaaaaaaaacaccatctacgtatgaaagagaatcatcaaattagtcttctagtacattgttacttaatcaaggaaaaaaaaacaaaaacaaaaggtgagagagaaaaaaaaaatcatgtgcatatgtgctcgcttttcaggtccggatccagcaatgtcgccaccaaatcctgcccccggctcggctgcctcagatgccgctgcaccaccgcatataataataacaaaaaaaaaaaccatatcccgatttcatcgatccatccatccaaactggggccaaatggccaatactctaatcacaaaattaacaatcctaattgctccaaggtacgtagtacaacagtacaggacgcaaagcgatgatataacgcccgccaggtcatcctcgcacccttcttcacttatcacccccagatcacaccaaagattggaccggatttgtttagtttaggtttcgattagcttaacgatactgttccattaaacaaaccaatcaaccaattaattaattaaacatagatcagcagcagcagcattagcggtggcggaatctgggcccccgactggtttgactgaccgctctgttcccgtctccggtgggcccgggcccaccgtgctctcctccttgccggccggcccacgcacgcatctgccactaaaacaaaagagaaaaaaaaatatagaccagagtatataaaataaaaaagaaaaaggagaggtgtcacagcaaagcgaacacatgaaaaagcaggcaaaggatttttctactccttttccctccaaataaaaaaagtcaagtcatgcgtgtggggccacacggcgatcgacccctcacgtgggccccacctccgtggttgcctcctcgttcgccaacctcccttgaacgcagcagcatcaacaaaaaaccaagaaagtgacacttttaatatctttacagatttttctttttaatatcctttggatttctaaactccaaaaaaatatcattattattattattaaaaaaaaggtgaggttagcagcggtggtgggatgactgatgatgaggagtgatgagcagtggagaaaaggcaagcaagcaaaggtggacaaaaagaaaaggaaaggacgaaaccacctcacctcatctcatggcgtttttgttatctgctccacctcctccaccacccccatctgctttgattccatcaacgccacgatacaataattactccgtattactctctctccctgcttaatgccgcactaacccttttttttctaatctggaccggcaagctagcctgtgtggtgtgatcagcgcctcggaaagcgacgctcgcagagatccccggatcggattagccagctctccctttttttttctctatcaaatccagagagacacacacgaaaaaaatatacaaattcaacagtttttaaacatgtgcacatgcactgtgctgccacgacggaggtggggcccacatgggcttttcgggtgtgtcttggtcgtagggacatgcgaggattagatggatggatggatggagtggtggttgtcattattgcgggggttacttaattaattaatttggtcaagcggtcaatcacctggtttagcgctaacccttttgtttatccattatattatttaatattttaatattntgtctcgtgtgcgagtgatcgatgcttcccaccaccatccatccatgtgtcacccctcctccgcttgctttatatagcccacgcgcctccctttcctttgccttcgtcttcgtcttcctccagccacgccattctgtcgcctcctccacttcttctccttcgccatggctgtgcaggcgcagtatgggggtgggatggcggcggggatgtgcttgccagaccatgaggtggaggcgcagatgcgggagctcggcgcgatgttctcggcggcaggtggtggttgctacaacggcggcggtggcggcggagggtatgactgcgccgccgtggtgagcggcgcggcgcagagcgagctgacgtgcaacaacggtggtgtttgtggtggtgcggtggggatgggggtgggggcggggaggaagcgggagagggaggtggtggagcagtatgcggcggtggcgtcgtccgcggcgctgctgccgatccccgggatgatgaaggtggcggcgccggtgagccggttggtggagtcggggatgacgtcgacgagtgggaggtcagcggcggcggtgggggatgcgctggtgtcggagctgtgcgcgcagagcgcggagatcgacgcggtggtgcggatggagtgcgagcggat

SEQ ID NO: 64644 - DNA, 1160 bp, Oryza sativa
atctcgctaactccagatgagtaatttagctagacatagattaggtagggggattagctgaattgatccagttcgttttgttcttttagtattagggtaaaaaaaatgatgacatggttaaattcaattggcgttttgtgttcatcccctctctgtaaaattaccgctcagtggaaaatttcaccgtgtcctcttttggccttccgggtcaagaaaagcttacaagttgtaaaaaaaaaagtcaggcatctgattgtaaaaattgaatgcatggccctttttttaccattttatttattactgtcaactacttatcccattttccatgggaaaccaaactgttcgagatcaaatttcccatgaaaaacggaaaaaaagatttaaaagaaggggggttaattaaattgtgccgttacgtccggaaaaggtgggattctttcggtgggtgaggcggcagttttttttgcatccgggcattaatcaccgcaggattaattgtactactgtacccaaatcggcacggtttccgaggcggattaatgagatgcaggataaagatatccacatgaatgcacccagttcagtgtcagggggtggggtgggttggatacttggattggatgactggtgatgtgaaaagatacccccagccacgggccactgcactactgcactgcacagctttgctgtagctggtggtactggagttgggagtagtagtagacagcgagattggcaatggcaggaggcatatgcatttgccttttttttttcttttgggttttacagtacacacctgacatctccttgtgcttcaccacactgcctttgctcagctttcctttccctttttttttttgtgagtaggagtgctagccggatcggattgcttcatctctttgaaaataagtacagtactgaagtattactactccggacaaatagtacattttagaaatacacgcagcagaaatgcggagctgggagcatgttgctacttctatattttagaacgggtggttatttattaagttcacttttcaaaatgtttgattcattttcataattaagcagataaaataatctgtctctctctctctctctcgtttggttgttccgactagtagtaataataataataattctacagtaggagtaaa

SEQ ID NO: 64645 - DNA, 2301 bp, Oryza sativa
tttgctcagctttcctttccctttttttttttgtgagtaggagtgctagccggatcggattgcttcatctctttgaaaataagtacagtactgaagtattactactccggacaaatagtacattttagaaatacacgcagcagaaatgcggagctgggagcatgttgctacttctatattttagaacgggtggttatttattaagttcacttttcaaaatgtttgattcattttcataattaagcagataaaataatctgtctctctctctctctctcgtttggttgttccgactagtagtaataataataataattctacagtaggagtaaaacgggagtagtaaaggtttgcagcaggccttactggcctcctcttttctgcttctgccgccgctgcatcatgtctgacagaagcaacaacaacaaacaacaggcaggctaatgtgtctatctgttctggtagttttctttcaccgggaaggcagcagtgtgcagcagtgggcagtgggcaccaagctggaccaaagcagtacactcattaccacagcagcagtggcaggcagtgcatttgtactaccgctagtcctacaattgggtcgagatccttgcaacttttttgaatggagtacgagtaccagcagtctcacagcagcattggggggttgggttggtcggtgtcttcttcctcgcgtctcatcgcatcgcatgccattggaaagggagaaaggatggagaagaaaaagaggcatctgctgcgtttgggtcgtgttgctttcgctcattgaggtcaatgactcgagatgcttgatttttcacattttggtccttttaaaaacttatttcgcaaatagacccctgaaaaaacttatcccagaaatagtcctttttggggcgccagagtggctggcgccgtcatccaacgggacggcgccaacctctctagcgccgtcctcctgccaccgtggcgcacgcgaaccgacgtggcaggaggaggctggcgccgccgcctccattcctttttctctgtatggagttgcaacggtgtcatttttattttattttttcggatgtttttttatactcagtatcacgatacaaccaaccacaaaaaaaatttaaactcgaactaccacttaggtaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagtacatagagatgcaattttttatttttatttcatttttttatatttttttcacactaaggagaacataggaaccaactgtataaaaaataaactcaaacggacaaaatatgtgacatgtagaattttccaaaactctaccgaaacggacaaaatatgtcatctattaaaataggcgtaactttctcatacgggctcagaatcaggcaaataatatatgcacggacatctacagaaaatgatacatccgattctccccatctacgccgggttcggtgatattaaaacctccaaatttcgcttgcaagattgtgttttcgatgagagaagtttttcggtggagctttggaaaattccacatgccacatatttcgctcgtttgagtttattttttatatggttggttcctgtgagttcctaagtgtgaaaaaaatatcaaaaaaataaaataaaaataaaaaagttgcacatctctctcctctgcactagttcggaaagagaggagaggagaggaaaaattctacatgtcacatattacgtccatttaagtttaatttttctatggttggttcttgtgtgtccctaagcgtgaaaaaaatatcaaacaaataaaacaaaaataaaaaatttcgggggggaggggcgccagccactctggcgcactccccctagccacctcagcatcaccccgccacgtcggcagggggacggcgccaaagaggctggcgccgtcctgttgaacgacggcgccagccactctggcgccctaaaaaggactatttttgggataagtttttttaggggtctatttacgaaataaattttttaaaaggaccaaaatgtgaaaaatccagtgtggaggtgaggggcttctctggcttttctcttttgcagccagctgctggtgcttgttctttttcttcttcttccatttgtgaggcagatgagagaagaatcaaggaagccaaccattgatgg

SEQ ID NO: 64646 - DNA, 703 bp, Oryza sativa
tcaccgccatcgacgataatcaactcaacagctgttgccctgttaaattgatctgccttggttcaatcgaccccaccgactaactcgaacagtaccagccggaccgaaccggtttttttttctttctccaaaaaaccggaccggtttcttttacttggtcaaccaccagtcaaagaaaaacagatcgatcctgtctcccttcttcctttggcttcctcgctcctcccagaaaccgcgcccgcgccgcttttcccgatgcgccgccgcctcctgctcctcacgctgccggccccgcaagaagcaccatgccccccacctcagaaaccgcctggggcgccgccgcctcccgccgctgtcacctgcgccgacccaccgattggatcgccaatcgcttccgccgccatcaacccgagcaccatgtctagtcatctccctgttgaaggcagccatcgacggttccggccgccgccagaagtgttcgatccaccgatcaagactccgttgatcgccgccgtgctccaccttgcgccaatgcccctccctgggcattatagcaggctacgcggtgtggagcacctccatcgcgcctctaccatggacctcccgcaggctctgataccacttgttataaaaccagccccgaaatcgacatcgatagctaaatacggaagaaaactccataggagatccaaaacgatgacga

SEQ ID NO: 64647 - DNA, 551 bp, Oryza sativa
ggattattaagttcatgtacaaatttgcttcagtaggcatcttgaactcttgtttctttggtctttgcactgaatcataaattgagtgagggctgatggatgggtttgtttgtatattagaccaagtggccttactatgcccagttccctgaagtagccatgccatggcttggcttatccagtttgatacattttgccatggtggtggtttattgctcttttagcaaagcagttgtgctggctattctttgttggacaagtttagtttgaaggcaggcatatgttctatttgtatgtggcttgccattttcataattttgtcagcagaactgggacaaacttattattgtaaaagggaagattattatttgaacaatctgtatatgatgaactgattcccgttactggtataaactacaaagacatgaactgtaacaaaactggtgaagattattaatattttgtgtctgtaaacagggaaaagcccaccattttccagtttgtcagaaactggttgcattgtatttttagattaattgaaaatttacatt

SEQ ID NO: 64648 - DNA, 21526 bp, Oryza sativa
ctgctacgttgagccacgctttcgaccgccagcacccggcctgtcgttgcttgtaccgaacgggagctagctcttcagatcgatcgtggataacggtagctatagctgccgtttctctgctcagatcgaaacgaaaaaggaagcagaatgtgtaggttttcttcggttgtcaaatgccgatgtgtgcagacgtacagtacgtggtcgtcatcatttgatctggccgtggagtttgtgtgccattgcaattgcaattgggtgtggctaatgggcgatcgatctgagcgaaacccatgccccctgtacacacctctcctcccctccccttcttctctttctactacactaaaaatttttaaaaaataaaaaaacaaagttgaaaaaatttatgtatagaaatacttatataaaaaaattagaattcaaatttaaatttgaaacggatgtgtaaacttttgacttataaattttgggtctataaactaatatttgaattcaaattcaaatttgaatcgggtatgtaaacttttgacttataaaatttgggtctataaattttaggtgtataaactttagatgcatagaaatactatatatataaaatatttgaattcaaattcaaatttgaatcgtttataattcaaattcaaatttgaatcgggtatataaacttttgacttataaactttgggtctataaattttaggtgtataaactttagatgtatagaaatactataaataaaatatttgaattcaaattcaaatttgaattgggtatcaaattcaaatttgaatcgggtatataaacttttgacttataaactttggatttataaactttagatgtatagaaacactatatataaaaaatatttgaattcaaattcaaatttgaatcgtatataaacttttgatttataaactttaggtctgtaaactttagatgtgtaaacttcaggtgtataaactttaggtgtataaatttactaaaataggaaagtaatatggtgtaaaaaaaaaacacgtggaggagggggggggggaaaccgatcgctcctggcgatcaatcgccaactggactctaggagtttcgattgcaattggtcttgcaggaagacgagacatctctcgtttctgaatgtggaattttttttatttttaattttttttattaaaagttttacaaaaataattttccattttgaaaattgacggaagtagtcgcctaccgccctctgggaaggcgatttttaaaaatcgccctcccagagggcggccaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccctttgccggcctccgcgagggcgattttgtactgtgcgggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaaaattaaaatctccaagtctggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctatataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcaacgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaatactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtatgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtataaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcccgcatctggtcgaaggtcaccatctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcaaggtgcgtgggatacgcgtccgtgacagcggcaacgtgcggctctggggcgtctggagtgaaggtcacacgcgcacgagtgcgaggaaggtaccagcgaaggtagtcacggtagttctccaccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcagctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacatggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggacactgcgcgctgcgaccaaccccgtagggtgcgctatccaccattggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtgttggtcggtcctaggtgtggaaggcgcatcacctgctcgaagcgcgcagtgatatcctccttccacccaaaaacaccgtccacgggaccaactgctgctcccgccagcggtagcccgagcaagtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtgtagtttggcgtccaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatataccacaatcaccggcagcagcaagaacgtgtgagcaaggaaggtgacgaagcttcggcttcatacaactgcaggtacatccaccatccgccttcaagacacattcctacacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacagaccaattttcttgtatcgatccctaaagtacgctttcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatggaaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagacaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatggcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgccccccctcgccgcccatttgcaggcggcccccccgcacagtataaaatcgccctaacggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactacttccgtcaattttcaaaatggaaaattatttttgtaaaacttttaataaaaaaaattataaataaaaaaaattctctgaatgtgatgattggtcaaagactcaagacgagaccttatcggctctggaccgaaatgcagttagaactactaattgggctgtgttcttaaaatgggccgccacaccaacccgtcagctactaaaggcccacagaaggcccgaacaagcctctcatttgcttaaactgctcagactgggccaaaagtgggttgctaattctagtgcatggcacgatcacatctgatccccgaaaacaaaatatttacggcattttagttcgatttttatatacagtaaatttgataaacatagctacattataattataatataactttcacaaaccattagatttgctttaagattcgtacaagaagaaaagaaaaaaattacactgcacaaacgatgtgaaggaattcagtctcgagatgtctccatcgtgagaacaatgcgttaccacaggttttttaaagttagatataagttatataagttatagttatacgacagttactacttactacaaatataatcacactacgattcaattatatttacctgacaaacatgttacggttttagatctgtttccgttggaaacttgaaccttcatggacactcacaaccagaaatgcccaattgcccatcccctgtcttgactcctggccatctttctccttgctgattttgtattctctaccgttttaatgccccattttgcaacgcatcgttatttagaagatttcagtgataatttcagttttcatttcttaattttggaatggaactaaggaaggaacaaactaatcctcagctcaacttccaaacacccggtgataacccagcttattgtactccagttctcagaccaaacgtactgtacgaatttggacaagaaaaaggaaaagtttagaggtagaaactgcacgaggcccacttgtcagtgacacaaccaattggtgtctgacgtcaattggaggccccttctcgttcgcacccctctccttggaaggagacgcgcccgctgcgactgcgagagcgaacccccaaaaccctcgccacctctgcggggcgccgcgcgatcgcgagctctctcccattcccttccctccctccctctctctctcgcgctccaccctaatgccccccacgaggcccaagcggcggcgcggcggctccgcgcgatcccgcggccggaagaagcagaagcgcctcgacgccatccacgatgtcgcgccggtatccgcccctcccgccggagccgccgtcgtcgtcggcggcggcggcgagagcgaggattccgacgcggagggcccccgacggagcacgcgggtgcgccgcgcgccggccctgctcgacacctcgccgctcccctccccgcgccgtaagagggcgcgcggcggcggcggcggcggggtggccgggtcgagcggcgggagctcgcggaggagaagcagaggtagggcgaggggcgaggcgggggttgcccgcgagattggcgaggaagaggaggaggaggaagacgacgaggcggggaacgtggtgtggcgctctcggctgcgggatagggtcaaggggaaggctaagctggataagcgagttaggagcctctggttcgacgaggactacgaggtggagctgaaggaggaggaggaggtggtggtggaggaggaggaggaggatgaggaggagggggatgaggaggaggaggaggagcaggttaggacattggtggtggaccttcgggagggagctgaggaagagacaatgggcgagggaagtgggagcttgccaatgcgagggagggaagtgatggatagggaaatcaatctaaccatcgatttgaatgtggaagaacatgaggctgtcgagggtgtcaatgtggtggaagaggaagatggggaaaaaggaggcgaagcggatgaggagaaaggagatgcgattggtcctggaaatgatctacacgaaggcaagcatgaggaggtaggggacgaggagggtttacatgagaaggagagaactgaagagctgggatcagcagtactagaagggcgaaatggtgatgagctaccttgcaatgagaataatgctgaggatggcactggcagttcacatgaacacgagcatcttcttgtgcaaaatgagcagactgtggaagagagcaacctttgtgttgagcagcaaatggaactggatggttctagtcctagtgagcaattgaaagaggttcagcaggatgtacagacaggtggtgcctcaaatgtagtactgcccgaggaggccccaaaggaaggagtccgcaaatttccagtttcggaagaaaaacagggtaccatggagattaaagaagggagacgttgtgggctctgtggtggagggactgatggaagaccacctaaggttgcattacatgatacagttgacagtgataatgaagcctatgagggggctttgccttcagaggatccaaactatgatatgtgggacgggttcggtgatgatcctgggtggcttggaaggttattgggtccaatacatgatcagtttggcattgctcgtgtctgggttcatcagaattgtgcagtttggagtcctgaggtatgccccacattattttataaaattctcaccctcatactattcctgtaccttctgccttatactgggtcattgtctccttgtgattttcatgaccatattctctcaaaacaatatgcccccaatacatgttttgggattatcattggttactccggactttggaagcaagcaaaacaagctaaatgtgttgcaagcaaaacaaactaaatgcttcaacatagtgcatgctttgaccttgtggtttggatgtaatggaatggagttatgaaaaacttgcttttgtcacattttcaggtttactttgctggtttgggctgcctaaaaaatgtaagagcagcactttgccgtggaaggcttttgaagtgcagccgatgtggcagacctggtgcaactattgggtgtcgagttgatcgatgtccgaaaacctaccatttggtaattggtttttacttaaaccacattttaccattctagttttgccctttagcctttaatatgcattaaccttttcgatttgtagccttgtagtcgagcagaagcctgtatatttgatcaccggatgtttcttatagcctgcaatgatcatcgacattacttccaacctcaaggagataaatatgttgaactgctcagaaaaatgaagataaaaaagatgaaggcagatatcagaaaggtgtcacatgatgcatggagaaaggacatagaggccgaggaaaaatggttagagaactgtggagaagatgaggaattcttgaaacgtgaggggaagaggctaaacagagatctttcgagaattgcacctgtttacataggaggcacttctgaaaatgaaaaggcgtactgtggctgggagtctgttgctgggctcagtaacgttattcagagcatgaaggaagtggtgatactgcctcttctgtatcctgagtttttcagttctttaggtcttacacctccaagaggtgttctgctgcatggccatcctggtactggtaaaacactcgtagtgcgtgcactaataggggcatgctctcaggggaacagaaggattgcttattttgctcgaaaaggtgctgattgtttgggaaagtatgttggcgatgctgagagacaactaagacttctgtttcaggtagctgaaagatgtcaaccttcgatcatattttttgatgagatagatggcttagcaccttctagatccagacgacaagaccagacacacaattcagttgtggcgactttgctttctttgctggatggtttgaaatcacggggttcagttatagtaatcggcgcaacaaatcgtcctgatgctattgatcctgctcttaggaggccaggaagatttgaccgtgagatatacttcccgctccccacctttgaggatagatccgctattctttcattacacacgaaaaaatggccaagtcctatttctggggcattcctctcagttattgcaagccaaactgttggatatgctggtgctgatctgcagtcaatttgcacccaagctgcaataaatgctttgaaaaggacttgcccattgaaggaaatcttactctctgcagagaaaggatttgagcatgggcgacttcctctaccatcaattcttgtggaggaaagggattggcttgctgctcttgcagctgctccaccaccctgttcacagagagaagcagggattgctgcaaatgatctagtttcctctcctcttgtctcctatcttgtgccgtgccttcttaaaccattgctgcacctttttatctccctctatttggatgagcgaatctggttaccttcatctcttctgaaggcatttgcttctattaagcaagttatcttctcatctatggagaagaataatgtgcctcacacattttggtcttcctatctcccatctttgatacaacagaaaggtattgcaaaaagaattgcatcaatcttgtcaggctatggtctaatagcttatcaactaggaaaccatgattctgtgttaaatcacaatgaacagcacgagaagtttgatgcccacagattgaattccaccggttctcacccaaaaggaggtttagcacataaattatcaggatttagagctttagctgctggagcgcccagatcaggccaacaacatctgatccgttgccttcttcatggttttgtgggtcatactgtaatacacaagcttgatcttgcaactatggcacaggagggaaacggtgatattcttagtggactcacacaaattcttcgtaagtttctttatttctttacctcataattgttcatctaaaggcattgtccacaaatatgtgataatattgtctgtatgcatggctctgaggttatataaatgcatgcttgctccaaaagttgtctgcatagaagaatcaatgataactctcttcaagcttaaacctgttattgcatgagcatgcctgtcatattgatatatcatggcactactgttgcctatccacattccccatttcccaatatctgcaattgcatgtaagacatctgacatttcttgctttgacttcttcgttctctatttatactcccattcaacgccatatatctgtagctgccattcctgttcatatttattatcttttttgacaggaagtcctgttcctatttattggttcaaatacatcatgttgtttttttttcctaaaaaatattgtgcacaaaacttccatatcgaatcatcatttctttgttctccttttgttttatcttttcaacactttcatacatggtcttaaatggttaattaaacattaggagcttttctggatctaacatttgataaatttttcaagagtctatttaaacaaactatgtaatatgtcatagctatcatcttcagatataccacaatactgatgagagtgtcttcttattcgatatggggaaccagccattcacaacctgaactgattttggacaagcagtacctactcagttcaaaagggaatgctatttaaccaagaacagtaattagttcaagtcagttatatcttcaagttggatctttctgttgactcaaagttgatctttgagggtgtttggttggttcctcgtgaggtatatacctcaacatcgcaatacatcctaagtacgagttcatcgcgatttagaaaatgatttaaatttatttctaactatccattttcactacactttaagttagttgagtcaaactggagttttggcattcaaagttgaatttgtttccattgagctgtatattttcaaattatatcgttaaagacaaatttgcatatgatctgaagattcctgcaccatgctaaattgtttatatttttggaagccatttcccgataatgattcaattgcaatcaatatagtggagatgcattgtttgaagatcaggcaataaattatgctgagttggtgatacaatgattgaagatcatgcaagaaattaaactgagtacttttaattataacagaattatgctatggcccaattccactttaagctgaagtgaaatgatatagtagttacttatgtattaccctattagcattcttcatttctttccagtgaaatgggcaaataatcatgtattttactttcgcttgaccagtaaaatgccttaatcttggaagatgtataatctatatgcctagaattgatttgtgggccatcgacaagttccatgaacaagaagcagaagatcatgtgctcaatgtgggaacaagcaagttagggtccacagcaacaaaaaatattaaaaaatgttctgaagtatggaattcgttggttgatcagatgggttcattgttagcttctgtatccatcagtgttctggtaaatttcttttcttttcatatgcttcttcaattcctttttgtttgaaaattttgggtatgtatgcatatccatactgtccttttactcacaatgtttacagctgaattgtgcattgcatttatgactaatatattgagattttagtaggttcatgagcgtaaatgactagcattagctgaaaatataggtattgacatttttattcaggcatataatcacctaatttgtactctatccctccaaatatgtataataatctaaacgaataataatttttgaaataatgttctgtccttagaaaaacaaatttaatgaactgaaatgctgctcaagtgttaataataataataataatttaatacatagtcataggagataatcagttgacagctattatcttaatcagtacacaagttacttctctgggtttccattttcaaataaaagaaagggcgaaaaggaagctggaatatatggcccatataccaggggataatttaagaggcagtgcaaggaaaccaagtataatataaaactaagggctcatttgacttcttgaatagtgatatgctctgttctacttcttgttgcagaatgtagttaagaaaatctttgcgtttctagtagaaaatgtattgctaagaagcggccaggcttcagttaacatataaaaagtgtaggacaattgcttaacaagcattacacttgcaaactgcttaactgttcatttattctggattacccctgtgcaaatgacgagtagtttgaccccatttgttgctgtgtgaattttcatattatgatcatctggaacaccgtgaatgttggattactgctattggccattacccctgattttctgatgataaaccctgatttacttggacttaagatctaatgatatatacttatggaacacttctggatatttacatccaaattgcacatttagctgataatttgtttttcagtccaccagtgaactgaagtttcaagatctccctagtggagtaagacatttcttcagcacacatgttgtagatcaatgtcttgcttcttcagaacacacaataccaaggttctctgtgaatgttgacagctactttacctgggatgaggttattgacgcatgctgtttgcggatatcacatgatttagttcagcagcatgttcaacttttgcatgacagggctcataacaatcatgatgaacagaaagaggtctttgttcctatggaaattagtgcaccaggtgaacatagatccagtgggagtaaggaagccagcatgttaacgaagtatccattgaacatggacaagcatccctcatgtggggtttcttcaagagagcatcctactcagctgggcacatgtagtgctcagcaagagccaccaacatctaatgttgaagataaagaggacaatactgagaaaattgatttcaatgagaaagtcgcaacaaatcgttctaatagaattgtgaaggacagtgaatcactagctattatggcctttggaattcagatactacagcacccgcaattttctaaactttgttgggttacatcgaaactacgagagggcccctgcactgatataaatggaccatggaaaggctggccatttaattcctgtttattgcaaagcactacagctgataaatcattatctggaggaaacaatgttcttaagggcaaagagaagattccgtctgtcagaggacttgttgctgttggtctattagcatatagaggtgcttatgcatctgttttggaaatctgttctgaggtgagaaaggtcttggaactgttagttggacaggtccgaactaaaattttggaaaagagaagtcgatatcggtacttccatattctgtcccaagttgcttatctggatgatatcatgagcagctgggcatacacctttcaaaggtaagcaatgggctgtatatttgtgtttgtttgtattggttgtcacattattgattctttttgaagttagtaaactagtaaagtatacttctggcagtcagcaaaaaatattggtacttcatactgctgttttctgacaaaattgtcctgatatttaacttttatatttgtctacaggttacatagtgaaaacaggagagtaaaaacaagtccaaaggtaactgttggaaagtcatccacaagagaatgtcaaggcgacagcaacactgcagaagcaaacatacttggtgctcctgctggctgctctgaggcccaaggcactcctggccaacatacagatgaccttgaagttattcctgctcactgccctagtgagatgcaagagaattcagtccaacatgctccaggccatcttgaaatccatggcattgtctgcgaccttgacaatgataatgtgacatctatatccagcataaatgcagtggaacctgatcttatccattcagcttcacttgatgtgcacacagattcacttaccccagcagatgcagtaataaatgatgggcaatcttgtggggttgacaatgatgggcaaatgtccagagtaatcaatggagaagaaaaccacatatctaatattgaaagacctgaaagccacacagtatctgttgcggatttcaatgagttgcaaaggaaaaatgctgttgcatcctcaactagtaccgacagtgcaggaacatccaggaacatggtgtcttctgaagctcgtggaagtgacaatgagcggaatactgatttccctgtggatgatgtcaaattaggtcatttggttaatcctcaatcacaggataccatgaaaagtctctcagttctgaaacctccatgtctctacaaatgttgccctgtgtgtttcaatgctgtttataagatggttcatgatattctttcaaattcagtaaggcctagtctgcattgcttagcagtcgatgatatgcatgaccttttgtcatcatggtcagtgaatcttctagcaacagttagaaaatggtatacttctcaaggtattgttggctctgaagaaaattctggagaagggcattgtgtttgtagcagtgataatggttgtgttccaagggagtgcacatgccatttggaaagcaacgaagatgctggaactataaaggatgagagctattatctaagtggacagccattaagttttttctttaaagatggtgtattgataccaccagatatcactgcaccaactacacttcattgcagttatatgagattatgtgtttgctcgataccaggttcaatttctatgttcaatcggatctcgagttgatgtgattgtgtgatgcaaggtacttcaatgctaaggataccacagttctgatctttttcctgtgctggcctatcttcagtgtttaccaggtcttgtgcactctcatgggattttgcttgtttccccagtggtagcagctagttcattgcaattacacctcctcccttgatgcaactcccaagctagccttctgcaaataaattgcctttattggttatgttcagcagtggagtgctgggttatatagtttttgggaaacctggatcgactgaaaagaaacaatgctattgattttgtgtctgttaagtggttccgttgtatacgcagtctactgttactgatattggaatctttaaactagctgatccgtgatgctttctcaaatctcattgtattatgtattatagctcaattaaatcactgagttgatcagttgaaacaagattgacaagtacctacagtgtccaagttgtaccttcagactggttactggtatgctttccgacgagctactaacatttaactgcgttcttatgtacatttgagcacactgttacttagaaatgcttaagaaattttgactttggtacttcttagaatataatcatgtacatatttctaaagaaggcaattgtttgacgataaaattaatgtccaacaaagtatttactgattttgtgttattggcatggaacttcattatatggataaatcagtgaactactcatgtgaacttcattgaagctttagtggattattaagttcatgtacaaatttgcttcagtaggcatcttgaactcttgtttctttggtctttgcactgaatcataaattgagtgagggctgatggatgggtttgtttgtatattagaccaagtggccttactatgcccagttccctgaagtagccatgccatggcttggcttatccagtttgatacattttgccatggtggtggtttattgctcttttagcaaagcagttgtgctggctattctttgttggacaagtttagtttgaaggcaggcatatgttctatttgtatgtggcttgccattttcataattttgtcagcagaactgggacaaacttattattgtaaaagggaagattattatttgaacaatctgtatatgatgaactgattcccgttactggtataaactacaaagacatgaactgtaacaaaactggtgaagattattaatattttgtgtctgtaaacagggaaaagcccaccattttccagtttgtcagaaactggttgcattgtatttttagattaattgaaaatttacattctgatgaaacatagattaagattgggcgacatgagaatttgtctgtgattgagccatcgaggtgaccaagaaccatcaataattcaaatactattcttgggattctgaatcttggttataaactataggcaaccgtttttcccccctgatgtttgtgtacaacctgactgttttggttgggtccgactgagaagctgtttggaccagacaacagcaaatcccaactaagttcataccatttgtgttactgttacctgtgctgctggctatcagggagaaatgcacagacaattccctttactttgttattgtttcttaccatgaacctcttgtgtcatctatcgtttactttgttagacttgttctaattggttcgatctgccacagggagtggctctcccacaataaagttttgaccctaacatgtattgagatgcccaagtctatggtgttctctaatgcaacatactagctaagaaatttcaacactttcagcaggagctttgtaactttctttatgccttgcagagcattatactggcaggctgtgttgaatgaactatgtaatttgaaacttgtcataccagccagtgatgctgttatcaaagggtgtggcgatggtttattgtactctcaaaacttattctgaaacaaactattgtctctgatggtcccatgttatgaaatattgtttcttccagcctgttctcaatcagattgtctcatacctgtatatactggtggttgtattgcactggtcagtgagtatggaatgcttatagtaagaaagctcatgctgcagcatgatagttcaagtcaagtgacctttgcatggtagtcctggttagaacaatcattggtttatttttgaagaggagaagttgagagaaggaatgtgaaaacattacatgagatgttaggaagatgcaggtttgtaaagatatggttaatggctttatgtgtcaatttttagtctttggaagatcttgctgatttttcaagccacagaaggttggaaggatacttttgcactttgctgtcaagctagacaaaatatgccatgaagaagagtactaaacacaagtaatatttttgcctctccagttcagttttttattacgttatttgtaatgactttataattcaattcttattttgcaaatacatacacagttgcttatatgtaggaacaattcataaaatgacatagctggtgtagtagtacaataagtttcaccagtgccattccatgtcaattagtatatgctaaattagatttataaatttattacactgaattttactttgatttctcgaagtttattttgctcaaatattatgtcaggtgcacatatttattcaaatcttagcatctactccctttgtcccaaaatataggaagttttgg

SEQ ID NO: 64649 - DNA, 2060 bp, Oryza sativa
gtggtggtgggatgagagtcagagcggatttttgtccctccactagtttggctagtcttcccacaaggagtgcggtgttgggtaatcgtaggatcagagttcatcaaggtaaactcctgtatattacaagtttttagtcaacctcgcggaagataaaagcatgctttttagaaaggctgagatattaaatacataccggtggaggggggttgaaagcattgtatggtacaactggcagcagatgtgaatagctgacaacgatagcatttgagaagatcttgtacattctttccttcatgaccttaaagtcaagagagtctggatcttcacgatttggatcatgtttgccatcaaattcaaaagccgtgcgggatctctctttgattggagctagccgacttttgatgaagtgccgagtgatctgctttccctgcaaaccttgttccttcagttttagcatgcgctccatcagttccactggctgagcagcttcatctcccataggcaatgaattccatgtgtcctggcagaccggagggagacaggagtactcggggagtgctggttcaggattctgaacgtaaaaccagtttgcgtgccagcctttgtttgaggtcttgaagggcatggagaaatacttttggcttagtgttcctctgagttggaaaccagcgcccccaacaacgcatggtttgctcttgttcggctggggcttgaggaagaagatgcggcggaacaaagcaaaatgaggtctaatgcccagaaaagcttcgcaggcatgaataaaattggcgatatgcactatggagtttggattcagatgatgcaggctaattccatagaagttcagagttcctcggaaaaatcctgaagttggaagagaaaacccgccataaaagaagtgagaaaataccacgacttcgtgtgtatagggggtcgggaacgcctcgctgaacgctggtcaccacccgatgatctccttcactggaagaacgccgtgtgctaccatttctttcagattctcctccgtcacatcggagggcgcccactgactctcaaaactttctctctcttccgccatggatgcgtgtggaatggtttgatttggtccaagatatagctggaggggaatgaggaatcggagcggaggacgcgcggagaagtttcgtgggatttttgagaatggattggggcggattgatgaaccctagcttcgtcggtgcggtttttaactgtagcaaggagtggggaaatggcgagagtctcggcggggaagacgaagcgtcgcttggacttcggtgttttgttagggtatcgggagtactaatgggcctgggcctgtacagtacttcagcccaatattattatcagcgtggcccgttgtgatccttagggacttaggcgctttttgctttggcaatttgtgctcataatgatgtgactcgatgctgctaaaatcctttttgatgcagttagataattctttggaattactacgatgcaaataaaaaggtgcccaacagaaaagtgttatactaattttgtaggccttttaggctgcaaatgctgttcgggttttcttgagatgattggttttaatgcagtcatccattcggcatgttatatgcttattttgattatggcatgagtcatagcctaggctatttaaactcatcttttatcaaattttatgccacgtttgataggtcttttgagagtttttactcggccttttatcatctatgttgatttataaacctttagagtgcttctcgctcgggtttttctttatgtttctttggcgcattaaaagcagtcggcaggaggttttatcagatgctgcacatgcttagccttagaccgtttggtttaaaaccactcggatggatgtcttgatgcactctgactatatgtttagttttatttaactaaccacatagtcgggggctacacctaattaggtgcatctagtcgatgcacctgattttttctattcttcagcccttcacagtctttgattttattactcgggagaccaaaacagaggaagttaaagcact

SEQ ID NO: 64650 - DNA, 729 bp, Oryza sativa
ggccattcccatggcgcgtggacgacacgacaaatgcccaaaaatgaaagggagggaaaaagcttactagtaatagcttggcttagcgagcagctacagtagcaggagtggagtggagtattagttaattaattagtccacggcgttaatgatactccaccgattgaaagagtagcagcaaaggggaatcctttccaccatcccacttccacctttcttcttcttcttcttcttcgcggcgacatggcgcgcgagggggaggggtggatccatgaccatgagtagcttacgaggattccccaagcccaccacccaccacccaccgccaccttttgttccgcaaccgcaatgatttcttcttcttgtaccacactgcttctgctgctgccgacgccgccgccgccgccgccaccagcaaaccccaatctcgcctgaccaccgttccccacctcgcctcgcctcgcctcgccgccgatacacgatgttcaagctgcaccgccaccgctcgtcggaccgcgtcggccagcgctttgacttccgcttctccaacttccgcgccgtccaggtaccatgctctcctctcgatcccccattccttcttgccctcctcaccttgccccttgggattcggattcggattcggattcctcgcatggggaatcaatcgcttgctttgcgacctcgattcatctacgtagctcaccagcatccaaggtttcgcatttcctg

SEQ ID NO: 64651 - DNA, 2640 bp, Oryza sativa
tcttgaataagaaggcctgaacctatataaaattccttgtctctgaacccatctactttttcagcttgatagccacccccttttagtattgccgaaatcttgtttcgacactgcgtggtcagagaggagaagggtgtaggagaacaacaggaggaagaagggaaggtaaaggccaagcaattttggggtttatggtgacttcgcaactagtgggtttgttcttaaattctagtatcctcgctgcaacggtacttttgtttactttctggaagcataatattcaaatagaaattgattcgatagccgcttacgcaattttttttaggttcttgtttacgggctgggaaacgtattttcaaatctggtagtaaacaatcaggtttcgggttatgcatcctaaataaagtttgtagtaatcgtcgatatatttctaacaccactggtttcgctcgattccaataaacggtttaggagaaacaacagaaacagtattattgaccgggtctgttttaacatggacaataattagttttacttcatctgagaccaatagaggcttaatctgattttgtgcccaacatgaaaaatttagacaattttatctagatgtccgaagttgtattatttgctagattatattccgttagatggcataaaacagtaatagaactgctgagtattctttactcactcttgtgcataatttggtttttaggtaccaaatgatatcgatcagcatgggacgagagtaggacaaggactacacattttattacactattgaaatttggttttagatcatgattttgcttagcataagttttgcgtagaacttgtaatggtcaattaaagttttggttcacatttccttgtggaatttatggagttaggatggttagcaatgtgttgattaattcgttattgatttatcttatgacttcctgtcgtggatgtccctatttttaggtgaggctctgccgaaatttctaataattttaggagttagtggttttgagtgtattttggtgtggcactttaggtacgtggttacctgggatgttacagttgagaccaacatcgattcggagtcggcaccggcatcgctcgggccgccccacgccgtcaccgctcgggccgcccgacactgtcgtcggatggaccgccccgccagccgccgctgctcacccccagccttcggcctcatattgttctgccggttgggaaaaaaaagaaaggagagagatagagcggaggggaagatgaaagtgaaagaagaaagagagaaagaggggtagatgaaaagtcaacttgcactgtagagcatttagcttacaatgttcttagtctacgtggcatgtgaaaaacagcaaaaatggaggacaccctgctaatacccgaatgctagagctgctggagcagtggggactggtttggatccctgcttcactagggaagtgcgatggagggggaccgctagttggcgcgtatgcgccaccggggcgcattttttctgaggataaggtggttagactaatcttttagttttagataccgatagtttgagataataatggtagtagataagattttctttttcccgcgagatttttttaacgaacaaattgaaaaagaaaatctatatctgaagtcaaattttcaaaattttaaacctatatttgaaaactttcaactcgaaatttgaattttaaattcaaatttcaaaaactttcaacttttcatcccaaatttgaaaactttcaacttgagatttgaaaattttcaactcgatttaaaaattttcaactcgagatttgaaaattttctactcagatttaaaaactttttaactcaaattttaaaccttttaactcgagatttgaaatttttcaagtccagatttaaaaattttcaagtaatgatttaaaaagttttaacacaaaatatttgaaaacacgcgtactgaaaatttaaaaaaataatcaggaaaaagagaaaaagaaagaaaatatcgtgaaaaaaaacaaaaaaacgcagcgccggggagggaccgccaccagctggcgcgcgccaattagctttcgcggggtttggagcagttttggactggatgtcaacccactagctgactaaaaggaccaagctgttcgccacgtgtgcgtgttgacttccacgtcagccttgcccttcatcaggctcaggagctctagcatcgtcaaaagtcctagcggcgggaaaagcgcggcagtttcccgccaaaacgccaccaaaatccccaatctcgcgctatcccgcgtcccacaaacgcgccgacggagagacgggagggcaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgaggtgcgggcgcctcctctcccctccccactgtggcggcgtttgtagagtccttttttcctttccttcctcgcattctgtgaacgatttgacatctag

SEQ ID NO: 64652 - DNA, 722 bp, Oryza sativa
cccatctcctccacccttttgtcgaaagcggctcgcccgcaaaacgattacctaagtgcataaggcaaacgagatattttggaaaaccggtgtattttggaacaagccgttgtttacaaccaccatcggattgccccggttaaacggctataaaccctatagaggacacaaggtaccactgcaacatccgaccatcgcgcgccatacccgtggccaggcacgcatgcctacaacaggatacaagtacaatcgcctgtcatcagaagacatgcaagcaggttcgtcctagaaagaagttctaggtgaccaaggatataatcaggagcgctcccatcgacccgaagccagtcccgtgaaaattggaatttcatatatcttaccttcttcgtttcttcaggaattttctaaaataattccgtggaaccctcctcgcaagaaaatacctaggtgcagttcctctccctctctttatccaacccttactaatcttgaggacgagattattcttaagggggtaggtttgtaacatcctggaaatctcgattctgaaatacggaattaaaaattcggaataataaaaaatcttttaaaacatttttgcatgctgggatttattatgtatttgtgtgtatttaggttgtgtgccaaagatctcgattaaatcttatctcctaaagggacgccctctctgtccaacgtcctttccttcccttatcttcacg

SEQ ID NO: 64653 - DNA, 2101 bp, Oryza sativa
tcccccattgctgcgagtgttcaccatctggcatggacagggcacaagaagagaaaccggggaaactacttaggacagagaattactttaacttttattgatcttaactgagtttcattattacaaactaaagattctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttctccatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatctgagaatttgataaaacagttaagtcattaaacaatattaatccaacgctatacaacataccctgttgtataggccccaccattcttgacaaccacccc

SEQ ID NO: 64654 - DNA, 23567 bp, Oryza sativa
gatgtcgctttgatttttttacttgcaacgtttgatcattcgttttatttgaaaaattagtgcaaatataaaaaatgataagtcatatttaaagtacttttaataataaaacaagtcacaaacaaaataaataataattctaaaattttttgaataagatgaatgatcgaacattacaaacaaaaaactcaaagcgataagtaatatgggacggaggtagtataagagtaacttaaatatttaagaagtaaacttaatcagtagcaaattaatcgacctgctattaattaatgttggtatttatgttaatttccagagtaggatctacggctcaaattaaagccataaatcaagtactttacaaatctaaattgaaattagctcaaataattgcagttacaagcttttgtacaattcacctatgttctcaataaaacaagtcagaattaattaacaagggctaaaacaatcgaactaaattataaagaagaaacatatcatttttaaagaaacacagttttaaagacattgagtaagtaaattaacctactcatacagatagggtgtatgtgtgtatgttcaaaggggtggttgtacgcgagttgtggacgcatacgtctatacagtggtggatccactgttggggcttgtcagtgcgcaagtcccagctccatgatccccttcctctaattagcaactaatgactctattagcatttagtgtaaatccagtagtatgacaaggaaagctagctcaagcactcaatgtccaaattaaattgcaatgtcaaatatgttataagtataccatatcaatttcttgatacatttgtgtgtatatattaatatagctgcaaattaaaatggagaaagcaatgggttgtcttttgatcatatgggtttgggtttcatcgaaaatacttagttgatatatcctagtttgtttcagtcacattgcccatatttatacaaagccctccctcaatttatatctagattcgccactgtgtctatactgtgtttttcttaaaaaaaagacgtggagtaaataatcatacttaaaaacaaggcgagatgagatgacaaaagatgagagagagagtaaaaatcaccactttggcttgtatatatcccggccgccgcttgctgctttcttctagtcttctccaattattcgcccatctctctctctcttcttcctcctctcctccatgaaagctagggaaattaactaagggcagtggtgcaccacaagttggtgaagctgccagcatgatctgatgatgatgatgatccacctctctcatctgtgttcttgattaattacggatcaatcgatcaggtcatgctgtagtttcatctgctggttgggagcacagcaaaaaaaaaccctaactttgtagccggatttgcatggattaatctgctaggtagctcatcagattctttgagagtctgccttgctcttctgcagatgaagacgtaatctttgaacagatgggattctcaactctcaaggtgaggtagtcatcaatccaatccatatacctgctcaaattcagttttaattaaagactagctgcttctatggagttaattagggatccttttttatagatctctcttgatctgtttcttagtctgttctttcttaataaggcatatatacctcttggatttggattttcttgaaaattaaggtagtttatgagttggatgtgttgtgttatctgcccagccttaatttaactgtgcttcctaaaaattcgtttgatttgatggtagcatctgaattgtgaactcatctttggagcttggactttagaccaggtgccttaattccttaacataagatttggtccatattgtttatggagcttcttatcaagaaatactcttttgattagggagtccccttgtcactttcttcagttgtgcaggtacatatgacatatctgtattaaactgatgacattcataaccaactgtccaagtagggattcatatctttctactaattgcagaatgttttcttggctgaaggaagtttaatctaactgttcaagttagttgcttggttagctgatagtgatccctgtgttttctagttgttgatactgcatatacatatatctgtgacatatggctagttcttgtttgttgtgtgtagataagatacatacaagattctgatctctgcagcaaaagaaacaaagcttccttttttctcttgttttatcccctaatatatctcttcttttgcagttctagctagcaatttcactgtaaaacatgtgtattaccgatcaatactggcatatatctgaacttgatgcaatacatgtgtattactgatcaatacataaaactgaaaatgtggaacatatctgctaattattttcatgagtgtggctttgattattgtgatcttgccacttgccagcaatgatgttagctagtgatgggaatatcacctgaccaaaggagggacatgattaaccttgctaattaagtaacaagaaaaggaggagggggcaaaagaattatggaatgggttttcttgacctgaagacaagtagtaagatttgctaatgcttgcttgcaagatatgcatgcctaaccacaaaacaaggagtttggcactacaaaactgaatgatgattgcctcttgcttgaaggatgaaactgctgcccatcttttgatcatggcacccccttcgcatatgcatgattgcccacacttttctcctcttttgggctctgtactatggagatattcaagccattttcttgagattttctctgcaatgtaatgacctgttctgtcccttgatgtttcacttgcaaaggagactgtactacagcatctctctctctagtctctacctctcttgatgtttcacttgcaaaggagattgtactacaccaccatctctctctaccaatctctctctctctctctctaattagttgcaagttttgttggcatctctaaccacctctccacactcatggtcatggccatggctagcacatttgtcacctagcttgcattgcatggtcctttggaagattcatgggccacacacacatggtgacattcatgcaaagctccaagcaggtctcctttattgtgatttggtcagctagctggtttgttacaagatgcccacaacctttgtcctttcaattcaatgcagtgtgcagtgtgtgcctgcaactttcatatacatgttgtaccatcatgtgtcctcttcctggcttgcaaaaatgtaatggctaatcacatccatcatgcttgcaaattaagctaattaattaatcacaggtggctagctaattaccaactgatgatgatgattagtgacaggcaaagatgataatctagatatcttgttcttctcactactgtcttgtcattgttggcgtggagtgcaatgctgccgtttgtgtggctccagaaaggttgccggctttgctgcccttctctccatgttcttgtctgaatcctgaacattttaacaaccgtgtctttttctcttcttccttttcctctttgctgacaagttgatggttttgagatatctattgttctgcttgtttttgtttttgcatgtgaagtcatattcagatggtttgcaaggattagaagtcatgggtgtactgtgtgcaaattgaacttgtcaggaacagtgactgaattttattgttcaggctttgcttgtctgaactcaagaagaggtagagctagggtgttattttttttatctgatttatgtgatacataatcaactaccattcgtttgacagaacaagattgataggtgcatgttcagagaagttccttcaggttaatttcttatcagcttaagattttcctccttttttctctctagtagctaaagtacacttgcatgtacaatatattcaaccggaacttacacagaagagctaatttaacttatagtatatgcaaattgttcttgtttttctcatacctgcatcagatattcagattagtgatacgagtaatgggcctgttcggctgctttgtaccgccgctgccctgccacagctggagaaacaatataccatgcttgttggctgcacccgaatagagccaatacactcagaataagttcactttaggtccctcaatttgtcacccagtctgatttgcattctcagtccagaaaaacggatacaacgcatccctcaacttacaaaaccgtgcagaaaaggtctctgggcagtattgtgcccggttttggatgatgtgctccctttgattaggtcctcgcccacgtggcattgacgtggtgcttatgtggtaattggatcccggaaaaataataaaaaatagtgggacccacatgtcagctacacaaaaataataagaaaaggtggggcccatgtggtcccacatgtcagccccctcttctctctacccccctctctctcccctacagaacagcgagcagtggcgcagaggggggaggtgggcggagcggcgcgcggcagcgggcaaggagggaggcggtgcgcggctaccgggaaaggagggagggctccgacccggatgtgaccatcgaggacgtcggcggcagcggccgggcgaggagaagccgcgggcggcggtcgggcgaggagggagggggcctgcggcggccgggcgaggagggaagcggcgctcgacgaccgggcgaggagggcggcgccgttctgttgggcatcgcgggcggagcggccgacggcgtggagctaccgcgctcgcgggcgacctcttttctgcctcttccacctccggccacctccgccgcccgcggcctgctgtcgctccgccagcgacctcttcctttgcctcttcctcctccggccacctccactgttgctccgcccgcggcctgccactgccgccacccctgccgctctgtccgccggcattctcatgccgccgctccgccgcgaggacgagggtgagccgagaggaagaggagggagagccgagatggacttgtggggcccacgtgggccccaccatctcttatttttagctgacatgtgggcccacatgggtcccaccatcttttaattaatttatgtgtgagcctgacatgtgggtcccacgaagtttactatttttccgaatcgaattatcatgtaagcaccaggtcaatgccacatcagatgaagaccaagtcaaatttgtcacgtaggcgtcatattagccaaaatcgccgtcaaaaccaccgagggacctcgtctgcactggttttgacagttgaggcacccgttgtatctggttttccgattgaagcatgaaaatcggattcgttgacaagttaagggacctcatatgaacttgttccaatacactccggctgatgaggaatgcatgtttcttttggcccaatcaggtactgttctaatggaggaccaatcagcccacatatgtaaatgggccgagcccatggtgctaagctctcaatctatttgggcttattttagcccaacctaactatctgggccatctctaaaaacaatactctgaaaaggccttctcgccattttttcttcagaaatcctcaacacagattctcaggccagttcagacttcacaaaagcatgtactccagaattaggattcctgcattctcagcaaaaccagttgctatgaactagtggattatcctatgttcagctaattaattcagttatctccaactagtttctgtcagggttagtaggagaacagaaacaccctttctgaagaactgaagaatggcatcacattagttcagccagcttgcaacttttctaaagcacttgggattaatacaataatctgtacttgaagcagtcgacggatggagccttcaatctgtacttgaagcagtcgccaccgccgtctcccgagcacagtgatgctcccaagttccaacatatactccacatggttgattcttttcttcccaaatctgaaggagaaaacaacattggcaattatgtgtgacaattattggagcgtacaaatgaatagattaactactatgaatttgaaaattatattgaaatcaatattataagaaattcatatactgaaagtttttacaaaaatcacaccactaatcgattcatcagaaaagatcagggccagactcacacacccagatcactgtctgtcttccaaaaccagctgtcctacccttgatttttcttcggattcaaagaaaatgatgttaacgaatggaaagagttgaaacaaatactaaagttctgctgctgatgctactccaacacctgctacagtagtactgcctactccatatgaagatgctgatgcttttgctttgcaggacgactcggcatccaatccaatcacgtttatcaaaagaagctgcagggccctgtagttgtagtactagtactagcatctcctgatctgatcatctgaattgacctgcctgaattgacctgtcccaattcttttcttattattactcctacttgattcttttcttactctattataattaatactgaaaagaaactcatgtgtttttcctttccttcttgtcgttttggctccaatctttgttcttccttgaagaggatgatgaatagttgtaggtttcagcaacagcaatgtggtgtttagtttcattttcttcttttcatgtttgttcagagaaaggatctcaaggcaggagcaagttttgtgatcttgcagcctttctctaaagagatgagatgagctctcacttttactttaccgtttgcttgctgcctaaaccccactgtcaaagcctgagattgcattagattcggcattatatatatgcagatgtaaacatgaagaagaaaagtgaggtttgagatgatctttagtcaccaatctcgagcaccgaaaagcatttcacagtttcacatcattccatgtctgaacattctgaatacctcctttttatacaagtttaagtaaaaaaagaagatcaaatgttaagcttatctgaacttaaaatgttccacaatccatacacaccgtgtttagagcgaatgaatttcatatgaaacaattcaattcccgtattagaaatgggaccctcattgttaagtaccacttctatacgatcttaagtttaaaaaaaagatcgagtttaaagtttacccaaacttgaaatgctccacacttaatgcacgccgcattcaggggcatgcatgaatttcacaggaaacagttcaattcccgcattataaacgggacctcatcgttattatagcactacagttttgcatgattgcatcatttgaaacataaattcctctcactcaccaagacagcaacagccatcaatgcccagagcctgaactgcaaatgcagctaagctaattaggattcaagaattgtgtggtccttgcaaaaccaaactgtcctacatccatataagctggtcctggaacaattcctccttgcttcgtccatatctacagttggagaggggagaacaagtgaacaaccctagctaatacattctcaccctgctatatgcaaatgcaattgcaaacaaagcaatcatcattaagggacccagcaattcaaagggggcaacaaactatttggtgtatgtagaatctatggattgataggcaagaggggtagatgatgttaaggtggcaaatggttaattggttagccaacttttgctttcaggctgcagtcaaagattctttagcctacaacaattctgttgtgacctgtgacttgtgagtactgagtagtagtaccaggtacactctattgttctttcttgttcttatatactgaaaaaaattacaagtagacataaacagattattggtaatgacaataaaagcataaggagaacattcaagtaagttcactggctgacaaatgcaacggtaatacttcatccatttcaaattacttgttgttttagctttttttctaaatcaaacatttgaatcttcaatcatcaattttcgtatacaccgaaagatttatgttttagattcactataagaaatactttcacaatatataatctatatgttaataaagtacacaatttttttaaaattaatagtcaaagataaaggtgtttcagtaaaaaaaaaaaagatgataaaagtatttgacttaggtcaatggagggagtagctaagtttaccacggttatcggctttatcaaggtaatacaaatcgagaaaccgctcgggaaaccagccaagttagagaaaagaaaaccgaaagtccaattttcagcaaatttgtttgaattctaccccctttttttttgttagtaatcgaagtgaaaccacggttaccggaagagcaaaagcacttaagaagttatgattccctgcagacaccacatattacaaatgcagatgatgcttgtctgtctgtattttcattgcccaaaccccctcaagttaaatcagagacaactgaaaagagaagatacaaaacaacacttcttacatgacacataaaaccaaaaaagaaaagagaaatcaacaccacacacatctacaaaccatctctgaatcttgttcagttttctgctcctaatgacagcaacagtgaagagtgacatgatcacaacagcttttgcaggcaatgccggcgacggcggcggcgttcggtcaggcgaagcgcttgcgacggccatcgatggtggcgaggaggcgggcgacgcccttggtccacatgtcatgctctctctggctgccgcactcgaactcgatcacccggtgctccgcggtgcggagcccgaagtaccgccggtgctcgccgccctctagcaggtgcctccccggccacgccgccacgtccctgcacacgtccaccaccacatctgccgccaccgccaccgcgacaaaaccccgccattgttagagacaaaggcatacacccctccgttcttaaaaatatatatatataaaaatcaacttctggaaacgaatctggacaagcgcttactcttcttcttcttggtgagcgtgcccgcgacgtgccggctcttcatcttgagcatcacctgcaacaatggcgaaccgcaacttgggatcagtaaaccttttttttcgccaacaaatttgatacatctaagaacacaatttggcatatgttggttatggatttaccactcccgtccgatggatgtagaccgagaccaccttccaatgcaaagctcctgcacatgatcatcgagtttgattgattaacatcatcgaatcgaattagtggatgatcaatggtgattgggtaggtaggtttgttacctttgcgagtgcgcttgaggagctcggtgccacgggcgaggagctcttggctgcagatggtgaggaagttgttgtcgtcgtcgtcgtcgtcgtcgacggcggcgacctcgtcgctgaagctgctgctcgtgttgctgccgttgccatggtggcggtggtgatgctgctgcttctgggcgttgtgtttgtggtggccaccgccggtggtggcggcggcgatggcgttcttctcgacggggatcaccgcggccacgttccacacgtccttgagcgccctcgccttgagcgtcgcggcgcctcgcaacgctgcaatgcaatgtagagagatggcgtgatcagtcacggtggctcgccggagacgatgaggatgggggtggaacgcgaaccggtggcggcggcggcggtgatggtgacgatgtcgccgggtgtgcggacgttgacggcggaggcgatggcggcggcgaggtggtcgcgctcggcgccgagggactcggcagcctcgacgcactgggcggcgaccagcgtcgccgcggacgccacggccatgtcggtgcgcgcggcgcggtcgtccctgccgccgccggaggccgcggtggcggcggccacggcggcgacagtggccgccaccgccgccaccgacaccgcggcgtggacctgcgcgttgtgcgcccgcgcctcctccttcttcttctccttcctctccttcagccaccgccccaccgtcttcccgccgccgccgacgacgccgcggtacggctgcggcttcggcgtgctcaccgctctgcaaaactgcacatttttccaagaaaaaaattgtctaattagcaaatagttccaaattagttcctagtaaatcaaatccctaggtttcatattatatgtcgctttaatttttgttagtcaaacttacaaaatataatatattttaacacaaaataaatatattatcaaaatatattaatgttatatttagtgaagctaatataatgttgtagatgttcctaaatttttctataaatttaatcaaacatacataaagatgtttctaaatttttctataaatttaatcaaacataaataaatttaaatagaaaaaaatcaaaacaacttataatataaaatggagggagtagtgttcaatgcatcaaagtcattcgatccgattctgtcctaataatcccatgtcaccatcatataattcaatccaaaacccaataatcctatcaaaaaccgaaatttttttaatgaaaagaattgtattaatttcatcggattggaactgcttaaccaaaatgtggcattcatgtacatgcactcctactacacaccattaggtaaaatggaatggatagctaataaattcccccaacttaaatttgatctacagcaaaagtggcaagcaaacagtagcattacaactggagcagctaagccaagaacaaactctgaatttgacaggttgcatccaaaggggttcttatttctgaacagcagcagcacacactgtaactgtatcaaaatgatgctaattgcaaagtgtggctgcatttcactgacccagggcaaatcattgtgcttcttttccattccatgacgttaatctagaaccctaggttaaatcaatggagaatgttgagcgtgccataggataggccaggtcagtcagtgcacacgccactgaagaaagaagaaagaagaacacaagaagacataatcatggagggcatgagcatgagccccaagcagcagctttctggagaggagaatttacattacattactctcaagcccctgttcctttcagatctttgtcgcagattatttgcttcccgcttctaaaaatatgatttctcaaaaaaaaaaagtctactgcgaagtttatttgtcaaaatattaatttatcgtgttaacaaataaaagctatttcctcagacagtgccttgattagagcacagattaaaataaaagaatggcatcatcaggttaggaacagaaagctgtgggggaataacacttgattagggataagaaaggcatcaggtagtcttgacactctcagctcatcactctcatcaagctcatggggcaaaaaggcaggcaagcagctaaagttcagagaagagagagagagagagggaggcaaggcaaggcaaggcaagcctgctgcttttcacccagagatggcagtgaagagagtgggggcactgaacatgttgcagggctttgcttgtggaaagaggagaccacaaggacagaaatgggagcaagaatcaaagcttcagttcttacacaccaagcaaccaccaaagaccatcaaatcaaacacctcttcctgctggtcagagctacaagtgtacagtacagaggaggaaatgtttttttttaaagaaaaaatggaattgggagtgtttcttgtggaaggaaaaagcatgagatcacatggtggtcttttcttcagttcttctctttctgaactttgagatggcccagaggctcatggggcaacaataacatgcagtgacaaattgccaatcaagtcttttgaccatgaccactctcatgagacatgtctctcatgagccaatgcaaagaggagctgaattgtggtggcacccatgcataggatttctgttcctatcaagattcaacttcaggaccaaagcttggctgagtacacagtacactgagagtgcatttcacattgctttgtgatgctatcagagtagacatcagcaaaggaatgcatggttgggaaaggtaagcagattctttcaatattcaatgtgagcattggtcaggtgacatggtccaatcactagtctttggttgttgattctttttgtcaccctaatgtttgctctactacatctgcttaattagatggcatgcttcagttgctaggcttgataagctattcacaagaactgcctctgttaaagagcatggcatgttggcatgcctatgtagctgccgcctgcagaatggagtgaaaaatgagcaatcattgctgtgagagctcaaaggcaacactctaacaaactagtgcagtgattcagagaacaaaatgtatcaaagggagaagaggataccagccaggcatgagaaaaggagcaaaagcatggaagaaaaggggaatgattattggtcacaagatgtatcccattttggggtgagaaattctgcagatggaaggaagaaaaagatatctccatccatatttgtgaaaaattcacaagtatatacattattctgcagtggctttttggtgtgtagtatttctgaagcatgtgagcctgcagagaaaatggaatttgggcagcaaagtattccattggatgaagagaaaggcataaactggaattctttctcactgtgcagaaaattttgtgaaaaggaaagctgcaaggctggtgtttttgtcccagaggccaagtccccacaagttctaacactgaaattgactaacctggaaatgctaaacactacacaaaattagccaaagtgacttcttgttgtgtcccagatatatattgctccacaccaaaaagatgcaaacaagctagtgttccatttccacaaggaaaaaaggagtacacaaaatcatagctgaatataaccatctcaaacaaaatgcaatgagcaggataaaaagatatcatggaatttcttgattatcttatccaaattggcagtaaagaatagcttatcctgtttttacccaacaatgctagtgcagcaactcccttaatcatgttcagtatgtataaactagagcaatcacacaccccccccccctctagaattgacaagattaacaagtcatccatgaagggaaaaaaaatgttcaggtgcagggatcaggagaagagaccttgctgtcgtcgacgtccggcgagaccggtgggctgtcggagagcgagccgccgccgttgagagggccgctgctgtgtgagaggcggccggaggtcagcggcgacacctcctgctgctccatgaaacaagaaacgagtaaattctcagtgtctatctgcaaagtgagctactgttccaagcagaacagcacaatttcacaataatcattgaacatgcaaggaagttttaaagagtaggaaatgttggtgtgaattgtgatcattaattagcttggattcatgttacagaaccaaataaagatggctagtattttgtgtgtgttttttcgttgattatgatgggggtgtgtggggggaaagaaatctcatatttggcctcttgttcttgtcctcacttcagtccaagaagtacaggaagtcagagaacattaaagcaaagcaggtactactaatcgacgaggtaatacccatgagaaatcaaaccaaaaacatgcagttgagagaatcacacctaaaagttgggagatacaagttttttactgcactgattgaagttcatgtattgtttggctagagagagagagaaacagaatgaaaaagcagagaaacatactacagaataatctcaccaacctctcacctaaaaaaagaataaaataattaaagtccataatccggttgctattaggatgtactcagttactcactcactcagggacaagctcaattaaaaaagaccgaattaatctctctattttttttaattaaggaagagagagagagagagagagagagaggatgaggcaagaacgaagggacgaaacgcgcacgcaccgattgcgacatgatcctgtccatgatgagctgcgaggtggccgccgacgcgaaggagaaggagctcccggaggcggagccgtcgacgtcgagctcaccggagacgtcctcggcgatgaccgcggccgacgccgccgccgccgggaaggcggcggcggcgagcgcgcggcgggagacgtcggcggcgcccgacgcgctccacgaccgggacaggaactccagcgccgggtcccgcggcagctccggcggccgcagctcgccccttcctccgccggcggtgaccctgccggattcgctcatcggagcagtcgctctcgtcgtcggcggcgagcggtggcggcgtgcgtgggcgcgaaaaaggtggtgcctttggagaagtgggggtgttggttttataggagtgaccctctgcaaagaaagacaaggaggggattaaccgtttgtgcatctaaagtgttttttttcttttttttttagtttctctggctttttgttttttgaagtagaattggtcattttctttattggtatatattttacttttttttggcttttaatatgtttttaatacttgcaggggatttcgcttacggatgttgttgataaggtcgtcttgatttacggggttgtcgtttctgatgtaatgacgtggtattgttggcgtatacggaataagtgataagctctacagaaagtttaataccgtaaaccataattctcgatgggttgttagaagtttaatcgtgtgggtttgaggtatgacgtggtgagcgagaggtttactcattgtcggtttgtcgacttgctggtttggtaagacaacgataagaaagatgaagatagtatagtatactatgagataattttggctattcatggtttatggcctgaatggttaggatggacctctaataataaggagagtatagtagtgttcaataatacataaaaggtgaaccactcgcacaaggtaactataggagccagagaagaggttgccaatataattgtgaatatgatactcaataacctacaatgctccgcagttacatcagcattgggagattcatatcgcaatagacctttctcaaagcaacttagcacaaggctaaccattactctaatgaaccactaaaaagtttctttttttagtttatctgccttttttaagtagaattgttcattttctttattggcatattttaccctttttttgtctttaatgtgtttgtaatacttgagggggggtgtcacttacgaatattatcgataaggtcgtcttaatttaccgatggttgtttatgatataatgacgtgataatgttggcgtatacggaagaagtgataagatctatggaaagtatactagcgtaaaccataattcaacgggttggtagaaatttattcataagggcatccacaatgtacatgaaaaccagtccataggaaataaaaaattccattcagctatcttaacacattatgcaactagtctatagcaaagaaataacaaaagttgtccatagcactatgggtagtccatagacaataaaaaatcatagttatgccaggtgcatgcatgctgcagcctgcagcttcagctccggctgatttttttttgcctttagtgggacccaccttaattgcacacattgtggtggtttctaaaactatggactcccaggtgtgggtcccacatctatggactagtttgctaaatacattggtgttgccctaagggtttgaggtatgacgtggggaatgagatttactcatcgtcggtttgtcgacttgctgattaatggcaagacgacgataataaagatgtaggtagcgtcatcattgtagactatgagataattttggttattcatggtgtatggacttgatgattgagacgaacctctaatgaacagtagtaagaaggagagtagtagcattcgatgatatatgaaaggtgaaccactcacatgaggaaaccgtaggagccaaagaagaggttgacaatataattgtgaatatgatgctcaataaaactcgcctgcaataaattcagcacgacacacagcttaacctcttaaacactacaatgctcagcagctacatcaacctttggagattcatatcacaatagatctttctcaaagcaacttagcacaaggctatccattacttttacaagtagcatcacatgtaaaacttaactaacaattaaaaaaccctcatgtcagccactcttcatttccaaattacaagcaatggctccacattccctggaattattgctccttaaaatagcagtactatactactatttttttcctaactcacccaatataatcaattatgccataataagtggtgctccatttgttgtcaagttagtttaaggtctcatctcatgcctttttggatgggccttctctgctttagtttttgtcttctcttttcccagatgttaagaaaccatagcaaaaccagctatcctcacactttttttctctttttttcccttagcttccatgtccttttgttgtgtacacttgtgctagctgtgaaccatacctaggcccccacacaagacatggtagtatggtacttgttctgttggatactcatgtgttgtgagcagcagtggttttcttctgtctagaagcaaacatggcctgtactggcaacatacttatgtgctttctttgctaatggtcatgatgatctttttttattatttgggggtcgctttaacttaatttgactttaagcagatacagatacatggatgagctttggattgtagtgcctttcttgtccatgcagaattgcataatagaagctgaaacatgtgtgatgaacagaattatactactacttgtttgttgataggcctatttctaggaaaaaaaatgttattttttgagtagctagaatgtgatcaaatagtacatgatttaattgattctatggatataatgataaatactacatccgtccataaggaatcctattttttttagagactacgggtaaaaaaaacatgttgccttattaacgagggatgtttagggggtggggaagacctcttataattatagaaaaattctaaaccattagatcccttatatttgtatttgtagatagagggaacatgatttaacctgtgattgtaaggttaaccctcactttctatatatacaaaccaaatttgtattgcgtatcacgttatgcatatactcaaattttatttttaaaaagttacagggcagattaaccatcacaatactcacattagtggttgcagtgccaagggcaccaagattagatcattagagcatccaatttgatcatatcaacataagtacatgacagggacgaccattaattttgatttgatcttgtgttcttgtacatatgtgggaatgcacagaggcagcagccataaacagctgatgcaaccacccacagcatccaccgactcacactgtagtgtatactgtacacacacaccatttggtactctacctgatcacctccagctctttcttcctctctactcctactcctactagatcagtgatcagtagcctaccctgccggctgggtcactgccaggtggggcccacccagaagcatgagctatatagcagattagcagtagcacctgagctacttcacctccctgtctgtatgcatgatcatgttctgttttgggcttgtggcctgcattggcggtggtggccaatggctcatgcagtagttgaagaatttagattattggttggattattgctgcgaattatcaacttgattacaattatctatatatatttcttttaaaaaaactccaatggtggttacagtaaatctgtcccacattaccctttgaacttctaaatatattacataacaactacatttaaatgaatagtcacaaataaaattaaattgaggtgagtataacttgtagcaaaaaggtggatgacacattgataaaaaaatatatgcttttatttattttagacaataatattatgataacataataactagtttaaaataggtggtctaatgcagaaaaaaagaattttaagaaaacgcatttcaaagcgtggagcaaataacccgttttgaacttttgataatccggtaaataagctgaactgaaattcctatagtaacaggcagcaggcagagaaagacagatttcgctgggttgctttgatgattggttggttgggttggctgcttgatggtctccatcaggtccacccagcatgcagtcagtcatcagtgtgatcgatccatccttgatatgagaatgagatgctgctgctcatcagtggtgatcactagtgctgctgccagtggacagcagcaacagcaagatggaaatttcttccatcctgttgtaaattcttcttctctgattttatctgcaaccatgagtatatgctgctgctgatgccaactcatgatgcagcacatgaaactacagcttctctgcagtcagaaatcgaaatagtgatcaacagatcaggtactattaaccagcaggatttgcattgtttggctacatgtgcagagtcttaaatttcccggctattcttgctcgagctgaaacctgataagtctgtccgtcctaaaatataactgacttaataagaacaagaaaactatattacttcttgggtgtgtttagttcacgctaaaattagaagtttaattgaaattgtaacgatatgacggaaaagttagaagtttgtgtgtgtaagaaagttttgatgtgatggaaaaattggaagtttaaagaaaaagttgggaactaaaccaagccctaattgagtattaggttactatattttaaaatggagggagtacttacttatctgaaaataattcagtttggaagttcagcttagctctcatcaggaagacggcatgtaaatgcaggtatcatgattcatgagcaaagaaggcagttgacagaagacagtgtgtgaagaactctgcaatggcaacagcaagagcactgtagtaggtcgctgcagattactatgcacgcatcaggcttcagttcagacagcaagcaggcaggaggaaacaggtataaatttcatacgagaaaaagaggagggaagcagcgagaagagtgaacagtggaagggaatcggcaacggcaagtgcagtcgcattcatctccaagagtaaagaagctagataggcagcctaccttgctacgaacatgggcagctgcagaagcagcaatggcggcaacgcatcagcagagcagcagcttaagaattcagatcaatagcgagcactgttcattgcgtagcgtagttcagaaactgaagctcactactcctccgtggtactctccgcctcaaaataacatcatttttcactcatctcacacatatcaatacaaagaaaaaaactatagtaccctcactttattaaatcctaatgcgtcaatgtaattatttcatactttattatttttaatatttatcccctatttttataaacttatttcataaattctgatgcaacgattatttaaaattaaatttattttgagataaacaggagaaataaaagatgaacttattgagtatggaaccggatcctctgacgtagcgctcgctacgtcagagggacgtccggcagcgctcgtccatccgttcagcatccaacggagttgagcgcgcacagcacacaggctcggcccacggcaaataaaaaacggcccacatcttcgcgttgacgccacacaagccgctgcggtgcagccggtggtgcgccgcgccgccgccacaagtgagggaggggaggcctatgccgccgccgccacacggccacaacccgtgcttcctgatgaagccccctctgccaccgccctcttccttgaccctgtcccacgcctccgcgtcctccctcgtgccgtcgtgcgggagcctcgctgcgctccggctgcgtggaggtccgattccagatcgcgtatctgacggcatggcagcattcgctccgctgcagttcgtcctttgtcgttcgtcccagaagcgcgtcgcccagtcgttcaacccatgtcgccagggaactccggccgccagaatcgccgctcaatctcctcgagttcctctcgagctggtggagcgcgtcggccgtcgatgttccccgtgcgtggggcacgcgatgtcacctccagcgagggcagagtagaaccgatcgaagatgacgctttctttccatttgttaaagaagacatcaagagagtgtaatgtgttaaccaagaaaaggaatttgcggccatgaactgaagagaaaacgagtgatttttttatttttttcttcaatttgttcctcgtctagctcctcgacggcgaggacggactagtattccagccgaccaagttgaagatcacggcggggttgctcgatccttacccctaggaccttggcttcctgctctgcttcttgctcctctagccaaacagcttggacacagacaaattgatgtgaccatggctactacggatacatccgttgctcacatcatggatgaacaacaagatatcaagttcaagtcctccaagtgctggaatccgattcggccacctactacactgctgacttcaaacggccgccgaatctccatacgacctccgttttcggccggtgagtacttgatggaaagctctcggagtcctctttccaatgcatcaagcctcattgccaaattccatctcagtcagcagcaactgaagaaacaaggtgctgcgacacctgtaatgggcctatgggcttgtaacttcatttgggaccccggcccaggtggggcccatgtggggtgcgccccaagctggtggggcacgaccctaggcacccctaggtcgtcctcctacccctatatatagctagttaccccttcagggtttctgggttttgatgatagagatagctacttgctaccggctcgcagcgcgcgtgttggctaaaccgcccgtctgcctgtaatcggaaccccaccatattgtgttttgatagtgaaactttcatctttatctagcaatttcagtgcttgttctacttgttcttgcttgttcttcgattgcttgcaggacgagtgccctcgtggccgggttgacgcgcaccacaagttcgcggtgaccattggaggtggtgtatcggttgctaaggcgtagcgtctttggacagttgtagtcgggctgtgaacgtcgtcttcatccaatcgagttatcccttacctctcatcgaaagatcggaccacaaaccctagcgggttcccatcacaaatgctacccagccgtcgacttcacaacggcatacttaacaacagcagaaccagcggcgcggtgaacgacagcgagcaagtagcgcacatgctgcacccatttttccctgagcgagtagcgagcgttcgatgcttgatggacggcggatcgacgggctactgccctctgacttagtttttcctaagtcagaggatctggttccggaagcaagggcaaattgtggggccatttgtcagtgtcacaaggtggctagtttcccttgtttgcaatatgtttgccttcttcttcttcgggttctttatggccggacatatataggacatggttgtattcctactgaataatgatagcccggcatatataggacatggctggctatattcctgctgaataatgatatggagtagctagtaatctggattcttcgagaagatgttccctagtttctttgcattccatctaattagttatgaaaaaaattggtaagatagattagtatgtgacggggtatattattttgtaaacatttaagtttagattatacaagttaaaaaaatatgaccgtgagtacacatatactagtttgagttaaatttgttgattttattacaacttgtggggatcaaattttaagttacatattttttagatcgatatattacatattaatctatcttatcattcattttatataactttttggataatatacaccaccgaggagacatccccttatgcatgagattaaaacctatttccgtagtaaccttcactatttcgtgttttcaatactcctatatgacaccgctaactttattcgatagacggttggtcaacaacatgatacccggagaattgactacgtacgaatgataatagatgaaaccagcatgatatgaactgcaatgatgatccatcgcctcgcctgaagaaagcttaagcttatataacctgggatggatgaatggatggagaggacagaatattcctctcctcgagccttttgatgtcctgcctgctgctgccattctaccaaattgccaatcagcaatatgcaggcatgcttgcttgcatgggcaaaaccatagaggatgtcgagctaatttaaggtggtgtttggatccggggacttaattttagtatctgtatttagacactaatttagagtattaaatatagattacttacaaaactaattacataaatgaacgctaatatgcgagacaaatttttaagcctaattaatccataatatgcgagacaaatttttaagcctaattaatccataattagagaatgtttattgtgctaatcacggattaattaggctcaatagattcgtctcgcgaattagtccaagattatggatgtgttttattaatagtctatgtttaatatttatagttagtgtccaaacattcgatgtgatagggacttttaaagttccagtcccatctaaatagggtcttaagctagcggcattcatgctcgatgagccagttgaaaatgaagaacaatgtatatataatatatgtctgatgtctccaaaagcttcgaatgtccacgtgatgttgctgtagcctgtacaattttactacgtatatgcctagtaatactacaaattatacaatgtgttttgagtttatatggaccttgggatcttcaacctcttagccaagacaacgatgattaccactctgctgcagacacacacactcacaaactcactctcactgtcgattcttttcccattaagataaatatatattttacctccgttcttttgtggttacgatataaattttacctcggttttagtgtgctttttaactgaaggtgtattttgtacgaaaactttttatatagaagttgctttaaaatatcaggtaaattcatttttcaagtttataataattaaaactcaattaatcatatgctaataacttttttgtttttcgtgccttaacttcatcttcattttcagtagaaatgaacatcatctcggcgtgtgctttcagctgttcaactcatttcgtatgcttttgtactttcttagaataataaagtggtgtttaacatccaactttgcattcctattcagattacaatgaggatttgagaatcaaacatgacacccctcctgtaaggtagaagcaaacctggctaggttgtgagcatcaaagttacaatacaagcctgattttcctaacaaaatttacttttgcagaatacttctttcttgc

SEQ ID NO: 64655 - DNA, 629 bp, Oryza sativa
aggtgtgaataaaatacccagctccaaaacagagatatggcggactaactagcttcattccatattacatcatggcactgggagatacattccaaaaggggagaatgggactgccaactacaacgcaacgcccaacaaggactcacatacttagccttacacagggagacaatggaggcgagagtggatcgatcgatagtggaggcttcctacgagttcttccgacttgttggcctaggtcaggttgacagtcgcgcgtgcctgtgcgagcagagcagaggtgttcttgtgggagagctgctggaaacgggcttctaggtctgtgtaaaatttgcttacaacaacagttaccatgctagcattcgaatggcaccctatgaggcactttatggaagaaagtgttgatccccattatgttgtgattccataggggagagagctgttttaggacccgattgggttcaacagaccacagaacggatagcagaaatacgacaacacatgcttgcagctcaaagtaggcagaagagctacgccgatgtcagaagacgggaattggagtttaaagtgggtgatcaagtacttctaaaggtatctcctaccaaaggtgttgtgagatttggaatgaa

SEQ ID NO: 64656 - DNA, 942 bp, Oryza sativa
tgtaaatgagactaaataagataagactcgagtaaacattagtttcacacttatatatcaataacatggaaatcatatatatgaacctatcaaaaagtaggagataagaagtggtacatatcgttttatctccatgcatttcatccttgtcatgattaaggtccatcaaaaaataatgcatgtcttccacacctcattatcgggaaataacctagtagacaacttatgcaaaagagaggttaatcccataaacatcggtttatcatctatcaccaaagtaacaattacacaaattgtttaatccaagatctttcaatcttctctctttggtgatggataataacctgatataaacaattagagagatgagatggaagatgatttcaaatcaagatagaaatcttataataaacaaaatatagaataagctccccctcaagatgtgcatacatatggatataaaggaacacatatgcacataatcaatcaagatcaatgaggtagggcgaattcgagctcggtacccacaagagagaccaagttagaatatgtgaagtttaatacatacctctcatcatttttattttcatatccaaataagactagtcaaagaaaggctcgtaaaaacgttagtctcatataattagatttgtcattaatcaccaaaaccaaattaaggcacttgaacttacaatgggcggcgacactgtagcccgagggaaaggtcaacgtttatcccgaatcgtaattatcttcaactcaccgaaagatcgggccaatcatagacgtgagtttctcaagtggagatcagggttcatcggggggggggaggggggagggggcatcgtccttttataggcggcgagaggcgattgtcgacttggccacgatgacggtgatgtgaagaagaagagcacaaccgccgccctcgtcttctgattg

SEQ ID NO: 64657 - DNA, 9958 bp, Oryza sativa
tttgtgtgtatgaattatgatgggcccatgacctggcccgaaagacaggtaggccaggaatatgggccggcccgttattattatctacccagtttggattgaatgaaactggcaactcgttcgtcagtgtcagtctcgagacgtcctaaaatcaagaacgaacaatcaagcagagatcttgtattgtatgcacatatatatataggccgatttttgtacccattctcaagcttcttttcattgattattcagaataccaaagaagatagaaacaaacttttgtatattgtgatgccaagttttctcttgtcgaaagattgaaactctgaacatttaggacaacgaacatcataaattaagaaaacattactacttaccttcttgttagcatttggaggagaatcttgttgtggcctcttcatttttttttcctcaactcatcatattcataccatactaccatcctccaaatgagcattcagtcttcgaccagatgcgcaaaatttgtctagtgtttgtataattttgagttatcaacagtcgcgatggagatttgagaagataaagagatctcactccagtccaatgcactcatcgcagccatgatgaatgatgcatcagaggagaaggaagtttcaagaatgtgactgaattcttgctactaccttcaaaaaattcagaacttcttcgaactgccaccattcgccattggatcctgaatttgattccaacgtttgtaaccgcctccaaattctttcactcaaaattaaatgaaacaaagatcattccttactacatttattgccaagctccggtttcgagtgtcaccatggcccattgttctgctgcctgctccctgctgctgcagcactgttcaggccttcaaggtccaggctagcacattgaatcctcaaccattgtggctgtctcgacactcataaacccagcagcctcctacatcagtagcagcagcagcagcaccatggtgtaccagcatgcagtacagatcaaagtttcaaaggcacacattactcatcactattcaatacgccattgttacacactcatcataagcacaatcatgtgaaagaagctagtcaagtcaggaaggagaaggttcaggccactgctcccctctgtccgcaaatataaggtatttggggtttctccatccatccacaaaaatacctttgaatttatcacttattggtagttgaatcggtaggcatgatctttcccgataagtaaagtatcaggggcatcagaggaatttcaccttaaccttaaacagtgctaaacaatttagaaccccttaagtcccatcatttcgcctacagctgactatcagcttaaaaaataacttgtgagcaaaacttttatacttatcttcttagtgactttaaagccaccactgaaaaataaactacaataaaaaaatcaaaatcaactataaaattaaaattttaaattttagccgtgactgataagctaaagaacaaacgatgaacaaactttatgtttgtggaccaagggagtaattaattggtattggatcatgagccctcatgaaaaactttgctcagatggtgtttgttaccactggttaaagtagctagcagtagctgtagcacttgtagaccatggtcattgtagcagtaccacattgtgctgagttgtgccatgtgtttgcttctggaagatgagggagtactgcatgatgcatgaatgaatccacagtgctcacattcatagccaggttaattccagtaaaaaaaagcaaaagaaagattgtactgaattactcaccacatgtagcctctgaaaaccccccttaaatccccacaattacaccataattaacattgtccatctcatatgagggacacatttttctttgttgtcccattttttgcagtgaaaggctgtgtttagatccaaagtttgaatccaaacttcagtcattttccatcacatcaatctgtcatacacacataacttttcagtcacatcatctccaatttcaaccaaaatccaaactttgcgctgaactaaacacagccaaagttgaggagttagtaattggtatgcttaaattgtgttgggtacagagtttgcagtcctgcagatatatttaactgaatgcatgtgcaagaagaagaagaagaagagcagtatgtagattggcagattgcagaggcataggtggaagatgtgtaaggttctagaagcatctagaagccgaagctgaggtcactaggccatcacttctgctgcagaagcttcttctccttcttgtgcagagatggggaaggcgggtaggtggctcagaagcttcctgaccggcggcaagaaggacaggaagggcaaggacggcggccagccgccggcgccgccgtcgccggcgccgccgtctgccaaggagaagcggcggtggagcttccggaggccgccggcgcaggccaccaccaacacgtcgtcgctctgcttctccgacgtgcacgccgtctcgccggcgccggaggcggagagctcggccgccgctgacgtcgccgaggagaacgaggccgccgcggccgcggcggtcaggattcaggcggcgttccgatcctacctggtacgtataatgatacgccattgatgacgccatcatctgttcctggttttgtgcaactcgatggcgtgtgggggggtgcaggcgaggaaggcgctgtgcgcgctgagagggatggtgaagctgcaggcgatggtgagggggcagctggtgcggcgccaggcgagcacgacgctgcgccgcatgcaggcgctcgtcgccgcgcagaggcgcgcgcgcgccgagcggctgtgcctcctcgacgacgacaaggacaagcacgcgcgctcgccgcggccgccgacgacgaccagccgccgctcgtcgccgcagcaccaccgatcacggaagccactggtaagcgaagcgtctccgccaccgcactctagctcgcgacggcgatcatgggagacatgaggagaagatgactatggcattgcaggaggtggtggataggggatcggaggagaacgtgagggtcgtcgaggtggacaatggcggcggcggcggcggcgcggcgagggggtgcgggaggcgcagcacgtgcggcgcggcggcggcggcggcgaagggcgagctctaccagaaggtgtcgccgacgccgtcggcgttgacggaggcgagcgcgcggacaatgagcggccggctcgacgactactccttctccgccgcggcgtccgaggccagcgggcgccaccacagcgttccagcagccgcagtcgccggcggcgaccacgcggcggcgctgcagcagctgttcccgaagaactacatgtcgaacacggagtcgtcgcgcgccaaggcgcggtcccagagcgcgccgaggcagcggcacgaccagccgatcagcgccgctgcctcgccgtccccttcgccgtcgtgcggcgagtggacgacgacgccgggcgaccgccggcgcagggcgtcgctggacccgcgtgacctcgccgcccccgcctccgccgccggcgtcggcgtcggcgcgcgcatggagcggtgcgcgtcgcaggcgcgcgccagcgccagcgcgagcgcggcgtgcccgtgggcagtgaggatggacaggtcgacggcgtcgctcgccggcggcagcgacggcggctcgtccgccgccaccgcggtgaccgcggccacggcggcgcgcgtgacaagctgacacggacgaacacgagctgcatgctactgtgtgaagaagcgatcactctcttctctcgaagtctcaagtctgaaattttttttttttcagtggcttgaacagatcaacagtagaagctgacaaccttgttgcttctttgcttcttgctgacctgaatgagccttgtttcttttcagtgatctgaagttctgaacagtgaaattttgttgtgtgttgtctgtggcattgtgcaagttacagattgtgtcagtgagaaacaattgtgtgagtttaattcagatttgtttcttgagatagtgtggaattgcagttattctctgaggtgatattttcagttatggccttgaaaaatttatggaaactgggcctgtttcttttagcatccattcctgcccaaagtgactgaagggttttaatttatgagttgtccatttacaatgtttttttttgttattttcggatcctctttgatgtagtactgcaattcaccataattagactactgttacttgttaccgtaaatgcgatgtgcatatgatttatgatatgtaaaatatattgacaggttttgcactagccttatcctaattgtggtatatcaagatgtatcgcaattctatatacatctcgcgcgttaggttttacactagtcgtatgtctattttagtcattgaagatagtcattattgttcatacatatcagcgatctcgctatgatttagaacatccttatagccatcttttaattaaccacctaagatgtttgctagtatagcacccttatcacctttgctcaacccacaccccctttacaacatcaccacctttcatcacataatgatgtaatgataaaagcacgggcacaaaccataatgcaagatatagagatgagcgcactatgatctaagatagacgataatttcatccaaatgtgaaagactcatgtataagtctggttcgaatgctttatcatactacaataaagaataaataatgtaaccatagctactacgcaagaaaacgtataaggtatatctatgtacctatgtcatggtgcagtctagcattaccataatttatttttcaaatggccggatattatcctgagatctatatatgctagattgatttcaattacccccatataaaaaaatataatttctactacgccctctgtttcatattataaatcttttaacttttttcctagctaatcattgttaaatttgaccaattttttagaaaaatttagcaacatctaaatatatcaaattagttttattaaatcttacattgaatatattttgataatatatttgttttgtattgaaaatactactccctctatttcaggttataagacgttttgactttggttaaagtcaaactaccataagtttgactaactctgtagaaaaaagtagtaatatttacaacaccagtatagtttcattaaatctataattggataaattttcataatatatattatgtcttgggttaaaaatattaatattttttctacaaaattaatcaaacttaaaatagttcgactttgactaaagtcaaaacgtcttataacctaaaatagatggagtactatatttaagaaaaatatggccaaacttaaaaaaatttgcctaggaacaaaagtcaaacgactcatataacatggagcacgaggtaaaacaagagggggctgaaatgtgataagttatttttacagggacaataagctgagttaccccgatgggaggagaggcgagggccgaggggtataaaagcaaattaaaaaaaaaaggaggagaagggggagaggcctcgcgtcgcgtctcccacgtatcgtggtccgcgaaacccgagtggccggagaagccgaggcgaggcgaggcggttgccgtggcgggcgagtgacatcgtcgtcgtcgttgtcgtcgtcgtcgtcgtcgtcgcgcgccccacgaaccctatcggatcgggatcgggatcggagaggagaggagagggtatggacgaagcggcggcggcggaggcggtgcagctgatcgacggcgagggggagttcgcggccgactccgcggagcgcttcatggcggccgcgggcgtcgccggctgcggcctctcctacgccgtcgtctccatcatgggaccccagagcagcggtacgtacggacccatcccatccctcgcgccatgtcgagatcgcctcatcgatcggccgccgcgcgccatgcgtcatgattgggtatcgatcgatccctcgcacggcacctgttcgatcaaatgtttcggcgcgcgcgcagggccgctacgacgctcgtagtatacaaacatcagttttgaataatctttgctttaatttgtttggattggtagtacatcagtacaatacaaatctgcatttgctactagtggagtacttgcatacgtacgtttgtgtttctagcaagttattatggttgcattttttttttcgtctcccaatactgattgatggatgcatgaacgtactctttggctaaggtgtgtgtaaaggagccacttaattgtacacatctttcatcaagctctgcctctgctgacatgaatggatattataacccggcaaaatgaatggatattatagggtgtataagtctcgcataatctgttctccgcaatccacatagatgacagcatctaccgtttttcatttttcttacacgcctacctttcatgcatggaggaaagacccctttgtttttgtcttttctgatacttgactgtgttatactccttccgtttcataatgtaagactttctagcattgcccacatacatatagatgttaatgaatctagacacatacatatgtttagattcattaacatctaaatgaatgttggcaatgctagaaagtcttatattgtgaaacagatgaagtattactcttagcacgcattctttggctaatagtaccctgacactggcctttactacaatgtactattagcttttagctgacatgtgtgctttctgtcaccaatatttgtgagtacatgattaagaaattaattagtacttgtttgatcatcataacataccttttattttgagcaggaaagagtacgttgctgaaccaactctttggaactaattttagggagatggatgcgttcaggggaaggtagtcccgttttgttcctccacatgattataaatattcgtactgtcttatttttattttgttttttgaactagttacttttctttgctaggcagtagtacgtatctttgcttgttcattttcctgttctctgattgctgaactggatctctcacaggaactcatagtcacactattacattttgatttctggtagggaaataccatgatatcactgatattatgcctatgtctttaggagtcaaactaccaaaggtatctggatagcacgatgtgttggtgttgagccgtgtactgttgtgatggatttggagggtactgatggaagagaaagaggagaggtatgcttgcttaacgcgtatacaattcaattcccatgttcaatatatcttctagtgaaccttttggagtggccgtgtgcacttgtagaaagctgttctgtagaaatcggtaactagcccaagatatggtttcacagaacaataaccaaccactgacaattggatttttccctagcccgagatctttaaaagcaaagtttggatttttccctaccccgagatctttaaaagcaaaagttcagttagcattagtatctcctttcctcctgcaatgatttatctgagcaaattaagtttgcaatatttggtttataagtattgcgttttcattgcattgtcattttcttgtcttctgtttatatcttccaattaatgaaaatgagcttaacctgcttggctagctcctatgttttaaaatgtgcctttacatgtattacgagtttaagcaacttgagggatacatgagttgtttcttcagttccttttctgatacctgtgtcttctgccccattttaggacgacactgcatttgagaagcaaagttcgttgtttgctcttgcaatttcagacatagttctaattaacatgtgagttactcaattgttcaactctactactgagctcatattatgaaaattcctcatagccttctaggttgaactttaatatataattcatcaacttcatgactttgtattaccaccatatgtatgtcgataggtggtgccatgatattggccgggaacaagctgccaataagcctcttctaaaaacagtatttcaggtatttatctgttttttcagataacctttgccacagcaatacattcttgatgcatttgtaacatttggacaactgggtttgtaggtcatgatgcgtttgttcagtccccgaaagacaacactattatttgttatacgtgataaaaccagggtttgcctctttgttctttattctttcttgaatatatttactgttatgttttgtgcaagctgtttggaaatataatcattgctccatttacttgggccaatctcagacacatcgttgttttcatgtagactccacttgagcatctagaaccagttctgagggaggatattcaaaaggtgatgccatcatctattgtttccatctttgttacaacatagtttcctttctctagtcctaatattgtcacagatttaatcagatatggaactctgttgataagccagaggcgcacaaagacacccctatcagtgaatttttcaatgtaggttttgtagttccagtattcaatctttgaaacaaagatgaaggttttactgtttatgttaacatggtttgtcaatatgaaggtgcaagtcactgcattgcccagttttgaagaaaaagaagaacaattcagagagcaggtaccttttcacttgtactctaatgaaacagttgtctggggacaacagaacgttttcaaacaaaaatagggaactgaaaattattatttttcaagcaccttacttttacctctgccaggttcaacaacttaggcagagattttcaaattcaattgcaccaggaggtcttgcaggtgatagaagaggagtggttcctgcttcaggatttttgtttagttcacaacagatttggaaagttatacgagagaataaggatcttgacctacctgctcacaaggtacacttatatctccttctgtgcactaaagacttatactgggtcagtattattacacttaccattaaggatttaaaatctataatattgtctgtgcactttagaatacaattgaatatactatgcagaatacaccaatgaatccccactttctgaacgaaaagactaatgccacaccatctgatgtatgctaaaattgtttctttcaaatgcattgtggaaacttttgttgtcaacagtgatcagtaaaatagttaactgcgagtttaaatctgtatgatatacctaggtgaagtaacatcatcaattcagtaagagaaaccactctagcttgtcggttattgatttattttcatttgtttcattatacaaggtaatggttgctacagttcgatgtgatgaaattgcacacgaaaagttttcctgcctaacctcagatgcagtaagaatctcccacttgatctattgacctgtgtacaatttccaggttcattaatttgtttgtgtcattctttaggaatggatggaattggagagtgatgtgcagtcaggtccagtacctggttttggaaaaaaacttggctatattgtggacgtccacatgcaagagtaagcccctgcataatataagttgttgacagctcacagttgtggtttgttcagtgtgattcctattaccttcaatttagcaagcaaacagtataagtaatataaacttggtaacataaatgcatttgatgtttctataaatctaccagtagataggcatatgcatcgcaaacaggaaatgtcttaaaagttctcaaacacttaattatgatatttacggaagaattaatatagagatgttttcctctgtttcgaattgctatttgcaaattctggaagctagaaattggtcccttgttttgtaccaaatccaatattttgtggtgacggtaagtatttgttcatgaataaaattgatacgtgaattatttttaggtatgacaaagaagccatctatttcgatgaagctgttaggacagca

SEQ ID NO: 64658 - DNA, 1523 bp, Oryza sativa
ttcggatccacggatcctatgtctccgttgaggggccacaagaccgggtctatttcaaccatttcctacgagattgcacaaatgcactcctcggtttcactcttgatttcttcccttacagaggcgaaatcgaagtcttcacaaactttctatggcacaccacaaccttgggtgatcaccgacgatgcctagccatctggaaaaccttagtccccaagagtaacaaacacaatcgaagatttacttgctatgaactcgagtgctcaaagtatggagtgaaactcactagctctcaacttctcaatctctcaatccaactctctcctcttctcaaatccctctaacaaagaggcaccacaaaggatggagtgaagctcactagctctcaactcctcactctctcaatccaactctcttcccttctcaaatccccctcacaaagaagcaccacaaaaggatgggaaatggggatggctatttggctttggatgtgtttaatattgcccaagaacagcagcccctcaaaggaggggtgtaggagtttatatacccgagcctctcaaaaactagacattgtaggtcaagactgtaattttcggaagttccgaaaagcattttcggatatgtccgaaaatttacagaagccaatctcagattcgtggccatttttggaatttccaataattttcggatatttccgaaatattttcagaatttctgagaagcacatagtaaaacgactataacttttcgctcgggagtctgtttttgatgatcttggactatatggaaagctcactcagaggactacccaactcaaccaaaaacaaggtccaaaaccactcaaaggatatgttaaagcttaggtttctctcaagagaactacccaactcaaccaaaaacaaggtccaaaaccaatcaaaggatatgttaaagcttaggtttctctcaaggtagtactataataggtcactttgagcaccaagacatatacaaacacctcgatgttgcatccgtcttaatagtacggcattcctaaactcaaatataaataggaagagaattataccaataggaatgccttctttccatctttctttatcttaagggacgccaatgccgaaaccgtttcaccatatattcatcaaatgattgatgaggttacttctagcttcaaatggccttgcacggtccatcatgacaaagccgtcactcgcccttcaccacatgatttggttcttcggcgccaagccccttgcttgcccttcaccgccacatggtccatcgcgaccgagcatcacttgcccttcactgtcttgccatagtagccacttcatatcccatatcttcaatatctccactttgttattcttggtattttaggtgcaatcatatcacttgagtgtcaacaccttttcaatccttggaacctatttttctcattcaattcaatgaaattattagtctcaatgatccggttgtcaacctccacatgttgaccaaccgatcgcatgtataaaagg

SEQ ID NO: 64659 - DNA, 7962 bp, Oryza sativa
ttcctgcaccccacctcctggttcgcagagcggcgggtgcggtcggtctgccgcgcaagccgaatcttcttcagcacatacctgcataaacacacacacaaacctccaacatgatcaaaatggctgaaataacagtgagcttcaagaatgccaaaaaaaaaaggaaagaaagaaaaatgagatgaacaatgtcgagtcaaaagctcacttcttcttctccagcttgtgcctcaccaacaacgccgagccaaacgcccctttcccaatctgctccagcacctcatactgatccatccctttttcctacgagagacgcccccaagaaaccaccgcgaagatccaagaactcgcttccccccacccaaactcccgatcagcaaaggatcgatctttgggcccccgcgccgacgccttcacgcgcgcagatctcgccgcatttgatcggaggagagccaaggcaggggcaccgagaagagaagaacacgagccgcgaaattgaaagccgcagcgagggaagaacgaaaatgaaaagaaaagaaaaaaaagatggggtttttggtggggttcaatcaaactcgcttactcccctcagctttatatagcctccaaaaagccaaagcaaatgaggagcaagaagaagaggccaagctcctcaagctcctcgaggagagagaaagcaagagcaatgctagagagagagagagagatggtgatggcactgaagagagagagagggaggaggaggaggaagaagaagaagagtgagagatgactgaggagagagaaagagggggtgtgggccccactggtctagtcaaattagtgctctcttttttttaatttatttttttaaaagaaaatattttgggtcttttaggttgcattgatccaattggtgtttgtgaagagaacaaaaaggaagtcattagtgtgagtatggctacactaatgatatggtaacagtgtgtgattatacaaagtacctacttgtggaggtgtgggtaccactgattttttttttttttgattttttggatgaactgagaggagaaggcatgtgatcagatgagaaatcaaagaacaaatcagtacggagttcgagcctgcttgattttaaaatttggggggtttgattttatgactagttttagagatttcttggtcacttttgttgtccaaatctctttacatgttttcgttgcttgaaaagaaacaccaaaatagcataatttcattaaagacagctactagtttttttccttttctggaaactgattctatttagctagttgaattgtatatgcatttttctcttgacatttttttaacttttttttaaaaaataggacaaaatccgtatcatttgtctatgatgttagggtgattagtgatggggctcacactatacacatttgttttataatgtagccatttctcctgcaactactactaacaccacttgcagcattatactacttcacaattacactatcaaacaaagaagtgaaacattttataatccaactatccaagcagtgttagaggcatctgaaaagaaaaaaaaacacatgtacagaaagcccattggatgtagcctttgtttggcatcttctgaactcaagagaaagttcacagataacagattcattcagatatggtagtagtgtagatggagaggtgcttgctttagctggaacaagttcagaggtgactttgggtcattgttcattttgctagggtccacacgtcagtcactcaaagtcaggtgatgttaccgcggaggattcgcttcgtgctttagctagatagaattagatttttgaagcaaatcaaatcaaattgctcagttcctttcatcctttaatttcttgctttctttctttcatgtgtgctgcttctgcgatctctgcttttggctgcatgccatggctcctttctctctgcctgacaccagagcattttgtgcaaagcaatgttccatccattccatatatcttcttttgacacgcctgcaatgctgcttggtaaagcagatcgatcacattgatgtttattgcaacagaaattgttatgctctttgatcagttgctctcaatgtttagttagtacatgcattgcattttacaatcactgtccatttggttggttaagtcaccatcaacctaggaaagcacctaatgtacccatccctccttttccatgcatcaaaagtataggcaaattaaacaaaacactttcatgcttaccaaattgtatgggatataactagtgggaatcatggatgaagcttaattatctgaagcaaagaatagcattcaagaatctcatcattattgtttctctaatttagttgctttaatgtgtcctatgtaagccatttattctgctattttggttctctctgtattatttgaaccctataaacacctccagatttattgcctgtttgaaacatagaaaatttcacctagagttttgccttatgtttgcttattagcttatcagccgtaagttaaaatttgaattttaaaagttagttttggattcgattcatagttatttcatcatagcttattttttagcattggttttaaatgttaataacacagcttatttaaaaaaatagtgaaaaaataaataaaacaacccaaaaaaaatttatgggtaatattttttaagtaaaagttttaagaaaaaactcaaatgaattattgatacgatttgtgaaacacaagtaaagcaaataaaaccgtattattaagatatgtatatatcgtgtgatgtactgaacgtgtgtacgtgcacgagatgaaaattaaaaatccgacaggtaccgaactgggtctcacatggagggaacagtggaatccaatgcgtctatatatatgtgccaattaaattgaatataaaagtagaattagatgcatctaataatgatatgtgatagatgtggcagcatgagaaagtgacccatacttaacccctactattactatactttgagttggatctaatcctagcatgtaaaaatatcactctagcaaaaataaagaaattcagaatgtcaactcactcgagtctgatccaattgattgttagttttgctcttaaggtatgctcctatatacgtgcattttgcatctacacccttcttgaaatacacgttttttcatagtggtagtaagtagatgttcccagtgaaaatttgattgtgataatttcttatttgcccctgcaaaatacacacgatcaatcatttatttactcatgacgagtcactgacattgggtcctagatccatatgtcattgagagaatgagaggaaaataagggatcgggttaattgtagaggcaaataatgattttatccaaatttaattgatccactacattgaaattgagggtacagttacaaataaggcctctaactttttttcccttttgctttatctgcttctaaaaagagccagaaatattcctgattccattgccatgcagttccatcacaagctttttgtttgacagtttgactgcatctcctatcaacctttttgccttcgctttgtttggcaaacgggataacgtacagtctccttgatgcaaaaaaaaaaaaagaaagaaaaaaaagaaaaaaaaagaagaagaagcatgcctaggtgactggcatgtgggtcccaccccaagcttctaaacactgttgcttcgctatgcatgattccaaaagcactaatgcaaaacagtgagcatgcaattgagtagcaagaactaaaagatatatggtcggtacactgaagaaaaacaaaccttcaaaaggataacaatgtctctgtttcttgcaaagaagaaaaaagggtgctgatcatgatgttaacttcctactactgttgacttagaatctcaattatgtccaagatatcactctagctagcttttttttaaaaaaaaacaaatcctgaattgtggtgtaatattataggatgggtgtattaataattagctaattcatttaacaaaatatttagaattttatctccctatatacctcaacatttcttttccaaaaagctaaattgttaaataacagaatgatggaatgatttagcgatctctattcaagagcaaaaaggaataaattaagtacataatataaactttaaaaataaatttataactttttaaaagaaattcagaaatgaaaaacttttgcgaaaaccacaacgttaaggagctcaggcccattgatccatttctccattcctttagatagaacaaagaaatatacaggctggagctcgattccaagaagcaatccagaaatcaggaaaagaaaaaaaaagaaaccaggaaagttaaaaaagaaaagatcaggggaaaagaaaaaaacagaaagcagatcgagaacacgtatacgccatgtcgatgcatgccgtaatttaataactgcagccaaaaggatagaggatagagttgatgtcatgcgtcccttctgaatctccgaatgtgtctgaataagtttttcagcgatgcatcgcgctttttgcttacctgtttctctccaacctctttcttggcgtatcatgcgaagatattgattcaccgtgtttactacttatcataaactagatattaatccaccgtgtttactactcacaacacaacgcgcgaagctttcatctgatagaaatgtatttttgtcaaccctgcaatcttcgctcgacattggcatttgaagcatctaaaatttgttcgcaaatataaataatctagaatacctcttgtccctacaattacctcttattaaaatttcttcccatctttactacttatcaccctctcacctcatccatcgatccctcatttatcgaaggccaccgattttttttctcttagcgttaattcaggttgaacaaacataaaaatgcatatttataaacggagagagcatatatatatatatatgtcagcgccatgcaatgtcaaggaatgcactgctgcaactgcaaacaagccttgtattttttttttatatagccatttaaattggaaacttagtcccacgaacatgccaatctaaaatttcgctcgtatgaagatttaaaatcaaaaccttaagatgctactgaggtcactgcaactactaaactatacaccctttggcaagcatgccattgcaagcctggatcgagtcagactcaggggatgcatacgccattgcaatttcgattgcgattgacgtactgtttgaagagagaagactgaaacggagccatctccgccattactgcggcgaaagcagcagcttcgtcatgcagagatgcaggggcatacgtgacggccattaatacaaggagatgaaggtcacatgctccttgctccccttcgccagtctcgccggaactgacggcctcgacggcgaccggccggagcggcggagccattcatgctgctgtacctgctgcatttgcatgcgcatccctctctacagtctacacacgtgttgctacatctggtctaaggagaagatagaagaagatcgaatacgtaaaatgagataagtcatcagcacggaattagttaagtattaattatcttaaatttaaaaataaattaatatgattttctttagaaaaacatactatcttcgtcccaaaaaaaagtgcaaccgtggatatccatgtccaacatttgatcgttcgttttatttgaaaaatttataaaatttttttaaaaatattagccatacataaagtgctatttatgttttatcatgtactagtaacaatattaatcgtaaaagtttttctaataagacgaacggttaaacattgaacatgaaccgtgtaaaactacacttattttgagacggagagagtaccatttcgcagtccaccagggagtgcgcatgcggagaacgagtttttctcccaatccccatgacttgaaacaagcaaaatgagcatactacatcatagatgctagtagctagcaaaatgagcaccaataaaagacgcagtaagcatgaatattgttactagtagctagccatccaaagtggatgaagcagatactagcaattgaaattctatgggtaggcttctctaataaaacaaatgaatctcttccctcccgatcagaaatggagccaactgattttgaacattgttttgtttgattcatgtgatgtagtacctgcaacttatctccttgttttgttggtatgcacgtacagtacggtgcttttgtactgtattttagttggttgagaaaatgtgatcggataaagttggggaaaaaaagatgggaatggagatgctatgagtcacgaattaattgtatctgttctcaaccgatgcaggcatagctgtgtacttcgtacaattgtacatcacatttgtcagactgcagagctactgatggtgatacatcacatgccatagtttctagggcatcgccatcaattcatcgtccatatgtactccagatgccagaagtcatcaggtcattttaaaaaaaaatactatgtgcaacctatacaagcacaattttcttatgctccataatagtggtaaaagatgtggtcacagttgatcacaggaatgtagaatatggtgtctaaattttgaggaatcaaaatctgcatttcacaaacccagacaaaagcttgtatacaatggaaattgcaccacttaaggcatatataattaaaaaaccagatcagcaaaatttgtgtgcctcggtgtacaatacagatcaacagcttacaaaatctggcatgcaaatctaagctctcaccacgctatgaaaaatatcccctttgcaactgtaagctaggaaagaatatgaccacaacaggggaagaatttgggagccattcactgtccatttgttgtttattcaagccgtttctttgaatatacggggaagcacttcgtggatgctaatgtccaggagctcaggactcctgcagaaatattaaagaagagatatagtacactatataaaagctggagacacccacaagaggagggaatagacattgatggttatctaacaggtcgggaaagcaaaccctaagtcatgaatgaatggtgcaaagtttatagctgtacaacaggtacaacataggtcacaaaaagtgctgagcaccacaagatggcgcaaaaagctggaacatagatcaattatatcctaacaaaattcatagcaggagaaacatgccagcacaatgcaaaggttttctatttatgtttactactaattccttgagaaattgaattcctcaaagtaaaatatggaaatgcagatataataattttgtctcatgaagaaagggataagtacctgcataatactcgtcccttttcagttgtgctagggacaaaccatatcttccgcagaattggtgactcaaattgcacaaagaaaccatcactctggtcaagcttccattttcttgatccctgtcctttccagacctgtatataacaagatcattgttagtctatcattttcattctagcaccaaaaaaggaaatcttatgcgctgatttaacatgaacaaaagaaaatatattagagccaagcatgcagcaacacaacatcagaaaatgataggcacaaatcatacagggcatggtgacacatgaaagaggggagagggtgatttgacctgagggtacgagatggcgctcttaggtgctaccatacaagcagcctttgagaaagactcctcggaatattgccgcaaaaatgtgaagcaactgctgtgagtgtggggtgagtcaaaggcctagtaaaaaaagaaaccagataggtgttaataggagacaatgtcatggattcagaatagaagccgtaacagaaaattgaagatttacatatgtaaaaaataactagatcctaattctgttaaagaaattgactattataaatttcaagatgtctgcctatttatgaattgtt

SEQ ID NO: 64660 - DNA, 16175 bp, Oryza sativa
caataaaacaataaaatatgaaggtgaagatcattatatcgagcaagaaatgtcaaatgtcaaagtacatatgcccaacctgaagaagctatagtacaccctacccaacttaatctaatctgtagaactgtagatcgattccaaatctaattaaaaaaagcaaacccattccattcccatgcatcaactaattaaagattgctagaaggagagaatatatgcaagaagttgggcgatttgggatcgatgccgccaccaagaaaaaaaatatatatttgaagcatcagagaagtgattaaaacagcaagtgaacacacaagcaaacgatgtataaaatggcatggaggagacgaggatcagtgctatacctctagctccgacgagaggccggtgcggcggcgagacgacggcgatgatctccacctccacctcgtcgtcgtcgtcgccgtcgtcgtcttcctcatccaccatcatgctgaacctgaggaactcctcctcgaactcacggccgtcgtactcgtcgtcgtcgtcctcctcctcctcattgtactccacctccttcccggggcggtggccgcgcggcggcgccatctccaccgccaccaccgacggcggcggcggcggcaggtcggcggcgacggtgatggcgtggtgattgtcggggcctcctccacacatggctggaattaatggatcgattggattctccaatgccggatggagatgttgcagcagcagcagcagcaacagtaacagtggaggtagctagctagctgaaaaaagcaagagagctcactctctctgtctggcctctgccgactcaagtgaagaagagacgagacaatgtcaataaataataatggaccaaagcaagcaaggcaaagcttcaccgtcacagctgcagattcacaagagggacacgtgatagagacacgtacggtgtgtgtggagtagcaagttgtaagcctattttctctgttctaaaatctatctaaaatatcaaatcacatcatatatatacacgacgactaagggtgtgtttagttcatgtcaaaattaaaagtttggttgaaattacaacgatgtaacgaaaaagttgaaagtttacgtgtgtagaaaagtttcgatgtgatggaaaagttggaagtttgaaaaaaaattttggaacaaaactcggcctaagatgcatcagatcccatttagatagtgatattttgagacgaaggtatcattacctaatagtagcgctactatagtattcccttcgttagaaaaaaaggaaaaacttagcctatgataaatgtgatcaatctcttttagtacaataaatctagacagataattgttcagatttgttatactagaaatagtcacatcatctagtttgagttttttttggacgaaagaagtatgtagaggagagaggagagtcttgagatgaaaagtgtgctatagatttatagccatttacagtacagggctctaatatattatacgtctgagagataaatcaaatattaatggagtagtatatatttatattaaactattatgtagatagtcgctctaaatattatgttagtttttagagttatttttagttaactactttcttcgtttgaaaataaattaatttataagggatatgataaattataatatatactactattaattaaatttgctctagtgcaagcagcaacgagccaacgcagcagcagtagcagcacagggcggaggcaacagaccagacggcacacatggctcaacttgatttgggggctcgcgcacgcacacacccctgcacactgttaagagcacccgtaatggttatctatatgctctctacaagagatccatgtcatcatattttcctacttggaagagattaaatgaagagagagagtaaaactatctactaacttagagatagtctatagagaaaaacgaggcaatggatgagagagctattgatacccatgtagacatactattgaggtgatttactattaatctaatctattgctgagatgtacatgttttatagagagcaccttactttaccattgcgggtgctctaatatcagctttaccttctactacctccattttttttaagtgtagttacacggctttcggttaaacgttagatataaaaattcactactatattttaaaatgagacgaagggagtactgacaataacaataagtaacctagctgtagctttatagcttgctttgccatgtgcggccaaaaccctgggcgcactcaggcaggcaggaccaacagtccaaggtccctattaatatagcactagttcggtatgaattatcatgctttaatatatatgtagtaactgttatccatattaattgtcatgctttaatatagtactagttcgatatgaaactaacttgagtgagattaatgacgtgtagattgtggtgccagtattattataattttgctcacataatagcatatatatatatatacacgttaaaataaaataaaatgataacataattttaaactctgatctaactcgatccaattgaccgattcctggtactttgtaattcatatcttcataaaaccaacgtattagatcgtttaacactagatctctcttcgtaaagtcggtattgaaagccatacggaattaacacggtagcctatcatctatattatcacctatcatatagagcttgcttgctttcaagctaatttttcactgccaaaaccttgacaaattttgacaataccaaatttgttataatagaatttgtacttgtgtgtataaaatttaacatcaaaccaaacatccatacaatactaatggagttgtcaaaaaaattaaatataattcaatgaggataaatcatcttgtgattgagcaatgtcttcagcctggtggagatcagagaggagacgtgcgatgacggcggacctcgggaggatagaaggggtagcagcggaggtcggggaggagaggaataagtggcggatgtcgaagaagagggagagtagcagcggaggttggagaggagggggagtagcgatggaggtcgggtaggagacacatgatggtggtaagcctcgaagtggatggaaggggcagtagcaatccaaatccacccgcccaaccatcctaatcttcttccctcttctcctatatattctatctgactacctccttcccctttcttgaagggtgacgctgatggtcccgatgaagaaggtagcagtgtcagcagcaccattggtggccttgtggaaggttgatatatggagctggactcaacaatagcacgattccatcggccatgcggcatgtggggaagaaggggaatggttgacggcagcaataagtagaggtggacctagaggttggttgttgcctcttcatccttgaccaatcgtcttgcaccatcgccaaccagatatttgctcccccaccccctcccttgacttagctatgttgaagaaatgtgggtgaggttgtcagatgtgcctcatttacacataggtttaaaaatagatttaattgtcacgttggatgccatctaatcgaaacagtacgtaatgtataggaatagaggggattattcgtccggtttgaaaagtttggacctatttagattactgtaaaatgaacctttccaaaatttgggaacgctaaaattttaccatgttgacagtattaccaagctttggtaggacaaactaaatatgatgttatcaaaatttcctaaacactaccaatgtttggtaacaaactaaaagcatctacatgcttatcaattttaccaaatatgatacggtttaaattggtatcaatctgaacgggtccttcagagtagtttgtagtttagtagcttaattcggatgatcgcagtagttaagggtaaatttagacatttcccttaattaaattgaaccatatatatgagatttactttgttgtgtttgtctctgtttcctcgacagaaggtacgtacggttgatgcagcaacagcagcagctgctggcgcggcacgtgacattaatctgcacccatcgtgattaacaacctgttgatccgtacatctccctttctgtcccaatcgtacacacagtaattaattaagcacactgcaagttgtacaagtggccatcaaagggaaatgacccgtgaagggcacctcgccaaaaaacaggaatcgatactgtaaacaacgaccctgcccagctggcctgtctgtacatactatatattcagagatttcatcagactatcaagctagccagtgtgccacacaagttacattgtacccccccccccccccatcgtccttgtgtgtatctgtgttcaatggtttatcgttcatcttattttaaattttttttataattaatgtttttattattattagataataaaatatgaatagtattttatgtgtgatttattttttttataaatttttcgattaagacggacaatctaattaatgttggacgcaaaaactcgtaaatgaatttattttgggaagaagggtgtattgtacatagtacagtactccgtactatgttaagatcaagttgagggtagatgtgaggatgagcatgaatctttttgcacgaccctacacgcatatatggatgatcgatcttatctatagctagttttgcacactggaatgaaacgatcgactaatactgccgctggttttgaacggttggcgtgcaaaccaggaacgaatttcaggggccgtttgatgcatgccaaccacacacgtttgccacaccttaacaagtaaaaatcacattactcacgatttgagtaggaaccgggactaaagaatatctttagtcctggttcaaaagcccgtgggtactttttgatctaaccgggactaaagatcatttttagtcccgattgaaaaagttattagggtgtgtcaggccccaaccggttaagcagtatactttttcataaaaaaatatatattactttaaaaatcatattaatcgatttttaaagtttctagcatcagtatgttttgcgtgcggggaaaaaagtttccaaataccctcacacttataaacgagtacacacatcctacccctacggacatttccgaaaatctggactggattattttgatattgataaagtcattaccaccgtctcgcagtccagacctcgagggtacgtcatcttcaataaaaaagataattagcagtaaatgtaagcactcgtcctcatgatagatcacctcagatcgagagagatgatagacacgtggggacagtagagtcagtactaatagcccgctctgtcagcccagataaaaaggaaaggtgaaaaaatcgtggagagatcaatcaatgagtaatacgattacagtgccccttactttgtgggtggctcgcccggaaggccaagagccaaggcccggaaatagacagactatatgcagagcgtgctggcaggacagcacaaggccacaagctagtggagtactactagtagtacgtccttgctctcgacaaactgggcatttaactaatactacctgtttattttttactcatttcacacattaaacataatagaaaaatcagaatacccctactttatcaaattttgaggaaactatgttttacttaatcgtctcgttaacatgaaataatatttttagatatgtagcatgtcttattaaaaaaataaaatttgattgaaacctgtttcctacgaatatatattcacctatcaaggttgaaatcctacttcctacgaatattatgcacacacatgtataagcttttaatatgactttagtaagatcagaaatgtatcactggtttttgtctttttaaacgtatgttactgagcatattcataagaaaaaattcatggacaagataacgaacaaaagtagtcatagttcttttcgtgcagggcttagcaggatgagaatcctaataataataatgatcacaatttcaatcgcaaaattgtgcgagagcaccgtagttgtccttcctagcccctcatttattttgtgctgatcaatcttttttcatccctcagtacgtcttcaagttgaccaagcttgcaagtttgtgggggctaatacactacacatgcatttatataatccaacaacaatcaagatatacatatatattctttacttccaatgatcatacttgtctccggtgatcgtatgattgatatatcgagttcgagacacaaaaatcatgaaacattaatctaacatggaatcaagttgatttgcatatatagtccatatatatcactaattaatactacttggtactagtagtaattaattaatctggataataatggcagcaaatatatacaccgtgtttagttgcaaacttttttttcaaactttcaacttttccattacattaaaactttcctacacaaataaatttccaacttgtccgtcagatcgtttcaatttcaaccaaactttcaattttagcgtgacctaaacacacccatagtttagttttcgataatggcgatcttgcacgtaattaacttgctcgatcgatcagaagctccagagatcatcgccgacgtgctcctgcccgtcgccgccgccgagcaggagctagcatctcctggatgatctcaggagcaggagctaacattattcagaagccaaattggatttgggcgttttggctaacaattaatgggcccctggtgaatctgagacggtaaactgtgtgagctagctagctgcattttgataaggaacatatatataggaaaactagctgctgcggtcggtataagtaaaaggaaaattggctagcacttaattggctgaactcagattatttatgatttgtattaggtatatattaactaattatatactacaatttctgttgtacagctagaatgccggttagttttttttttcataagagataaggagaattgccatacaatgtcggtttgaatttttcttttctttatatttttcttcaaacatagggaggatatgatggttacaataaatatctctgtttggatgactctataaaagggcttggaatacaatcttggatatgcatgaatttacatagtagtgtacgtgtatcctttataactcagagctagctcatgagatgagatcaataagaatgcaacttatcctccatagaacttcttgtgaaaataaaataccacttcctatctttcatattaaaagttgtttatataaaaatattgtaagattttcaatacaaaacaatcatattatcaaaatatattcaatgttaaatttaatgaaattaatttggtgttacagatgatgctaattttttttataaacttatcaaaccaaaaaaaatttaactaagaaaaaaatcaaacaactataaaaaaaattagaaacggattggagttctacacttctactagctatctcattgggaatgaagaagtacaatattccatgcgtggaatagatctatcaaattaaaatgttaatagtaattcactttgcgtttctaatggaactttcaagctgcaataaaatatggaggtgaagagatcctagttacaaatgtcaatgctagctagcatgcccatcctcaagtgtgtgtgtatcccaacttaatctaatgtgtagtagaaaggagagaatggccgatttgggagagaatttttttttaaggatgatcagaagaaaacgcatgcagaagaacctttaactccgatgaggccggcgcggcggcgagacggtgatgagacctcgtcgtcgtcgtcgtccatcgatcatgctcacggtggtcgtcgtcctctttcccgggacggcggccgtgtgccatcaacgcggcggcggcggcggcggcgacggggccggtggtggttgtcgggccggggcttcttccacacatctttcgatggatggagaggtcgtcgtcgtcgcagcggcagcggcagcagcagtgacagtactggaggtagctagctactctactgtctactctatggcctctgaagagggaggaggaagcaatatacagtactacctccgtccttttaagtttttatttatcaatatttgatcattcgtcttatttaaacaattttagaattattatttattttgtttgtcatttgctttattatcaaaaatactttacatataacttatcttttttttatatttgcactaatttttcaaataaaacgaatggtcaaatgttgtaaataaaaagtcaaaaacatcacttattatgagacttggagggagtactaaattaatggtgaccctaattaggagtagagaacaagggtcttgtttagtttcaaactttttttttaacttttaactttttcatcacattaaaatttttctacacataaattttcaatttttccgtcacattattctaatttcaactaaaattttaattttgacgtaaactaaatacgcctaaggaaaaccaatggatcgatgaaaagcttttgcttcacacaggcgccctagccacagctgcagcttcacaagaggggacacgtatacagagaggggagtagctaccagcagcagcagtatccgtggacacggacacggattggaccaaatcgacaagacgacacacaacacgcggctgatcatcttgatttgggacctgcactgctactgctgctagctttacccccatttctctcacctgcgagggcagtaacaacaatagttccaaacatttttgtttgaactttcaacttttacatcacatcaaaattttcctacacacgtaagcttaaaaaacaaaacaaactctctctttttcttctgctgccgaacgtagcctaagagattatgcagattgttaccaaaataaatcttactaaattttatcaatttagtaatattatcaagttttttatgatttctaacgtatttactgaagtttagtaaaaaaaactaaatggatacgcatcttgatcactttatctaaaaaaaaatggtaggatttgaaatgacatcagtctaaacaatctccctaagtatcctagctagcttaaggttgagtttaggagtgagggttgggaataccttcactcccgacatgcaaaacggagcaacggttagtgcatgatttattaagtattagctaaaataaacttgataaatggattaatatattttttaaagcaacttttctataattttttttaaaaaaatatgtaccgtttaatagtttataaaacgtgagttagaaaaggtgtgggaaaaacacaacctaagtttagccagtgccattgccatttccgcccaagaaacccttgggcgcacgcaggaccgccaaagtccaaggtaagtagtcccatccatctctcttattcactagcagtacattacaacctttaatttttaatagatgacgtcattaatatatgaaccatatttatttatttgtcttatttaaaatttatgtaaatgtataagatataaatcatatctaaaaaacttttaagtgataaaacaactcacaacaaaataaattattattaaaatattaaataaaagataaatatgtgataaaaaaatcaacggtgtcatatattaaaaaacatagatagtacatcagaaattacaatccatgcttaactataattacttgagtcggtacaatacctctacatcagccgggtataagggtattatgttacacatcaagtttgttctgagttggttccaaataaattatatgagagagcaaaattagaatccactagcaagttctagacttctagtacgttaaaatccgaagaatcatttgtttagctatgcgggtctaggtctgtgatccctcacatgattttgtcagcttgcgtagccgacaactaatctatggagtacattattactttctcttaattatgtacacttaataatatcatggttacaattgtcagacacaccaaaattaaatatggtccctctcggagcttgcaatattgggaagcatattcctttagcttagctagctagggcataatgctattcgatcgattttttcagtggcaagcagatatcaatcgttttgctagacttgctcggctgagctggagcttctctgccagttaatctctttgatgctgttaactttgataccatttttaaccttaccaaattttaataaagttgctaaaaaagtggttacatttagtttgctgctaaattttggtaactatataggaaatcctgccaaaattttggtaagttgccaaaattttgacaactatattaaaattttggcaatgctaaaatttgataaggttttttttatcaaagtgaacaggagctgagattttactgaccctagtagctgcgcagtaaccatagctagctacagctaatccgagcaaagggtagtaatatttcgattatttattaattgatttaattctctcaatttgaactcatcaaccccacatgtacatatattgagcttagcttcttatatatgttgattatgcgcagtttactgttgttgccgttgtcattgcacctccctccatatttagcatcgggattctctataatactgttcactaacatgtggacatgaggatctataagacccacatatcagtgagtgtgtgcagtacggcagaggaattgcttcccatcgcttagcttcactgccagcaagttcatgggcctttttcacaacctaaaatactccttaatttatcctaaaatgtactgcccatactatcccatattctccaatccggatttatatcttacctttcctgataaggcaaacaagtctttctacatttctctccttaattaataaccatgtcattttctaaaaattgttagtactgcatcttagtatggagggagtagattgatgagccttcatgtttcaagctataatgttccaccaccaatatatcaaaagtgtgagcctaaaccaacaacataaatttcctcgttaccattagccacgtatcacataattatgtgatcttgaagatattttaaatttcaagagaccattcaaactgtataacacctgctatcttgatcagccttataatataatactagctagatgaaggcagtttaacatttggtggcagtttaacatttggaatttgttctaaaatataattaacttattcaccagcattctctttctaacctacgattcaatttctgcacttaccttcccttctcaactaaccacaatatttactatgtaattttatctacctttttaattaataactaggacggaggtactatatatattagccaaacaataggcagctaaattatacacgttgtactattaattatgtcaagacttaggaataatatatacttagtataatttaatttaatcacatgagatttgtatatactcctagtataagtttggttgttttctgtcgctgttgcagaacagaacgtacgtacggctgctgcatctgcatgtgacaattcatctgcaccactcgtgttaatcccagtcatgtcctttcctctgccccaatcgtacactaattgaccatagtaccacaagttgtgcaagtggccactaaaggtaatgacccagcgaattgaagctcacctcgccaaaaacagaaattaatataaacaacgaccctgctggcctgctctgttccgtaccccgtcgcctgtaacaaaattacttaggctgtgtttaattcacatcaaaatttgaagtttggctgaaattgaaacaatgtgatggaaaagttagaagtttatgtgtgtaggaaaattttgatgtgatgaaaaaattagaagtttaaagaattattttggaactaaacacggcgttagcctagtactcctatcctaacatactacatactatacgatcttttagtgtgtgtttagttcacgttaaaattggaagtttggttgaaattggaacgatgtgacggaaaagttggaagtttatgtgtgtaggaaagttttgatgtgattaaaaagttggaagtttaaagaaaaaatttagaactaaactcggccttatattataatgctatgaatctaatatccagattcatagtatcaagatatgtcatatccgatactattaagttattttggaacgaagaaggtatgtatatttttctgattcaatgatattcagggggtgtctagatacagaggtgtaaagttttagcgtgtcacatcaggtattatatagggtgtcgcatggggtgttcggcactaataaaaaaactaattacagaatccgtcagtaaaccgcgagacgaacttattaagaataattaatccatcattagcaaatgtttactgtagcaccacattgttaaatcatgaagcaattcgtctcgcaaattagtcgtaatatgttcaattagtttttttttagcctatatttaatactttatataggtgttcaataaagttttaggatgggatgtaaacatgtaatcaattttataaataaattaagcaccatccatcaggctactccagctatatatagctagggcacacaagttgcattgtacggtaatactgtatactgacttacagccgaagtagtatgatgaggatgagcatgaatctgcagctagtaaattttgcacactggaaaacgactgctgccctggtttttgcacgattcaattttgtatgaccatgatcggggaaggtgacgctgtgacaagcatatatgcacatatattcactgctagtctgtagtagatataatagggctgtgtttagtttacgttaaaattaaaactggaacgatgtgacgtaaaagttgaaagtttatgttagtaggaaagtttgatgtgatggaaaaagttggaagtttaaagaaaaaattaggatctaaacacggtgtaggtagatgattttgtaaatttcaagctcttattactagttagtatattatatctttattattactttcattattactttcgttttggttgccgattattacacgatgttcgtcataacgacgtttaattagcagctgacgccctagctagctgcaggccttgttttgactttctcatcccacagcccggcccaaatagttctgatcctctcagatgggcctgtcaatagcagagaatttggcccatgagatttctctttcttttttctgcggggacggcccatgatatttaacacgtgtggttactgggccggactatgtattcagaagaggaccatttttctttttttttttgcgcaagaaattattttgtaccccattctgccaatttaactctgcattgaaactttgtccatccgagttcaagtcctagactcagctcacgtgctagcatgtgccaggacttgtcctcgttgtactatctttatgaataaaaagggacatttttttttcagaaaataatgtacccttcatttgtttcccccttttattatgtaaattaaatggtggtgcaaaagaatcttcatgcagataccatatgctgcttatatttattcagatatcagggggacttgtagcagcagctgaaagcctgaaagtgatcatatccatgatgtgtgtggaactgttcttgagtgacgacgacatgttgtcgctgcactttttggagcatagtggagataacatattcttctgtacttccaatgaggagaaaggaggatggtcaagttgataaactagtttaatataatgcaagagattatggtttcagatctaggatatctcatgctctggatctttcctggattgttggcactttcttcaaccacaatatgatcccttgataagcacaaatctctgttagatatatgtctaggaagttgatatgttcatcacttatccaatctttgtctttgttggagtatatgtagtatatccctattgtcatatgctactccctcgtttactgtgggcacactttttgaaccgttacactgtgtttttttaaaaattctctatataaaagttttgttaaaaaatcaataatttttttgagtttataatagttaatatttaattaaatggtgcactagcggtcccgtgcctaagtcaaatagtgtgctttcgttttcacctttttactgatcaatgaggttagagttcagaatggccagcttggttcagaaaacgagcctttataatgtcatgaaccaattaggagatgggctgaatttataggctacctgttttggcagtactaccggtttgtttcttagctggttttcaggtcaaatcacagtttaatttgccataactatttccaagttgcatctcctatgagttaaatctttggcaacttgtggcatcttgaaaatttaataagtaaaggtcactttgattttatttaggagagctatcatgacatgacatgtatatatgtgtgttcttgttcattaatgggtgttattgacagcagttaacgttgggtttcagattgtgaactgatcaacactctttgagcttcaaagtgtccatgtaacttctctatgcttttccagaggaaacttgcaattagctttagtataactaacaatttgcagttattaatgggtggatacaaaatagtactctgttatcttcacaacactttccaggaaataatggttttttttcttgtcagttcctgcaattggctgtatcatgtattttgcttgattaccagttgatgtggttgttaacatctgtagtcacactcatagtatgtcatgaactcaaggtgccaaggaacctgtcatttcagacccctgaaccaacggctgccatgaactctacctcacaaccttcactctcaccttattcaggatatcgatcaaatcattcagaaaatcagtcaacagaaagcttcattacattacatggaaaaaactgaactcatacatacatggaaagtgaccctcttataatttctctcctcacatacataaaattagtcttattcaaggtcattaattaacagactagtgtttcaaatgctaggatcaaaaagggaaatatgctcgtccttgatgcatgagcatttcctgtggtgtagtgctgaaacaagtccagacatgacatcccaattgattgagtgatccatctgagtctgaaatctgaacaaccattttatgtagtaacagaaggccacaagtgagccaaacatgtcagtgtattttggagtgtcttcatgctctaaatttaactcacttcattggtacatgaacatgtcagttaacaatagcagatactcatactacttggactgtgactgcagcttgtcttcttgttgaaaaggaaggaaaggattagttgcaggatagcaggtgatcaacaattagcttaagctctaccttttcagcccaatatgggagccagcttgatcaaacccaacatctaatgcccttgtttaagtagggtttgttatcaacttatcataatctcttcttggagaggttatagaatgataaaggcatccatgcagtgatggtggcacctgaactttaagccgagctttttcagaatgagagtaggcacacattttcaatatcacacaattcatccttgaattgatggtgacatagtgttactgttcatgtactgaacagagcaagatagtctctgaattgttaatacagaacagagcaagaatatactatcttttgttagaataattgggctaggcccaactataacattaaatctcaaaggcccataataagtgttgaggataataataccacctcaggatttaagcgagaaatatctcaacctaaataaggagttattggaggctccctgttgaccagttgaggtaggggtcggaatgccacacgcgcgcgcgccgggccgggcgtgggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgtcttcttcgcttctttcccggtgttagtttcttcttctccgcgtctgagttgctctcgcttcctcgcttctgatctcttgcgcgcacgaaagattggaaagatcaatgccttcgaaaccacacccttagctgaaatctgcaccgggtaggcggg

SEQ ID NO: 64661 - DNA, 1712 bp, Oryza sativa
aagtaatccagtgcatctagcatgaaccaatgcccttttgataacgaagaataaatctgaccaatgaaatccaaagccctacctcggtacggtcatggttccatatgcgcctactaaacatttccaatccgttgacgagcttcacttcctctgtagcacttgaaataatcatcaattactttcggccaatagaattccactcttataagcaaccaatgcatcttatgggccgattaatgaattccacaaatcccttcatgcacatctcccctagcaactttagattaatcattgtctaaacacatcaatagcattccatctatatttcagcgatataatatttgaacgcttgccgccgaatcttccggtcaaccccaagactaggatctttcaaatattctattcaaagggattctccaatctatttctgacttatgggcacaaatgtccgaattcacaattaatccggtctttaaatcaattgtaacgtgccccccagctctctacccgggatcggtcagaccggacacacaatgccggtcagacctccctgtctatccggtcggaccggccatgcagagccggtcagaccgccggtcatcaccggtcagaccggccatgcaatgctggtcagaccgcccctggtccgtgatttggccaatttcatccaaagacttaaaaatcaagcaccgacttttctagtaaaaaatactcctttcttcatattataactagatgcttggtgtatcaaactattggaccaaaatccatcctctctagacatatgaaaaaattataacatccaactaacatgtctagatgaatactaattcaaatggcttttgaaacaataatcatcatggcatcaaaacacttagccaattgaagtatgatcaataatgaatcaccaaagtcatatgtgtcacatgcatagattccaataaactacaaatgtaagtaatcggcttgagtatgtatgtaaaatattaacaatgccaatgttcctaaatacaataactctaggacaaatcatcacattgaccattgacactagccgaattactaataagcaaaactttcatggtgcaataaatatgaaatctatatattatatggtgatccataaaaacacatatgatttggctctaaataaatatcaaagactcatgagccaaatcatactttaaacaaattatatgccaacctaccaattccactacctagaactggcatttgcaacatgtatgtataatatcaatttgataaacaaaaacacacatgtgctagatagcaagcaatgttctaacatggcataggcatataatataacgttgaacacaataaaccaataaacccataccttgccttagcatccaacaaacggcggctcaaagatatgatgttgtatccatcgccgttcatcttctcttggttccctcataagcataataatgtcttgccccccaagcaaaatcagctttctagattgtgcgatttcgaaggcaagacggataccgcactaacacccatagcatcatgtgaaggagacttatctctaatgaccgatgattcttctctcatcaaattggatttacctctactatgggaaatcaccggtctcttaacttttacctctttggatctaaacacttgcctaggtgtcgttcgaggctctaaattataacatgttttgttctccacatcttcggcct

SEQ ID NO: 64662 - DNA, 1064 bp, Oryza sativa
atgaatataatttaaggtttttggtgcaaagttttagtggaagctccccctaagagtgtgcataaaagcaagtggagagctccccctaaattattgcatccacattgaagctcacaagagaataaatatatcacatatgctcatcacatccaacacatcacatgcaaatgaataattacatctcatcacaagcaccatataaagaggataagatattgcaccacattaaagataataggatccattacatcacaagcattcataattaaacaatagacttacaaagctttaaacttaacataaaaaacacaaaaaatatcatacagataaaaaccaaccgtgctcgacgctaaggataagatagataaactaaagctatgatagatattctccccctttggcagcaagacaccaaaaagagaggacgatgagctgacgactcaagcgaagggcgcctgaggaggatcctcgggaggtggtggaggaggatagccatagccatggccatatccaaagaagtcgaagtcggaaggcaacccggcaaaaggatcctcaatctcttcatcctccggctcatcgggctcggcctcgaaacccggaggagaaggagggatatcaatgtggtggtcctcataataccgtgcctttaggaacttgacatcacgagccgtcttcttcgccgaattccgcaatcagcggttctttttggcctcctcggagcaaagaccaaaaagactccgcaaaatgcggaataagggagacggctcacgacgagccacagaggcagggcgctcaggagcaggaggcggctgggtagaagaggagggtatgtcccgagcagctgaggagcagggggccttaagaaggcgcaagtgaagctgagaatgagtcacatcatggcgaaactggagctgagtcacagtctcgatcatccgcataatgtgaggggcatagaccaaccccttcttgtactgaattgaagccatgcggatctcctcccacacaaagtgatagacatggaagcgatgaggagggggatcaaaccggagaagcacggtcctaga

SEQ ID NO: 64663 - DNA, 1245 bp, Oryza sativa
aggtttcacccccgtccccagcgggcaacgggcagtcccctctcgtgcctaggtgaatccggaagcgacagaggccgtcgcaaggcccgccccgttccatcacgcccacccttgcctggatgcgtctactagaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaacagtctaaacattaataggattttccccaatgtgaactagctgaactaagcatggctaagcaatccccagtcctaactctaatcatgttagaaccccaagttgacaaagaaacaaggtacaacaatcgcatggctatgacaataggtaaacaacccatagtaacattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggacgaattggaatctatcgacatacaaagcaaacattgtaaacaggctataagactactgaaacagggaacaaaaccatttttaatggattctacacatttatcttgatttactggaacttgaacggtcttaaacggagctcggatgaattaattatgaattttagaagatgcactgcgtttattactataacagaaatccttaaataatttattgcgcaatattttccagggctgacgtcagcacaggggaagcggcgccgacatgcgggccccaccggtcagcggctcagggggggaaagaaagggcggcggcacgcggctcggcttggctcaaggccggccgaccgaccgcggcgacggcgatggcgcgcgcgcgaacgcgttgccggcgacggcaaccggcggcgaaagcgacggcgcaaaaggcgacgcgaaggcggctgcgctaagcggcggctaggaaggggagggaatgggcggcgataaaggccgccgccgactcggctcggcatcaaagccgaccggccggccaagtctagcggcgacggcatgcggccgacgacggcggcgaccggcggcacgggaagcggcggcggtggtc

SEQ ID NO: 64664 - DNA, 1642 bp, Oryza sativa
cttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgataaccgttctgtagtagaacaagctcatgagattcagatgctggctaaagaacttgagaacaacaactgtgagttgccggacaagtttgtggcgggtggcattattgccaaactaccaccttcttggtcggactttgccacttctctaaagcacaagagacaagagttcagtgtttctgatctcattggctctttgggtgttgaggagaaggcgagggcaaaggacgtgcggggcaaaaaggttgagggatgttctagtgccaatatggtacagaagaagaaccctcatgcatcccacaacaacaagaaagtcaagcctgatgtcaaacccaaggctgcaaccaattttaagaaaaaaggcaagggaaaggcaaagggagactgctttgtgtgtggcaagtctgggcattgggccaaggactgtcctgagcgcaaagacaggaagtctgccaacatggtcattagcgagggcggaggaacatcggggtacggtaaaatattacctacagttctctctgtttttcattcacctgattggtgggtggatactggtgctaatattcatgtatgtgctgacatttctctgttttcttcttatcaggttgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtttctaaatatgggacttttgttggaaaaggttatgacagcggaggcttgttccgcttttctttgaatgacatgtgtaataatcataatgctgtgaaccatattagcgagaatgatgagtcaaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcgtctgaggcgaggaatttggcacctctagaacttgttcattccgatttgtgcgaaatgaacggcgtgttgactaaagggggaaagaaatatttcatgacactgatagatgattgtactagattttgctatgtgtatctattgaa

SEQ ID NO: 64665 - DNA, 6905 bp, Oryza sativa
gaggacgttctgcggcttcacgtcacggtgcgccacgccgcgcgcgtggcagtaggacagcgcgtcgacgagctggacgaacacccggcgcgccgcgctctcgggcaggcgccgccgcggcagcgccgccagcctcgacaggaggtcgccgccggtggcgagctccatgacgaggtagatcctggcgcgcgtggcgagcacctcgtggaggcgcagcacgtgcgggtggcgcagccgccgcatcgccgccacctcccggagcacgcgcggcgccatgcccgccgtgcccatcacctccgccttgtcgatcaccttcaccgccaccgcctcgccgccggccaccgcgcgcgccaggtacaccttggcgaacgtccctcgcccaagcatccgcccaagctcatacttgccgagaagcggctcgccgccgccgccgccgctcttcttcttcctcgcgtccatggcagccatggccatggacaccaaccacaaacaccttcaagatttggtgtcttaggtttagtttgttgaatgatgagttgtgtgtgtgtgtatgtgtgtgttgggtttatatgatggaggtgagttggctgtcttaattagtttggttagttaattaaccatcttagttgggttagttaaccatggttagtgtcatcttaattataattggtataaaggacacattgcaaccaatagagtgatgcaacattggagtagtttctgggtggagtgatcatgtgtagggggtttatgtgtaccaaagggtgtcgtctaaccatctgatatcgataaattattatattttataacatatattatttcacgcaatttgttcttaattaggcgttttctcgaacataaaccttaatttactatacatacggaaaaggaaaatatgtgtatgattcaactgtatcatactccctccgtattttaatgtatgacgccgttgacttttcgactaacgtttgaccatttgttttatttaaaatttttgtgcaaatataaaaatattgatgtcatgtttaaacaacatttgatgacgaatcaagtcataataaaataaatgataattacataaatttttttgaataagacgaatggtcaaacgttggataaaaagtcaacagcgtcatacattaaaatatggagttagtactatttgtggttgttttgaggtgtggggttgatgtgtccattctggtggtggcattatgttgcaaattggccattgatatttgcaagctggtgggccatgcttgagctgcagctgctaccatagtgttgacaatggccctccatgggccaatatatatgtatgttggcagatggaatctgtcaccaagatgcctttgcctgaacctcaagacaacaggaaaaaatatcaccaggtttaatttcctctaagtggccaccaacccactttattataatctaaggaattgtttggaatacagtgatcattctgcaggaattaaatagaaaaaaaaatcagtagtgcaaggtccctattttgtggtcaattctttgggcacgtaagttttcagttccatagatcaaactgcatatgtttgtatctgctatgtttggctcaatctgattcaatcagcttgattatttcatatatgaaggttcctgagtaatgaccaaatatcactgttgaaggaaaagggaaaactgaagaagaaagctgagaacagtagaggtaagagtgtgaaaacaactgacacatatcattgttgaactctgatcttttttctcgaacgcgcaagttgaactctgatctagtattagacttaatgagcaactaatcaatcacttctctccatttagctatcctatttcctatcagtatatgtctcacttggacagtgatacaacattctctgatagtagatcgcaggttaaattgttcctagaaatgaatattcagtttttctttctaattcttggatgcatgtgaattgtggttcagagtttcagacagcacaactttaagggatttgttggaatagcaaaatagcgtcccaaagatttgcagtcagtgtcaggttggtcgttttctagtattaattatagcatatttctgttttcttgcaaaaatttattaaggatttgttgctacctcgtatgtagttttgtgcaacttcctctcattggcaaccatttttcagataaactctcattggaacatatataccagtttggttgcttcagagcaactagtactttatgttgatttctttcattgaggaagaattaacaatgtttcaagcaaaagcttttggaaaagaagaagacttccattaaattgtaaaataaaaggtggcatatcctcattctttgattaatctctaaatgtgcaacaataaagatgctagggcaaaagcatcgtcttggctttaatctttacatttggctaaagatcaccactaatcatcgtctaaagaaagatctcttctgatatcagtatacattgcaaagcaagacaaacccatatttaaagcaaataagcaatacaagatgatcttctccacaagcactcagattttctttttccaactaatggcaaatgatttgtccttgctcactaactaatattctgagagctagacctgcatgctctgaatcccaaggataagaacagagtattaaattgagcacatgatcgattgaatgcatttgtcacatggcatttctaaatgcatactccgtccatcctaaagaaaacgagaaggatatgtccagattcgtaatcagaaattggtttttttctaggatgaatggagtaccaatgaattataaaacatggactagaacacatttcttgtcttcaatcttaccatgctgaattgatgctacagttgggcctacaaatttagcaggatctgttgtttgtttcagacattaagacccatgctttggccagagcattgatcactgcatttgtccatgttgtttaattaacaagtaggagtagaatagaagctgattggtggcagaggtagatgagatattttcagagaaggcatcaagagtgccttatgtgagcaggcataaatgtatattccccagcttgattggtttgacaggtaaaattattctgctgttgattggctcatatgaacaactggggaaaacatatcacatatattttttgttatcttctcagtagaagtatcctgacaaccatagttgtgaccttccaagtttggccacctaagaaaatattttttattaggtgatatttttgcatgaagctttgagggaaaaaaaaggttttttgttcttttgtcagaagtatataatggatttaggtccaacctggctataaacatatgttctattttttagatacatctaacatttagttttcagccattccgaaaggcctatttctgtttgagagtactccatgccatattttgcgaatgtgaactgatattttttttatatcacccaatttcaagtgacaagtggaaaacaagcaagagagtgacccagaatatgtctcttgatctgtcgtccattcactgaaactgacaccaaggattcatatcacaacttttgtaggagagcatgcatcttccacttacaaatttttacataaaattgcacattcagtctctaaacttattcgcgagaggaatttctactaactaataaggttggctgaaaatctgagagatgttttcttatttgggtgacttactgatgagctctaaggccaaccaatatatatttgggtatattttgtgatcattttcaatgtccatttatggtgattgtcagtttctctagatcgccgtttcttgataaattgacatactggcaggtcatggttttcaaagcacaagtggatgacaaaagtagaaggcgactgaaaagtgaaaacaccagcacatctattgtccatttcaagaagttgtcttacctttcaagcaaagaccagccatgacatatatatctaccaaaatcaaatttggcgaaaattcacgcatgcccgtatcgaaaaacttcgtcgaatacaattgaatacactttgtccacaaccaaaatagttatactgaaaaccacatttgcatcagcccttccacatcgatcattgataacatgcttcctgaacttttcttcagtatctgaaattctgaactctgaactttctgaaccgaaaaatgttggacaaattagtcgacaggaaattgacgacagccaagcaacccagcgatgcgtcagcttccagggcggggccgaatgattggtgggccccacatgtgcgctgctgtccacacattccagtgggtgtgggcccgggcgtgacatgcaatgtgggcccgaggaaggtgccacgccagatttggattctcgaggagccacagccactagctaccggatctctgcctaacctgacgaacacaccaagaactactcgagcattcgacgaatatgcagaacaaaattaaggttgctgccgattgtcgtcgttttagggttttgattatactcctgagttctaaaattgttgtccttttagaatttaaagtttatctaaaataattatctttatagagtactaattatctcaccaatcacttccaatttaaatttctctcaaccgtactcccacatctaacaaaaaaaaatcatataatgaggaatcacatagtttttttcctgaaatcttaatctatgttaaataacttagaacaataattattttaaaacgggttgagtataatggttgcaggtgaagtgttcctgtcgtaatcactaactacactataacatagtcgtactacatatggatgcatgagagctagtggtcctaattggaaggtggggattaaaatgtgctagttaattagtgactagtcatattataaacatttggcgttttgctgatatttttgttaattagtttattaattatttaattactagggcattgtttttttgtgttgcaaactgaagttatatagccattgttagtggtgtggaaaatgtgccgctgaatggaattgttccagtctttataagaaaaaacacactaacaatttagtagtgttaaaatttgctttgattctgatactaccaaattttagtagggtataaaaaaccgaaacagtcgtaggttcactgtgtctttgatatagtgacctctccttatatatatgctttcacttacaccctaaatgcatatatatacgagtcaactttaagagttgattagcaaaattaattaggcagtgatcatgcatgcgtgaactgtaatctccgaagattacacatgatgatggccctcacaaaattcccatcaacgagtaggaatgaacgaatgaatgaagccatgcatcatcctgttggagcatagtatacttgactaccacatcaatgttcatatttaattcggataattatatatgtgcaccatatatagagattaaatatatttcagtggggtccttaagtttagaaaccaacggacgagaacgatctaatcatgtacaggtatatgttaactataatatataatactcaccatcaaggttaaccctggcccgccatgatctaggtctggatcgtggttcactgtcaatgattttctctcctttaattattagctaatttgatacctgatgtctgatgatatatgtattagagtgaactgtaatttgaaccatcttttattactaatgtttcactttaaaccatccttaaaaactgatcgaatgtcactttttaaagtttggatcgcctaactctcttttctgcgatattatacctatcgaggtgctccccgtcagttgttacaacaaccatgtctagccttccttctggcaaagatatagcgtgcacgtagatgaggagttcatcggtgtgtcagagccgatgtatttaggatcattgatgtttatagaagaagtcgtttcgaatggtttaaactgtaataatgataaaaaaaatctggtctaaagcgaaaagatcggttatttaaaaatgatccaaagtgaaacttaaaaagaaaaaagttggctcgtgctgcagttcactctatatagtatttggtggcgagcatgagtattgactatgagcaaaaaaaaaactatatgtatcctataaatataggtagagctagctggtcaggaagatgctgagatgatgaaattggttaatcgacagaatgtaagttaaccgattaattttgtcaggtttcgtcgtcggacgttggttatataggacttgcaggtacatagaattatatatatgctgttgatttataatctactggttcaggttctctcaatctgatgggattagagctagttgctggataactacccttgtaatacaatctgcatctgaaatatttctgcgtggccaagtcaaactcaaactgctatataattatgtgcaaaataatcctaatatatactctctctctctctctccatttttaaatatttaaactttttaaaatatgtttgaccgttcatcttattcaaaaaatttaagtaattattaactatttttctatcatttgattcattgttaaatatacttatatgtatacgtatagttttacatattttacaaaagtttttgaataagacgaacgatcaaatatgtgctaaaaagttaacgatgtcaactatttagaaacggggggtaatatcaggtctcggtgtagccagagaccctgtttaaagcaaggaccgtcccgtagatattttaggccctgagctgtgcggaattctaacgatcgaattttaaagataaaaatgaaattagtacaatttggaggagtccagtatataattcatagcaacacaaaatggagcgaaacttagcaatgtattgtgcattgatcaatattcaataattcattaaaacactaaggtattact

SEQ ID NO: 64666 - DNA, 3662 bp, Oryza sativa
tattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgagtgggaaggttagtatagagttggtataagatgaatgtgagggtaaaccgaaccaagcgaggcttggagaggtggatgaaccctggataattacaacttcaacattaacgttgtttttagttaaaactgctaagtcataggtttgtgaaatgaattgtgaaaactagctttatgcaaataaaccaagccatccttgaacccctgtgtacattagattcattttgtagtagtggcttgctgagtacgtatgtactcactcttgcttaattaaatcttttagaaaggagttggagtcgattatattcatgccatgctgctatcaagtacgtgtcgaagacgatggattagggatcatagattcaccagtcgttgcctgtggagttggatggaccgcaactgcttcgcttccactattcggtatacttctttggaattttgtaatgtatgtgaccatgcttggtctattcaggacccatttgggatacccttgttttactattgtagaaacatctgtaaatgatgtcagttgtgatattatattgtgctatgtgtgtaccacctattgatccagagagtgatactatatgacacatgggattaccggtgtataaaaccgggggtccccacagacatactttgtaacgtcccgcctcttttgtaatgtccagcctctcccaggtcgagcccgcttacatctggcaactttcataggtcatagactaccctcacaagtcttttctgcacactttgtctattgatccagagtggtactgtatgacacatgagattaccggtgtataaaacggggggggggggggggagggtcccacagacatactttgtaacatcccacctctcccaggcttaccctcatagcctaccctcaattgcttcaggcctcccaggcctatccagagtggtacatctggcagctttcataggtcatagcctaccctcaattgcttcaggccaagcactcttaacctcagagttctttagagatcggcttccggaaaagaagttgcaacatgttgatatgagtattctattaatcctattaagccctggtccggaaaagaagttgcaacatgttgatatgagtattctattaatcctattaagccctgggccgggatgtcacagggttgttacacatcaagtggaccaaatagaactttataatatgtggtaatatgcgcttttaaattcgcatcaccatttatcatctcgtcaccattttgtaattgataaattcttgtttacctatgcttaccatttgctgccaaataaaaatatttagtattggagtctcctttcaaaatatttttagtctttagtcacaatataattatgtaaatacattgtaattacactcgacgactatttgtattgcaatgaaacgaaccagtcatgggcgtaagtagcttgattgtctcaacgtgagtcaatgcgttaatgataaaactgggtccaatctaacagctcaatcggttaaaaatcaatttgctcattgctcaataattatgttcttgcgggttttggctgattggatagatgtgtatgggaattatatggatttgcttctttcctaatcatttttcaatttgcgagttttgacttttggttgattggattggaattctatggattttaggtcataaaattccatataatttgtgagttttccctgacatgaatgctgtgcaatgtagattttgtggatttgcttcacttctgtggacatttttatgttgaaccaaactaacaatgatgctaatccaggctacatgcttgttgtatcggtttattggctgcaggtttgttaatggaattttggagaatggagttgtaggatcggaggttcaggtatttttctacctcagcttgtgctagttattttgcactatttatatctttgtgatttccacattaggcaccaattaatgcctttttttctatgcaaattgcacttccatttgttgtagttgccatattttagtcatgtactctgcttttgaatttctgcaacttcaattataattttcagcaaataccttttgctttcattatagctggattttctcttgaacatgttgcgcataataaatttttagccaatcatggattggagaaacaatacagttttgtttctgccgatataggatgaatatcgccgtttttgcaaattctattataaacatatgcaactttagttataaattttgagcaacaataacttgccatagttctggctggtctctgcgggcttgtgattgtttttgtgtgtttggctctaaacatctcttgttttaattttgtttcttttctcccttatttcttgatttgcctataaaatagaaccagtagaaatgaaattttagatatctagcatcttaaaaacacatgctatatcgacatcatatgaaaactatgttgattggtaacgtttttatgattattgtcaacatatgtcgagggctatatttgttttttggcatgcagtagaccatagatccaccctgtggggctcatcaggttgatttgctttttgatggggatgtgatgggcaatttttaaatcaatttcatgtatgttgattcttgatttgattttgtgtgttttgtgttctgataattttctcttacaactagacaaaaaatttgtttttttaatagcatggctttaattaatttttccgttctagtaacgtttatgtttagccatctacaacatgcagttcaacagtttttccattggtaaaattagaatacaaaataataaaaaaatgttgttaaatttgttctatgtcatttttacacttccctattgttgaggtcgccattttcaaatctgcaaagttttggttataaatttgtgtaactttagttataaatttgtgcaaccattgatttgtttttctgtaattatttcatgtttgtgtaggattggcaaagggacaattttaaatgttccatcagaagattacgacttgttttggatgtaattgatcctaaatgtaatgtgttcagtgaaacagatctttgtattacgagtatttaccttggaaaactttgttatgtgacatgttcttccacaaattatgtcggttagggggagaccataacagaaggcaaattttcagccatgtgtggtatcaaattttgtataggtcaatgcatttgttgtttctaaaccagaagcatcaactaatttgatttgcacatatactattcttttctatcttaattctgcataggctaactttcgttcttgatgcttcccaattgagtttttttaagagaacacatgataatggacaaaaagccttgaaaattaagttcttttgcccaacaatggtaaggaacaaaagcctggccaacatgcattggaaaaaaaaggcccaaacgcgttcaacttaaaaataa

SEQ ID NO: 64667 - DNA, 21251 bp, Oryza sativa
  unsure (1)..(21251): unsure at all n locations
tatctagattcattaccatcaatatgaatgtgggaaatgctagaatgacttacagtgtgaaacggaaggagtaaaagatagggacaatgttagggcacgacgacaggcagccgatcgagcacaaagtacggtaaccgtcaagagtggtcgagcatcatcgatcaagaaaacaaaactatactccctagacaaagcctcctaaggtacacttagagctttgttcgaccaaataacatccaaatctttttacatacggatgttcttttagtccgcctacaattaaatagacggtccgtaaaattcgtttttgtacgtagttgggtgggctagcatgtaccaattgtactatagacattgacccctgaggccctgaagcgatcataggattattttcctattatatgcataatatgaaaaaaaataaaacatatgctcctagatagaagatatataatgctgtaaatcatttccattattaaaaggtaaaaaaaggataattgtggaagagcctttgctggcggtggctagaaggggcttggcctcccccgtgtcttgaaattttgcgctgattttactgcagatttagcaaattttgtttaaagaaattaacactctcagcacgacagcaaggtctccagcaaataaattgtgtttggtggctccgatccgccacctttggttttctgagtgcatgtctgcatatatatcaggtggaaaccagtagagctcactaaaactaggatgtgggcctgcataagcccattcaaaacacaagctgcacctgatggggaataagtcaactttgactctcctaaatatagctctaatcatatttgtatcactcaaccgcaataccggatatctccaaccccaactatcgaaatcggtgcaacttgactttctcgttgattttaaaagtggtttttgctgacatgacacgttgacttggtccactatgctgacgtggcagcctagttacaaaaatacaagtgacacatgtaagtgaataagaaatagttttaaaaaaataactgtaggacccactggtcagcctccttcttccttctctaccttttcccctcaacaactccatgcccagtgtgttgctcatgtcgacagggctgacccggattgctgccttcctccctgttgacgtgcgggagagctatattttgagggacacaaaatggacttatgccatctgatggagacggagagaggcagagagctctctccacaggcccattcagcaccgtatcagatggaaggcccataatcctctgcagctcagttcagcccactagaggacttctgctcgagttctagtctttcatggatggggaaggtccactttagttctttcaattaagggtcgagaggaaagaaaaaaaaatggatggatgacattatgtagacgtacgatgctatttttcatatgtaacgtcctactatttttatctacatgtaaacaccatgtagacgtcacgtcagatgaagacaagtcaacatatcacgtgggtgccatatcaatcgacaccaccttaaacaactaaaccatcttgggacttatactggtttttaaagatgtgggttgcgttatattcagttttgagatactgagggatacgatctaaactttgacctatatttgagggatctaaagtaaactttttccttcatggttttttggctgtctcaggcccagaaacaaaaatggcccagctaccacctgagtttggaattcccgtgagttttgaggtactgtagcaggcaggctcgctctttgttcgtttggactttagaggaagcggcgaagtcaacgcgacgggttgacttggtcggatagatttcctgattttttttaaaaaaaaagaaagtaaaatacggtgaggcgcgcgcatggttgacgtgtcaccgtcggatcggccgtacaatcgatcgatgggtaaagtaaaaattggaacactagcgaattaaatttactgaaagtcaacggttgcaacaattgggccacacgatgtaggagccgagccgtacggcttggttcaggaatagatgatactccatttcaggttataaaacgtttttgactttaatcaaaattaaactattataaatttcattaattttgtagaaaatagtagtaatatttttaacccaagataaatatattacaaaaatttatttgttttgagttaaaaatattactacttttttctatagaattagttaaatttaaagtagtttgactttaaccaaagtcaaaacgtgttataacctgaaacggagggacgttggtgggctggtggctacttgtaattaagctggcggtcaatagtaagcaaatactagtaacatcgcaatatcttatttttaaaatgtatgacgctgttaacttctcagataatgtcttatcattcgttttattcgaaagtttagtatacatatgtaaaagtataagttaaaattacgttgaaatgaatttatggctacatcgtatacaaatatagaagtatttaatctgtgtctgaaatgattttctggctacattatgaaaagagaagattaagaaaatacgcaaaacgtaagacattagcatataattaattgagtattaactattttaaattttaaaaatagattaatatgattttttaagcaactttcctatagatttttttttcgcaaaaagcacaccgtttagtagtttgggaagcgtgcgcgtgagaaacgaggtgttttctctctcaatctcccggaaacgatatctcaaggtggactctttggataaaaaacctagttacagtcttacagatggctgcaacagctatgatgatatcctaaatgtgatcttttttttttagttgttgcattctcgatggttgtattttcgttggatcggttttgatggatatggtgatggtaagatattggtgaaagactctttgcagctaagtcatcctctgatattatcttctgctttggttcatcagtcatcgacggtgatgtgtgcacaattcggttgacactataatcagttaatcagtcacacatttcgaatattttgtttttggtttgagaatgacaatgactgcatatccaacttgtaagctattgtgaaaaaaaaagaagtgatcataatcacactaataaccataaagatgggcgaatccaacatgggtgttagagggattcaacttcgagccctccctaccccgttggatcctcatgaagaggagagggaagggggaagaaaagcagggagactgaaggagaaaatagaatatcggtattataagcatgttttatttctaatcaaaccgagattttataatttgcaaacattcattctacccggccctttttttaaagataaccttatagctaacctattatacatgttagctttaacattgacttatagtcagaagtggatcttactattaaacttgctcagctagctattgtaagcaacatctcttagagcaagtataatagagggatgtaagaaggctgaatgctaaggtggatgagagaggagaggagagagatgagaaatgagctgtaagcttacagtcggttcaaatctatgaaaccgataggtggaccgtatattatagtgaagagctaaccaccatatgagtaagctgagagatatgccataaagatctatgtagtcaataactgtctgttttattagtcttgctcttagttctatctcttgttgacacgtacatttttacagtcatcagccgactatactattaaacttgttcattagtacccgtccgcaaaaaaaaacaaatcctagctacgaacctggatatatgcgtgtctaggttcgtagctagaatttgttttttttggatggagtagtatgttatacttttggataaaagtggtacgcttttcaaatttctaaacagtgtgtttcgtgcgaaaactttctatataaaagttattataaaatataagattaatctattttttaagttcataataattaaaacacaattaatcacacgttattaccaccttattttacgtgaaacacttagggtgggttcggcaccctatttttccaacccctctccatcattttccgcgtgcacgtttttcaaactgctaaacggtgtgtattttacaaaatgtttctatacaaaagttgcttaaaaatcaaattaatccatttttgaaaaaaatggctaatacttaattagtcacgcgcagggtttaacttaccgccggtaaccgcgcggttaccgcggttaccgggcttaccgcaggggtacggtaatataaataccgcggtaacctccttaaatacaaataaatttaaaaaataatttgaatttttgataaattttgcacggttttgtacggtttttcacggttaccgcggttaccgcgcggtaaccgtgcttaccgccggggcgcggtaaccccggccccggcggtaaggtaaaccctggtcacgcgctaatggaccgttctgttttgcgtgattagtgttctgaatggcaacagcgaacaccgaacaaactcttaatctctatcttcatctccattttcattttcatgagattcaaataccacctaacctagctgaaaggatgggcgggcgtgtgggagcagtcgcagaggtcaaagtgaccaggaaaacccaaattaaggaacattggtgtacatacatgcagtgtccacggaacgggtctacgagggcggccacaaattaataaatttgtccaatccttgcacggatcgatgcaccactnnnnnnnnnnnnnnnnnnnnnatcggttgagccgcgggggcagtggactatggacctcttcttctttttattctttgttttcatggcttagaagacgtagcttaatcatatatattaatatataaaattcatctcacttaatgtagttaataatactattttttttcttatctcattaagccatatcattacaattatcactagccctggatgatcgatctatggtctaaattatctctcatttttcttctcttgtgaagtcatatcactttattttttttgatggttaatctatattatctccattattttccttctctatttgaaccacatcaccttatactttctttccaatgatcaatctatttactatttaaattgttataaaccacataattttaattgtctacagttttatttcaataaccgatcaaatacaaaaattatactaagtatgtaaggttacgtcgtctagatatcttacatgttaattatactatcatcacataaaaccccatggcaacgcgtgggatttcatctagttaaccaatactacctccatcccagaaagatcgtggttttgtatcgtttatcgccaatgtttgaccgtccatcttattttaaaaaaattatgattagtatttctgttgttattagatgataaaacataaataatactttatgtgtgactattttcttaaaaaaatttctttaaaaaattttcaaataagataaacggggatacggaaacttacaactgtactaggacgaaggatgaaggtagtaagacactatcatgtttagaggaggtttaagtattgtgttgtccagctgtgccgattggcattatgaaccgtctaacactgtactccctcggtccaataaaaaaccaacctagtatcagacgtgatactccctctatttttaaatatttgacgccgttgactttttaaaatatgtttgaccgttcgtcctattcaaaaaatttaattaattattaattcttttcctatcatttgattcattgttaaatatacttacatttatacttatagttttacatatttcataaaagtttttgaataagacgaacagtcaaatatatgctaaaaagtcaatggtgtcaaatatttagaaacggagggagtatattatagtactacgaatctagacatagtactataatatatcatatctggtactagatttttttttatgagacggatggagtatgattcaagagggtgcatcggcaaaaattgcttttgtatatatagtgccttttcattatgtgctaataattttatatatttggcatgtaatttttttttctgcgcgcctatcactgtcctcggtgcgtgcgtttgctgttctaatttctttccccactgaagattgacgacgacaccggtctctcgatcgatcaaaacttttacttttgacacggtaaatacaccggtcgtcgttcttccaacacgcgtgtcctccaatccacggcgtttgttcttcacatcagtctcgatcggttcattcattttcattactaattcctcgatctgttcccatgtcaacgatcgattcattcgagcgcgagaccgatcgagaaaacccggaccgtccgatcgatcgggtcactactagactggattttgttccatggcgtttttatgtcgtttggacgacgtcgtcaaaaccaaatcttgaccgtctagctgctgcgaccaaatcgcctactctctatgcataagtactcaatgcgttccattaaaaaaccaaattacctactctctgcttaatgggggattgtctgcagtactgcatcatactgttgatacagtagcaatgaccgacgtgtgaaccggacccacatgtcagcttctgctactgcatcagcagtattgtagaggatttgcatccctctctgctacaaccaaactatgttggttttctactctctgctgtgaccgaactatgttggttttttataagatggagggagtacgtagtagcagcagtcattctattttcaaaatgatctatcttgatcgccactagttaggctgagttcgttgcttggtgttggaaactcgtcccttcgcgcacataaaactgaagaactcactagtgcatgattaagtattagctaattctttttaaaagaataaatatgatttttaaagcaacttttgtatatattttttttgaaaaaacatattgtttagtagtttgaaaagcgcgcacgtgaaaaatgaaggagtcgagtgaaaaactttaacaaaagaacttagccttattactagtaatatgctctatccgttctataatataatcattattaaattcaggttgaatagaaacactattatgctcctcatgataattcaggcaagttgcaatctctgaattggatctagctgatcagtccaaacagcaattcattcatgatttcatccattcattgaactagaattttactgttgagctacgtgctcccaatccatattaattcattcgttcagtcaagccgcatatatgaacctacgtgtgtactgtggcagaaattctagtccaaacactcgcacgaatttaacgaaattctgctgctgccaatctctgaatcattctacaaccgacacctctgaaagtctgaactctgttcaaacctcaaatcacgcacacgtacacactagtgtaccgaagtatatccatcaatttccagggaaaaaaaacagaggaaatgtcagatgtattatatgaacaagtgaaaagaaaaacaaaggaataaaattcctgtatgcatgatgagtccctgtttggctctaacaaaacaactgcaggccagtaggtttgcaaagaaattaaagggcactgaacctgcaatacaacagctagtaaccaggagagaaaattacgtatatatataccctcaaaattaaatcaatcactttttaagtattaattattataaattaaaaaggaatttattttattttaaaaaatcttacacacacagttgtgctatacatttgtcgacaaatttttccttaaaaatttgggagatgtaaatatagtgtgatcgtaataattacatcgtaatttgcatgtaactacagtacaacttgaatgtaacttttaaaaatcttgtgataacatgctattttcatgaagcggaggtcacgagaccaaatcccctcacttacgtgtgtgttgtgactttttccttcccataaagcaaatctaatgattttaaaattacacgaaagttacatatcatgatatcaattaggagtacgcatctcatttagcagttaggaagcatatccatataatacaagagagaacagctaacccaaaactctaaaaaaaactcaggctaattaacacaaacaaattaaaaacattgtgtgaaggagcagagcagagcagagaaggctagagtgtggcgtagaggatgatgaattttgatgatgcgatgaattttgtaagcatatgcagatacagtggagagaagaaaccaagtgagattaattgagatcgatgaggtgtgcctcctccttgagatgcgaccacaccagctgttcacagcctgtggaacgcgtcgatcagcagaccaaatcgtgtattttatcatgctgcctcgtgtgccacaatattattgttaacgtaactgctctattatattagtatactattagttaattaaccatggatgacactctgctagattatgtttatttcttcagtgtctcaagaaaaagattgtgtactacgtatgtgtatgtttcaaacttacaagtaggaagttttgaattggttggggttgggcaaagttgttgtcttagctctgtgtttgtagatattagctaattgctctcatgtcactgaaaaatcgcaagttggattttttgttaaaaaaatagtaaccgtggcagcggtggaatgaaaggaaataaaagcaattaactatttcttttccttcatggcaggtcgctagttgccctcaaacatcgatgaaaataacttagtggattttagcattagtggtttccaaaaggaaaaaaagattatatatgagtagtacaaaatcacatttgctaaaatataatacccttttttaataatgggtagatcagcctttgcttccgcaaaagttacaaccaattattacagcgattatagcaactaagaaccgacaatatcaaatcagaaacaacaacatataaaaaagaaattcatggatgaaatataataccatttgtgctaaaataaccgtctttcttggttataaactgtgaacttgagcaatggtttgagagtaaatcatccgtaattctattggtcagagaagtagaccacagtcgatttaatttggaacagttcagtcaaacatctaccaaaaaatcttttaactagacaaaagcgttaagcgtatcacacaatattagttaaataaacttcctttattaaaaccatcctaatccctggcatttgacacagccaaacagtagtttgatactgatacgattcacacatcaattttccaattttgcgctgctctttcctcacatattgatcacatttgccactttttgaaaaatggaattaatcaacgtaaaattccaattaattaactaagcttcctttaataattaattccctcctaaaccctagcattaatttgacacagccaaacagttcatactaattcgattcacacaccaatttttcaaaaaaaaaaatcttagctctttccacacatcatatttatttgtctcttttttgaaaatggaactgatcaacctaaattgtaattaattaactgattaattaaactgcatgaattttgcacttttgacctagctagctagcagcctagctaggaaatcaaatcaaaccaacaaataaaactagttgatggcgatggaatcatgcaaggagatattgaatttgaaccccctgatgaaaaagtcaatgccatcagcttcttcctcttcttcaattcctccactcgttttcagatcattttccatggcgccatggcgcctatataagcacccacccccctctctccccctaaccctaaaaacatacaccatccatttttccaagcttcattccaagccactacactagcacacactacatacaatcttcttcttcttcttcttcttgagttcttggaggtcgaggggtgggtcatcaatggcggaggtggaggtgagggtgaggcaggagcaggtggcggagttcagggagacgttcgcgttcttcgacaaggacggggacgggtgcatcacgctggaggagctggacacggtggtgcggtcgctggggcagacgccgacgagggaggagctcgccgagatgatccgcgacgtcgacgtcgacggcaacggcaccatcgagttcgccgagttcctcgccctcatggcccgcaaggcctcgcgcggcggcgagaacggcggaggaggagacgactccggcgacgccgccgacgaggagctccgggaggcgttcaaggtgttcgacaaggaccaggacgggctcatctccgccgccgagctccgccacgtgatgatcagcctcggcgagaagctcaccgacgaggaggtggagcagatgatccgggaggccgacctcgacggcgacggccaggtcaacttcgacgagttcgtcaggatgatgatgctctccgaccaataattaatctcctctctactatatatccaaaatcaatatatctctctccatttcattttgttttttttcgatctcttctttctttctttcttcccaatttgattagttacctaactaattaaggtagctagctatagctactgtcatttaatttggccttggttaattagttccttgattaatgtatttgtttgtatgaccaaatcatacatacatgtatgtccattaatttttgcatgcaaatggaagtatatacatatatctccaaatatatgtcaataatttttttgttgcaagagagaaattaagaagcaatcttttatctctctttttgtttcttttggaaaatgaaaaagaaaatgagagaggaaggaaattaaattgaagcaggggtaggtcaacttgagctagctagcactagctgtccctgaccattaattttccattttttaaaagtcttttagtgtactttttttttgttggtgttgacaagaaacaatttggcaattaatgcctgaatctttctagagtatttgacctggctattttgttttgttttgcttttgttcatgtcctcttttttggacagtgactttggccgtgttggctagtagtagctttcatacgagtacttttctataaaaaaaaacagagaaagagagagagagagagagagagaaaaagagggtcggtgaggcatatagaatcggttgtgcgttcaacggttaaatgttgtgaaaccatacaacacgcggttgtgcagcaccgtgcaataaaccaaagataaaaggaaaagaaaaaggaatgtttttttttagaaaagcaaaagggaaaaagatcaaaggagattttgttgagggactctatatgatcttccgttaacacctttagaaatactgataggatcatgtatcaggaatcataattagaacacgcttgttaaccatgaatggatccaaccaaacgtctttgaagtagaaggatgcgcgtgaggccaagtttagttccaaacttttaatttttccatcacatcaaaactttcctacacatataaacttccaacttttcggtcacatcgtttcaatttcaaccaaaccttcaattttgatgtgaactaaacacaccctaagttggctttctcacgcttgcttcctcgttggcgtcctactgctcatatgtgttaccatgagtttatatctaatattgatggatttgtgcaaattcgatgcaaaaattctaatgcctcaacagaacaggttatccagtagtggagccaagttctgtaaacagagatgctgctatcctttcaacatatatttaatttgaatttaaaagttcatgaaatttcgactgtttaatttaggtttctagctcgactacttatggccatatgtggccaaattaacttcggtacaacctgaggtagactcatttttatgtttgtttgatcggattgctgagcttgcaaacaaaaaaaaagttaaaaaaaatacttgggcgacatttggacggtgcatacatacagcagccggcctgtctgactgactgtctgtcacgcgcattgctgtgtacggccgtacatacgtatatatatacatacacatttaggccatgtagctcttccaaacagttcagctttttatctagattttgagaagctgtagttgtagaatctgaatttagaaaataaactagaagccagaagttgggtttttcagcttttccagattctcagaagctagctaccaattagctacttctcggaatgttaagctccctacataaatgtactgtacaatccctttttgtctgctccattaactatgcaccatccgatacaaaatcaatggccgtgatggacgtacatgtatatatagtgtcgtgtactagtgtggatcaacaccgaacccgtgatggatgtacgtcgtattgaagcagtcgccggtcggtgatgtgtactgcaccgtctgcacgtactgcactgcatgtaggagtaaatcgcaaaggttgacgcatatggcgcaggcggctgagtctctcttttttttttccatcctctatttgatcgtaaagttgttcttataagaggaaatagttcgaataaacctctaaattataaaaccagatatttaacatttcaaatcaccccctctcccctcaactaaaaatccaccccttatagaagtattgtttggagcgattttgttgttgaccggctgacgtagaattccaacatgacaaaaatagaaaagatagacctatcttctagaacccattacatcgtcctactatttcctagtgggggagatattgcaacgccgggaaactcgtgtcgatgaaattaaggagcgatgtcgagctcactttttcccccattgggaacctcgtggatttgcgccgatctcgtcaccaaagctcattgtgcaagtgtgaagaaggcgtgggacggatggcgtgcaacgaccaagcagttttttcgggtagtgcgacgaaggttgggcggagatggcagctaccggaggaggaactcgagctcagggcagccatggaggtgggtactaaaagaaagggagaagggggcaccattgtctacgcgcgtggtcaatctccttcatgttgccacctagatctagaaagaggaagagccgagggaatcaagaagatggtcgtggcacgaagtagagggagccacatgaatgaagaggagcagatgaagcaaaagccacagttgccttcctctctcccctcgacgttgcgtcgggccccgttcgcgcatgaggacgccatctgccatgtatctatagtggctagttgcatcgtcagggttttcatcatcggccttgctgagaataagtcgcttcgtggatctacatcacttctccttccggcggcttcctccaacctccgccatgctgtatgtacttacaacatatactatccaccgctaataagacatcgctgtaagatggcacaccaccaacttgatccctttctctcttaagcataatatagatatgaagatagaggatgtcaggtggccccactaccataccatttagtatgaatgaaattcagatttttatcgtcatgttggatagcatgtagggtcaaaaccgtttcgtatttttttttcgtggtcaaaaccaccttgtattaaaatagggtcaaaacccgtcgtgcctgattttcttataagggagtatcggagtacaaatcttttttttctttttaaaaaacactctttatatatattgtgtttttctttaaaaaatcgcaccgttcaaaaaaaaacttaggaagcgtgtttacgataacagaaaatgaacagcaaagcgttaattaactaggaacccagaaaattaatgaactgggccttattagttaactacgcgagatggttttcaaagcaaattaagcgtgtacgcaagcacatgcgagtacgtacgtacaggtacaggtacagctatactattgatgtatgtatggacggagctagagcgaaatagaggatggtgtcacttgcttaatttactttattttagatcgagtttaagctgatacgggtgcccaagtttgtattgagagggtgtatacatggtgaaaatatatgaggtatagctaaaaaattttcttgatcggatacctggacaccccctaacatatactagctccgcccctggatgtactcatgtacgtttacatatgtgggggtacagcagtacagtacagtataggagtggatgggagctggggtattgaatgaatgaattgatcatcggttggtcaaaatcaaagcatgggctaagctgtgtagatagcccggcgccggccttcattgaagcctatctctgcatatctttggattttcattcatttgcagaggcccaccacccttcaaaccatccacacacattcttcccctttcttctttctctaataattctttgtgctctagccatgacttggacaacaacaaatttatgtgcatactgaataatgctacagaaactaatactccctccgttctaaaatataaaaaattttagtaggatgggacacatcctaataatattacgattctagacagagagcatgtatccaaccaaagcttcatatctaaatatatttatagtactgggatatgttccatccaactaaaatttcttatattttgggacggaacatatatttagacaagtcagatatgtgtacatctcagcgtgacacgtacgtatataggttgtccaggccggccacatgtagctagacataatttggtttgccagcttgatatatacttttatgtgttttgtgggggattatacatatgttgatgagattaattgctgaaggagttggagcctggaggtttctgcacttgaatacttgatcagttcattgtctgaagaatgcatgcatgaacattcagtgtccagcttgggctgcaagctggaattaacagcttgcagcttgtttgatccagctgtagtacatataataatttgtactacagcatatatatccatgtattaattcaaaatgatttactactactttggagaaaacagctagctatatgtatacaaacacatgcacacactctgatgggatggtattgctgggattaaatggaataataattaaggagccaactctgttgagtccaaatgcatgcatgagctagccggacaaccactcaaccagcactaagctcgttctatctgcacttttcttttatttctagaataagttcactttacgttctttatcttagacattgaatttgaattacctccttaaatcgcaatactatacatatataacacatccctcaacttatgaaaccgatgtacccaagatcctagacaatgtaatgcccgattttagctaaccaaacgagtgggacctacgtgggcccaacatgttagtggcccactcttcttccttctctccccctcgtccctctcttacccatccctcttcaggccaggaggcaggtggcgagcggcggggagaagggtgaccgccggcaggaggcgggtacgtggtggggagacgcaaacacgggaacctaaccgatggaggaagaagagttggcaactagcatgtgagatccacgtggggtcccactcatcacatcagctaaaatcgtgtattataatatcgtaggacctcgggtacaccggttttgtaagttgagaaatgtgttatatatgtttcggttcaagaacgtaactcaaacttgacatcaaaatgacagacctaaagtgaacttattcctttattattccctctcgagagaaggcccgataggcggcccatcaagaggacaaactaattaaacctaggattactactaccgtaccttattaactactaacaataaccactatataatcagctgtaaaaattgtacccgtacttaccaaaatataacaattttacaattcaaaagttgttctaaatataacaaccttttacctataaagggtgtgtttagttgacaccaaaattaaaaatttgattgaaattggaaacagaaaagttgaaagtttacgtgtgcaggaaagttttaatatgatgaaaaagttagaagtttgaagaaaaaatttagaactaaactcggccaaaaggtgacttttgttcccaaagtaatcatactatacccacagtatccattttgtttttattatgtactcctatttaactagtctcaactcccatctcatatctcacctacctcaaagacaatgcatttcttcttcttattgctcgtgacaaaagctaatattctcatattttcacttacggttatgcttattaactaaaatttaaattttcaaccttaattagtttggagctgattttggagttttcatcgaagtttatttttcagcatttactagattactattatatatatatatatatatatatatatatatatatataaaagttttatttaaaaattatttttcatttacaaatataccgtttggcttattctacaaataagcaaaatgatgggggccttaaaacttgaacagagggataggagtagtcgttctttcttttcattttgcgaggatgcaaaatgtctctctttaatttattacagtagaagaatccctgcggtttggctagctagttcatggcagcaagcagctagatttaatggcagattgcagctagctactcgtagctggtatatgcagtactccctctgtcaaaaaaaaaaaaaaaagacaaaccctggatttccgtgtccaacgtttaaccgtctgtcttatttgaaaaaattataaaaaaaataaaaatacaagttacgcataaagtattaatcatgttttatcatccaacaacaatgaaattactaattataaaaaaaatttatataaaacggacagataaacgttggacacggaaacccaagatttgactttttttaagacggagggagtacagtacacagtacagtccagctgcatgccgacctacctaagctagctataccgatcaccatttaggttttgtttagattcaaactttggatacaaacttctaacttttttcattacatcaacctgtcatacacacataacttttcagtcacatcgtactaatttcaacccaaattttcaactttggaaggaactaaacacagccttagcagcagtaatattgtacatatacggcagacacactgcatcctgacctgcagtatactgtccctgcataaacatggaccttgagagtttttatatatatatataggccagtacgtatatacagataatacaatgcctccattcttcttcttcttcttcttcttcttattcttcctgctgttgatctagctactccttttcttgagtctgaagacgactgatctggacctgattcggccatgttcttttcagttcatgtagttatgaattagtccgtaatgtaagaataagaggctgaagtcgaggatctacttctaagaaaaaatatttacgtttcaattttcttgtaaataggttgtcagcgctagtgttatttaacgtcgagacattgaacctcaacaccaataacttggcaatgagaaaaaaaagatcaattcctaaaataattttgtttcaaagatctatttgtaaagcaagttatcaaaaaagtcaaaatgtagaaattgatcgaccgaagtctccgatagttgggacaagacccggcctgatccagtgtggaatttataattccgctgtgagtaaattttaggaatgcacattcacctcttgtatgacttcaaaaccttttcaaatgatatcaaagcctaatataatgtataatgtataatgttcaatttatccatatcaacaattatccatgttatatccaatcatgtatataaagaacaatgatattctgttccaaaatacattaacttttaggggccctttgatttggaggaaaaacataggaattttagaggattttaatcctataggaaaatttcctatgaagccttttgaaacaaaggattgaatcctatccaatcctttgaaattcctatggaatggataatcctatagagattttggagaaaatttagcaagagcttcaacctcttgctaactttcctttgagtttatctctctcatccaattcctgtgtttttttgtgtggttcaatcaaacggtcattcctgtatttttcctgtgttttgcaatcctctgttttatacttacattcctatcaaaattctacgtttttcctattcctacgttttctcaatcctgcgattcaaaggggcccttagctataaatctgaatgaggacgtaggtagtagtatagcttataccgatccagcgtattccccccgtcccataaaaaaccaacctagtacgaatctgatcatagtacaaaaatatatcctagctagatttgttttttatgggatgaagagagttcatgtaagcatatgttgcttcaattctttcatatgtttcttttcgttttgattccaccacttgttgaacacgaagggtgtgtttagttcacaccaaagtttgaagtttggttgaaattggaacgatgtgacggaaaagttagaagtttatgtgtataggaaagttttgatgtgataaaaaagttgaaagttcgaagtaatagtttggaactaaacaaggccgaaattgaatactctaagctgcagtaagcaaatgcaaatgcatctagcttggtgaaggccgagtttactctcaaattttttattcaatcttccaacattttcattacatcaaaactttcctacatatacaaactttcaacttttctatcccatcgttccaatttcaaccaaacttctcattttgacctgaactaaacacacccgaactacaagtagctgagttagctatacaagtggatcagtagctgcatgtaagatcgatatatggatgacaagaataggtctagctgatatgtactgtaagagagataggcctgcatcaggcggcgacaaggcttttgtttgtcatgcgggtaaagcactgcacggctaccgaactagccacactagctactctaccaagtactactagtactgtatttaagtatatacacacatacaatttgtatttgtatacatatactatactcttctcaatgccaatgcaaaattaatactcctaccatatatatgcaatgcatatgcaagccggaccacacactaatcgatcagaactactgttttctcactccagatctctatatacattcagttgtggagcaagcgatggcgatgccctggagaccgaacgatgaagagcgttttttttttcttgccagcaactaatttttatgactattttggtgatcgagagtggcggcaccatgccaccggcatccgataaagcccgcgattgaccaccggctagcccgagagtttgctctaccaatcccatacaattcataggttttcagccgtgttcgtctaaaccgtagtctatttttcgcgaacgcgtaaaagacctaaaccatagtctaaaaggtctagatcgtgtctagatgttagacgattgtgtctgtaaggtttagggtataaattgtgaatcaaaccgtttggtcatctaatttatgggttttcgatcggtttctgtaaaaaaaacgtgaaccctaaaacagttttcttaaccgaaaccttgttaatttgaacttattggttgccaaagttaaaactatactggtgaacggtgtcaattaaaaatagaaaaatgaatgagaattttgctatagctataggtatggatagataaagatagttttcctccggctataggtgctccttttcagtagaaagggcagtagttctaactgccaaaagccttatggcaatgtgcatggtgagtagtaaatggcaccaaggagtgaaaaaataaccttaagtagacctagctatctaccactacctacacatatatagcccctgctaggatctagagatgggaccaccacttgtgtagatcatagagcaggagctagtagtgacagagatatatagaggggtcctgcatgcctgaacaagtgaaggtggttatattgctacaaatatgtgtgcatggtctgtacctgattggaaagcaaaggatgcatgctatgctagggttttgcatttcttttgttctactccctccgttgagatttggcttgcaacgtttgaccactcatcttattcaaattacttttataaatataaaaaacgaaaagttgtgcttaaagtactgtaaataataaagtaagtcacaaataaaataaataataattttaaatttttttgaataagacgagtggtcaaatgttgcaagcaaaaactcaaaatcccttatattatgggacggagagagtacaatttaatgatttgtttcttgagtattcttcttcttctccccttggcctgtgggatgtgtacatgtatgtactctctctccgtcctaagagcaggtaagccagctgtaaacatattttaagaagataaatcaggagagagaagagcagcgggctacatatttgtagccagctgtagcacggactctaagacgcagtgtgtctatgacatgtgggactaggtattaatagtgtagtatgtaactattgtatgaatgagctattaaattggctatagatgaattgaagctagtagttgactatactattgaacttgctctaaaataaaccaaactcgtatcaaaatgtaatatgtttagtttcgttgaattagaatatgttacatcgtaatacgatattggtttattttgaaatagtgtgagtatatatggaattatgtgctccattttcaggaggagaatctttgccagttatgaacaggttgctcaaatcttggcattgatgagacctttcatctatgtgcatatcactagccagccagctactacctctcatcagcttttagttacagctactagtacctggctagctatctcaaacagcttgtgttactcctagctaggagtaattagcaatgctctaatcaatttgcattcaccatattttacataaatgtacctttaagcaatgactgataaaaaagtatagaagtaaactaatttatgatcaaaatttcataaatgtacctttaagccacctaaaataatttatgatcaatttttttatgtttgtgtttttagtagtttaaaagttagggttgaaaaagagactataatgaaaaaacaaaattcactctaaaataagtttcgtcttttacattttagcggcgtc

SEQ ID NO: 64668 - DNA, 1156 bp, Oryza sativa
ggttattatccatcaccaaagagagaagattgaaagatcttggattaaacaatttgtgtaattgttactttggtgatagatgataaaccgatgtttatgggattaacctctcttttgcataagttgtctactaggttatttcccgataatgaggtgtggaagacatgcattattttttgatggaccttaatcatgacaaggatgaaatgcatggagataaaacgatatgtaccacttcttatctcctactttttgataggttcatatatatgatttccatgttattgatatataagtgtgaaactaatgtttactcgagtcttatcttatttagtctcatttacattgagaacatggagatcatgaaggtatatgttttatgttggtctacatcattactacatatgccttctctatgtgtataggataaacccccattgatcattctctaattatgcatacacttgcatctcttgtatatttatttgtatgcatatatttagggggagcaaatcctatatatttattgtgcatgttctagatctatgttgttcactgttggcggttgttaaatgccgattctataccgccaacatctgcataaagttcggataataaaacatccaacatagtgataggtgcttaatctcacatattccacaagtgttggaatatatttgtatgcagacgacaaaccccgatgttgggaggaaaatcagactacagtgaggagattcacgtatccatataaggaggggttgtaaacttcatccaaacaccaataattcaacccaaaactccgagaaatggatagaggaggtccaggggagaagatgggccaagagccaggccagatgggcccagcccaggttcggccgaaccagagccatccaggctggggttttgatgaggacataactagctcggatataatcatgactaccttatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtgggtaccgagctcgattcgcctatagt

SEQ ID NO: 64669 - DNA, 711 bp, Oryza sativa
ttttctttatctttgtccggtactgcttttacatggtttacttctttaccggcaaattctatttatacttgggctcaattagaacaaaaatttcatgattattttcacactaatgaaactgagcttaagttatttgatttaacatcggttaggcatgaatacaatgaatccgttgctaattatattgaagggtttagagatgttaaaaactgatgtttcaatttgaaaataactgacaaagatttagccaacattgcatatgatagattgcttgattctattaaagagaaattgaatggccagatatttcttgatgttgatcatgtgttgcatgaagctctagctcaggaaagccgagtggatgacaatagcttacaagctagtttagatgaaaatgcaatatcatgtgtagccaaaccaagcgatggttcggattgtgttaataatttgtgcaatgatgccataataagtatagctgaaccaaatgttggttcgaattgtcttactagcttggataataatgcaacaaccattatagccgaaccaagtgttggttcggattgtgttactagtttagacaacgatggaatagccgaaccaagtggtgattcggattgtgttgctagcttagagaataacatcattgaagatatagccgatctaaatgacggttcggattgtattacaagcaaagatgaaatagcattgtca

SEQ ID NO: 64670 - DNA, 9443 bp, Oryza sativa
accctttgtaccagaatcatcatacgaaactaatcgctgaagaagtgagaaactaattgtcagataggattgaaaaaaaaatctaaattttggacacaggaaaggttcgtcaacaacaaaaaagaaacatgtcacatccatactatttggtgcaaagaaaaaagaaagttactagcaataagcaggataaaagttatgatcaaacaatgcaacactgaaagatggcaagcactggtataattcagtcagaaaaacaatataaggtggattaaaactgatcaggtagaacagtaaagggatgaacaatacttggtggatagcaaaatcattgtacttcctaagttcttgggttgctctttccaatgaacattcaaaaccgaatgcacctttagggtacagtaactttgcaattcgatcaacatctttgtcactgtaaatgcgccttataagcaatggatggttcgcaatctgtggagcaatagaaaagaacaacttttgagaacaggtataataaacattttcctgaatttaaaagagtgaattgcgctttgggccacattttgttgccaaagtttcactttggaccagcctttgactgatattatcactttggactaggtaactttacacttcttgcactttggaccaccccaactttcttctctagctagtctaaccactcctctggaaaaaatatggcttgcgcagttcattgttgtgctagagtcgatgtgctcaagaaagtggtttggggtggtccaaagtgcaacaaatgtgaagttacctggtccaaggtgaaaatatcagtcaaagggtggtcaaaagtgaaactttggcaataaaatgtggcccagagtgcaattcatttacatgtgtgatatgctgctgaccttacggaactgcatgaaatagtttgatatttgtcgttttggaatcaacccaacaacattattagaaaaattggatgtggattttgcgctacgagcttgacaagcaccacggtattcatcaatggcatagttataagcttgaaactgctctgagtccattgttacgaaattaacctgtgacacaagatcactgtaaagttgaaccatgacaacgaaaaccatatgttgatggttaggtcgacgtacatgttgtatctttggaacaagttgctgcataacatctgatttcaaacgtctaagaataaatggccccaaaatggactttatacgtgaaattagctcatgatcttctgcatttaacagcttcttcagatcaatatctccagtggcaaatatatcaggcatcataaactccaacaatgaccatagctcctgtaaatcagttgaaaacaagtggtactttaagatgaaatgaactgaacttaagtagttgaagcgcatactccaaagaactggagacagaaagctatccgaaaactgttgctatttatttcatggctttccatgtaagtagtaattaaaaactgatgaacagcaaacagcattgagaacctgacatgcaatcaccatatccaaaagaactcaatatcggtttcaagtaataaggctaaggcatacaaggtcttggtaaagccagaagcttaagtggtcgttctaccaaaaacaagtgttagttatagatctttggttgacatgctgattatgtgcttcagccctttgctaacatgtggactctggttatgcaggattattcatgtgcgaaacctaaccaacatactcctgatttttacagacagtagtatgtcttaaattttcaaataggtggatggtatataagtattgcaaagaaccacagaacgacacatgcagcaggactaacttaaaccaaccacccatcaagttatcatcaaaacttacatgcaaatcattttggaggggagttcctgtcagcattagccgttggcgggcatgttgtgcgacagccataaggtttctccatcggaagctacccttatctttcagtacatgtgcttcatccatcaacacacaactccatcgccatcttttgagtgctttgcgatcatccttttgctgagcactacattacagataaaaaggaacttaaacttatacaaacatgaactatcatcggctctctgaaaactttggtgctaaacacaaaataaataaccacaaacctccgccgctcaaagagagagtaacaaacaaggaggacattaaatggaggcggataaccagctttgcccaatgaactcaactcctttgagtaggcagtccttccagcaccatgaaacatgatgattgaaaatgaaggacaccattttttaagttccctttcccaattttccaacacagaagctgggcaaactattagatgtggacctgggtcattatatagatgccgcaacagagtaagataggtcacggcctgtcatcacaagagcaaagatcaaacagcaatagcatgagttgccactgcaagtataggatcaaacaactcagcttcatctaaaataagccatatgaggttaaattctgacaatattttatattgaaccaaaagaaattcagaaaaatctattttgattaaaaaatagtgcataggtccccataataaaaaagataactccccatttgaactagcctagcttatacatcctgataagatgtcatttcactatacttatttatttatttattagttccctttccaccacatactgcaagatatcttacctgaactgtcttaccaagacccatttcatcagccaaaattgctgcacgaaaataacatataggttaatatgaccagtttagattctttggcgtgcagaaacaataaaacataataagaaaaagcaactagcatggttattaactcaatattacttaaacaacaaaacaatgattttgcagaaaaaaaatatttaacattcaactttaatcccttggtacattatagaataagcttttcatgggaaatacatgtggatctggctcctgtatactatggatctcctggtagttaatcacatgaatacaggaatgctgtttttttttctgttgacctaccaattttcattgttccatattcagagataccctaccattatttgggtctgcttgtcataaaattacaagaaaatcaaaggtgtctagaaatgtgttctccatcgagttcattttcattgattgaagattgattgcaatttcacataacggaaatctaaacagtataaaggaataacaaatagcagcatgtttccgaagacaaaaatggcagaaataacaggacgcttgcaagtaaatttcatgctatcatgctaaagggtggagtgaagtgaattactgaactgcatagatcaattttatttcatcgtgggtgcacttaaaaaaatctcagtcatatgcatctttactgacaatatcatctaaggcaacataaatgatcaaatgcaacagtttaaaaaacacctccaccgatatttttccggtgcaagagaagaagaaaattgacccccacaagctggtagggcttcagaataggctcaaactccgactcctcgcttgtgcatgcagcatccacatcatcctgctccgacacatccattgaatcaaaactccacaccttcaagtagactgcataaaaacagataagtacatacctgggtaacaattcggacactggaatcatctatctcagcataactctcacaattccttgtcgatgagccatacagctcctgtcgcaaatcagccgaaatgcgcgcgcacttgcgcaatgccttacccactacatccccctcctccacctccaccttcgtctcaccatagtccccatcttcatcgtcctcattctccaactccgaccagttcacaccatcatcctcctctgcttctaccccatccacctcagacgcacccacatccccgtcgctgtcatcatcgtccttaatcacgaaacggcgagcggtggctcgacgcggcctcgttggccttgggtctggatggtcaaaatcatcatcagcgagctctaaatcgtcgtcttcctccgagaggtcggcgacggcggttgccaagcgccgaccagcggtacggcgcggacgcgaggtcctcgaagaagggatgtcgaaatcatcgtcttcgagatcaaagccgtcgtcgtcgtcatcggaaaccgacaccgcggcggcggccttggcgggtttagggttgtagcggaaggactcgcggggcggaagggcccgcccaggggggctgtgctgccgctgcggacgattgagcacgcgggtgctcttcccggcgcggcgcaaccgctcctcctcaccaagttcgaaatcgtcgtcgtcgtcggagaggacgacggtggcggtggcggcggcggcggcggaggaggaggaaggcctggggttgtaacggaaggagtcgatgggcgggggaggctgcgagtccggctgggcgcctcggcttggtcgcttgaggacgcgcgaaggcttgaagctgtggttcgaccactcgtcgtcgtcgatctcctcgtagcctcgccgcatcggggcggcggctgcttctgcggcggctggtgggctagggttttggaggaggcggagccaagggcggaggcgaggaggcggtggtcggggagcgcgagaatttggggggagaaggcgaggggacggaaattttgggcggcctccgaggagtgggagaactggagcgccgccgcgaagagaccgccaacagatgcttttccggaagaagggtgattcgttataaactttcccttaaaaatgggggcgtatgattttctaaaggtttttttgaatcgttttcaaaataggggattatggggcggaaggcccactcgtcagtgtgttgttttggacattgtcctataatattcaaaatacactccattttgaacaatattttttaaaaaggaaatactatgcaactcctgtaacaagtgtcgcatgcttccacacaagtctcccccacgttgcactctctttctgagcctctcacacaccacacatgccacatgtgccaagacacgagaagtcaatataaggtgttatgtgtgtcgattttgatcatatttgtgctcatgtattctaagtgggtaatattgtgtgacggttatctataacatgtatgaattctatgttgcatatctatcaggcatgtcatgtactcataccatgtggaagaatatgagattttaagcctcgatcaaacatcgttgatacacgtagcataaactatagacttacttgtatttaagatggtgctgctaaaatatttgatgatacttattgttgatttttcgcgtcaacacttatatataccatcatgatacttccaattagtaccaccgtaaaactttatgatacttattattgatatttcgcgtcaacactttatgataccctgtaattagtacctccgtaaaacttagcgacgacatgatactcatgacatttctaggttaggaccgttagaaaaaaaaacgtgaaactcacaagctgctagagctcaactcgtcacaggctcaactagtcaaagatctaaatcgagtcgtttgagcttatctcaaagcttgcgagctctaccaacccgagcttaagctatttaacggaggcttgaaattttcgctagcttactctcaatctgcccacccaaattccactggcactccaaatttaatttccaccatatgcctatgattccacagacccagcaacttctaaatttccttccacatcccgtattctcatcgtatcaaaaacctagctcgatagctctcgtcctaaacaatgttggtatccaagattcacaattccaggtttctcctctgctttagatctagttgttcttcgtctcctccatgtgatctacatgaagaccatcatagaagattgcagtagtctatgacattgcttttggacggtacatatttaggaatttccagtaactatagcttttgttcttagcagcctgtgactacttcttatcgttaatttttgtcctatgtacttctgttaagtcaagggcacatggtactgtaacgttatttatccactcttgttatgaaagtgaaatcctgacagaagtcactgttgcaaaataaagtttacactattcaaagaaaatagtgttaacaagctttatacgaaacaaacttgagtcaagtcgattcttgatcgggttcgaacctatcctatttttgagtttgaaggtcattctgagctcggctcaagtctacaccaaacttaagttcagctcattgacaatttgacatgccatcatcttaaggtatcataaaattatgatcggtgacatgccatctatgccagcatcagtgattttttataagtatcatcggtgatatgaaataccgttaatatctatagatactacttcctttatcccaaaataaatatatacttttaaattagagaagtacacttcttttgagaacaaaagaagaactgtactccactaacgataagtttccttcctacaaggaaaatcaacattaattcatcgagaaaatctattctataccactgagtttgttcgagttcaatgatttaccatcgacattgtctccttctataatataccgataactttattaattgttctacaatacgccaatgggctgggctttcttttcaaaaatacccaaaatacccttagagacatacaagattaacaattgatttatctcattagaagtttcaaaaaataataaaaaattttatgtggcctcgttacacaacatggaagtttgtgtacatgtttttaagttttttctggtatatttagattttaaaaaaaaataatatttttatgtggtatatgagagaaaatttgtttatacgagagataataacgcaaaaatatcttatgtagtgtatgaaagatgatttatattaaaaacatcaataaaatgtattttgtatagcatataacaaatgagttatatattgtttaaaaaaattataaatgtaaaaaacttgaaacttctatacaaacttccatgttgtgtaagtaggccatataatttttttatattttttttgaaacttctaataggataaatcaattggtaaccttgtatgtccataaaggtattttgggtatttttgaaaatagtgtccaacccaatgacgtattatagaataattgataaagtcagtagtatattatagaaggagacaatattaatgacaaattattaaacttgaacaaaatcagtggtacaaaatagattctctctaattcatccgatcctgatccaacaaccgaggttcatcagatcaactcgccgctcgcagccgtcccagccagacccaaaccgacccgagtccgatttcagccttcaggtcaggccgcaccatataagggtctcagcgccggccgcgcgccgcaccggcatctcgttcccccaccccccacccatgtcggacgcctacaagaaagcgaagcccggccgcctcgtcttcaagggcggcgaggccgcctccctccacaagccgccgaagaagcacaagaagaacaagaagcccgcctccgacgcccccgccgacgccgaagccgacgcggaaggcgcagcggcgccctccgcggagggcgccgccgagggcggcggcgacgagtacaccatcgacgcggcgaagcggatgaagtacgaggatctattccccgtggagtcgaagaagttcgggtacgaccccgccaacgccgccaaggcctcccgcagccgcaccgtggaggaggccctcgacgaccgcgtgcgcaagaaggccgaccgatactgcaagtgaggtgagagcccttagaagctagggtttccggctccacggagcccggcgttcgatgctttgctctagtcggatctagctccggattcaattccaatcgagttctctcgacttattgtactgccgccacacatgaatttgcttgaattagcttgaatggtggagtgggttatgtttgatcgccgaattctggtttatacactgtggaatatgaagacgtgctgtaactgcaactaactgatgattaatgtgtaacgcggtctagttgcaatgttcctattagtcgtagcaaagctgtatcgtgtgcattataatccagaattatcgaaattgctggcaaattcaatatatggaccgaccaattctttgtatagattaatcaaaagcgaatattagggaaggacctaatatcaaataaatagaaggagtgaagcttcgaacccaggctggctagtccaccaccttgtggagctagcccgaagatccctgggtgcttctctgtatagattaatcacaaaagtgacttattttgtattgggtccctactcagtgtaatataggaacctattgataagattagagataggagaaagtcataacttgctagtttctgacccctatgatactgtttctgtgctcttaagttggtttttattgctattttgttttgatagtctttgaactgagttagtgttagtggtctataatcacaatcacaacaactttggtcaggtcgctcatatagacagcatacatagttgttagatcgataagtttatatggtggatgaaggtttcttatgtcatctttatatatcatgggtttctgagacacctgctgctgctgtatacctttcttccttttgggtgttgtatttgtttgattgcagaggctgttgattcaacattgatgcagtttttttttttgcttcgctttaagttaatatttcaactagtaattttgttttccctcctaggtccgtcccctctttagctgtctctctgtctcttaactctattattccttaaacacacaatcattttttccctcctccttagaaagtgtgttggctagattgtatagttcagatattgttttgtattagcttatctgttgttcatcatttgttctgttgtatgcaaaaaaagcatcatatggctcggaaaaagtgtgtgtatctctactcactgttgagatcacattgaatgtagcttaatatattttcctacttaacaggtgattcactcatgcgagttgttcacagttcttatggatgcaggagagtaattgtgctcattgtatcagaaaggacatacaattgatatagggtccagaattcctgatggcatgttgtaaatcaagctagtttagtgagtatttccttactagcgaacggaagggtgctcttgttcactcactctcacctgttttggttaattagataaaacactatatgcttggtctctgtgttgttaaatttgcatttaatccagttataagcctgtcaacaggctgcagtggtgtactgtattctttcttttgtgcgactattttttgttttcacctgcattgtccacagttatgatgtgatgggacaccctatgtcatacaggcactttttatagctctatgtgcgagtttatgg

SEQ ID NO: 64671 - DNA, 671 bp, Oryza sativa
tatgttgaagcataggccacgtgttaaggggtattgagcaacgtaataagctcgagctagcatagcctgcctagatcttagttccgcgaagtcctagcatttagaggtgtaatctcctgtcctgactgctaagcaatagagtgtgctccctgtgtgttgcatgtttattttggcttgattttggattttatatgcatccatatttgcattcatatgccttaccaccaatcatcatatcatcctgactaatcgatgtgtatacaaattccagtatactctcacgtgaatactcagcatcatacatagctctcagttagattgatagcccatacaatcccatcaaatgtggattaattcggaatcatcatcggctaagactatacatccctagaatagtacgccagttgaacataaacatattcattctataatttattaagagcctagtttatttatcatagagtaatatagattctccagaaattattcagtcagtttatcccctctaataattcacgcaaccttcagcaagaggccttgtatttaaatttgtgcgagcaatccgcatcgaaatttggagtggcatcgttataaatgggacctatgcagcacagcctgcctccacagatatcgagcataatgactacccttaggaatgttggacaaatcga

SEQ ID NO: 64672 - DNA, 9371 bp, Oryza sativa
taaaagtagtatgggaggtaactgacaccacagtgggcgtgatctcgggcttggggaaaataatttccccacctaccctcgtcttctcctcgccctcccctcatccatcgctttctccccctcccggtcgcccttccagtcgcctcctccccgtctggcgtcggctccgcccgtcctccccgtccggcgccggctccgctcctcctcgccgcgccgcaccgcttctcctcgcctcgccgcgcctcctctcgtctcgcgtcttgtgcggcggcggctgttgctgctgctccggcggcggcgagttgcggcgggcgtcgggcggcggcgcgggccctggattcggccaccaccaccggcctcgccgccgcccgctgcggagatggagaagaggcgggttgcgcggactcgggagcggcgggggcggcgggagtggacgacgcgacgccgacggtggacgcctcctcttctctgatgctccggccatctctcctctctcttctcgtcgtccctgcaaccctcctcagccaaagaaccacaagagagctcaggtagcaagcagatagaacgggtcaaggtagcttcagaatcaagaagaagaagaagaggtgagatttttattttgatttttattttctctctgtttgttttgcttttggcgtggttcttgtttccccaatcgagagcctcaccccctcaagaggctcatggatgtgaggagaaatcaaaggccaaaagaagaaggagttgtttttgtgtgatttgattcctctttgctgcagggaaggagaaggaggagcaagagcaagccatggaggagccggcgacggtcgggagggcgcggccgaggaggtagtaggcggcgcagagtgccacgatggcagccatggcgggaagcgtgacgatttttttttatctgtgatgatttttcttccttttttctttttcatcttgttgagtccgatctgtgataattgttgagtccgatctatgatgacttcaatttcttcctcggctttcacttctccagccttctcttcttcctggtcttctccaccacaacacttctcgagggcgaatcggggatttcttccgggggaatcggcgcgagggcacggggcagcgaagaaacgctgcccacagcgcgcgtgcctctgcgtgctcctctgccccgcgcctcggtttcttgccgcgcgtgggttgcgagagaaggaaccgcgcgcctcagttagggggcgaggtgctctggttgggcgcgctctcgctccacgtatgcacgaatccgacgtggaggggtgtaacaccggtccagctcaccgcactgtgaccagccttagagcaggtacaatagcagactattagctagctataaacatattttaatgagataaaagatgagagagaagtgcagcgggctacagatctgtagccagctgcatcatatacttcaaaacgcagtgtgtgtatgacaggtgggaacatatattaatagtatagtaagcaactattgtatgaattgactattagattggctatagatgaattggagttagtagtggattatactactcccttcgtcccaaaataagtgcagttttagcactcttcatgtctaacatttgaccgttcgtcttatttaaaaaagattatgattattatttttattattactagatgataaaatatgaatagtactttacgtgtggctaatttttttaaatattttttataatttttttaaataaataagacggatggttgaaacgctaaacataaatatttatggctacacttattctaggaaggatatagtgttaaacaaacttgctcttacctcgccgtcaacttttcccaagaaatggaatgcatcagtgtccgcgccacgcggtgaaaaaccatgcatccacagtggccggacccccttgtgctggcgagggcgtggggcctatgaacctgaggcggatcaaattttttttatttataattttttttattaaaagttttacaaaaataattttccattttgaaaattgacggaagtagtcgcctaccgccctttgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgggggggcatggaattttgcaggcggcccccttgccgtcctgggggagggcgattttatactgtgctctatatttttgtataaatatcaatagttataaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaatggcatttgatcatatttggtttgctgccaaaatgtaaaattgtagtgaagaatgttctacataatctcaaatttagattacgtattaacaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcaccgaaagttgatagtgataactcgagctgccgcttttcatgtgtgctgttgtggactgtgcgcgctactggatctgacactaccgtgaagcaccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccaggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacaaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaatttagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtacgaggaaggtaccagcgaaggtactcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctatgaagagaggtaaattatatggctcgatgaagtaattatcataaaaatttaaaaatgaacaatccgaactcacgagtggtcggcagggaggacggtcggctgcacgttgcccggaaacacctgcctaagtccgaactgtctcatcacacgctgcgggcagtgaggctcaacgaaaatgtcaaacaccatcggcaggatggtgagccagtaagcctggtcgcgtgtgcacaaggacgaaagtcctagcggtgctcttgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcatgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcatggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcagaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagccgacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacatgaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctacattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaaaatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcgtcatgtaatgcaccaagaggtatgggaggctcgtcaccttcaactagtggtctgcgagattgctcatctgtttgcttcattgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatattaccaacaacactgctgtacatctcacttgccacaaaagctgaagtgatgtttcggtgatacttctccaccccttgtaagtagcacttatgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatattctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatag

SEQ ID NO: 64673 - DNA, 2551 bp, Oryza sativa
gagagagagagagattataaacataggagttggaatggatttcattctctggaagctggatcagttatttggaaggggtcaatggaaggtagagagaggttaaagattgttgagattgatttcatttttggggagttggatcaatcaagggaagtttcttggaagaggtttaggaagaggatttgaatacaaagacgaggttatttttggacagggattttgagtagacgatgatgacaatggatcttgaggcaagggagggatttttgattgagatctatggcacaacttagactcagcactcaaagaacaaaattttcgcaattagggttttttgtaaattagctttttaacgcaatgcgagaatcgcggcgttacatttagcaaatatgatagttacttctgatatttgtaaatatataatcagaattagttaattctgaattgaattggttctttgccctgagtactgattttagttcctcaaaaaaagtatctgaatttattctatttggtaagcctaaatttgcatgaattttgcccacattctatttgataatacattatgatttgaaccaagtaggagcactattaaagttttgtgaatttgtttctctaaacctaagaaagaatccctaccctatgcactgactgttgtttcagtttcttaagaaaagatttatgatacttgcagtggatacttatatgtcctataactttaattaatttgagcagttagggaggagacagatgattggtatatagatgtcctgacatagcgaaactaatgttgtgattgtgaatataaatttgaaactccttgcaatccaaatgagtattctgtgttcagtacttttagcaattgatgctaatgtcacatttaattgctcaagtagcagaactattcatttatatctcgattcttccatctatatttttttatacaatttaatattatgtgtgcatatagctaaatctaaaggagtttttgttgtttctgatatttgcaggtttttgaaattgtatactacactatattcctgtttgatttttcatgcctttcaagcaataaaacagagctccacattgttggtttatgagcttgatacgatttcaagtatttcttacttgagtacatattttgccaatcaattttttttcatgttcaaacaatacaatctaattgttcatacttcaatgcacatttcatgttttctaatgtgcccgcggcaacgcgcggggctttatctagttttcttaataattatgtccacctctaaaatatattatgagacggagatagcacgtcagatcgaactcccggccggccgggtagcttcaattatcacattgcaacgatgctcgggtattacaatcagggattcagggtgtggctgtccattgtccacgattagcaaggtagcgcctgcagcttccatgagagaaagtgttaattaatcactcatccaacatgcttaattgccaccaaaccagtatatatagtgtgtattaattaccatggtcaaccataacgagaactgctatacacacacgatgttttgcttacgatagttttacgatcaaacgtctctgttaatggctgcatgttcctgtccgataaaaaaacatattccactcctagctgaatggcacggcgctagatcttacaaatatcgtaatcaattatcggatgcatagtattttcccaaggatatctatctatctattatattattaaaacagctttgaaaggaggcaccacattcgctgtgggggctagaaattcccatattaatcggagaaaaagaaaaagagagtccaagtagaaatacaatttaaaaataactaaaattcggaattaaaattaagcaatattgaaagaagagtccatataataacccaatgtgagattaattaatattcgaaataaaaaaataaaatccgaaatctctatcccttctctactacttaaaaaatagaaatatttccttcatccgtttaaatgaaaaaagtgaaaaaaaagaaagtctgattccccttggaaaaaaaaagatctgatcacttaaaaaggaaaaccaaaaaagtgagattaattaatattcgaaataaaaaaataaaatccgaaatctctatctcttccctactacttaaaaaatagaaacatttccttcatccgtttaaataaaaaaagcgaaaaaaagaaggtccgattccccttggaaaaaaatatcctatcacttaaaaaggaaaaccaaaaaagtccgagaaaaaataccgttaaaataaaaaacgaaaaaaaataaaaataaaagtccgattcccctggcaaaaaaatccgatcacttaaaaaggaaaaaaaacaaaaagtctgagaaaaaatagcgaaaaaaacaactaaaaaaatgtccgattcaaaagtggcgaaaaaacagaaaataaaccgtagatcagtttcccctaaaaagggtacggttcctgtataaggctgataaaatgtggcggacaaattaaaaatttgcgaaaaacacctaaatatggccgtccgattcaa

SEQ ID NO: 64674 - DNA, 1330 bp, Oryza sativa
agtcacactgatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattat

SEQ ID NO: 64675 - DNA, 5670 bp, Oryza sativa
gttttagcagtccatatatatcttttctctatctcaaatctaacctaatcaaactatttaaaaagaaaagttttcatcgtacaacaaaaaaagaaaaaaaacgcgtgagaaaaaaacaaaaaaaaaacatgtgagacaaaatgtcagaaaaaaagcaaaagaaacgcttaaaaaaggtttccatagtctataaaaaattagaaaagcgcgcgagaaaaaatatttccatcgtccgtaaaaaataaaaaaaaccatgcgaggaaaaaaactattagaaaaaacgtgccatttctaaaaaatggtttgaaaaaaccgctcaagaaaaaaggtaaagcaccatttataaaaaaaggttactctgaaaaactgtgagaaaaaaaatgctaaattgatctatgcttgggttggataggatccatcgattttgttcatctcctactgagcttttgtttcgccatctattttcctgtattggaaaaagcaaaaaaaacacgcgagggaaaaaatgttagaaaaacaagcaaaaaacgagcgagaaaaaaagcaaaaagaaaacatgctaggaaaaaactgtcagaaagaaatgtgccatttctgaaaaatggtttgagataactacgcatgaaaaaaatactgttcataaaaaacaagccgctctggaaaaatatcagaaaaaacactgtttatagaaaaaacccggatcgaaaacaataggattcaacgcgagaaaaaaccattgtttctaaaaacagtttgagaaaatcgtctgactcaacacgagaaaaaaaacaccatttctaaaaaagggttagcgaaaactatccgactcaacatgagaaaaaatgtcgtttgtaataagaaccgctcctaaaaaccatccaactcaacgcgagataaaattgatggacgcttgggttggataggatccattgattttttttttccatctccttcatggcttttgtttccctatctattctccagtattgaaaaccatgaacgtctctatatgcaattatcagactatttttgttaagtatagctattattcttgataacatagatataaaaataatattaaaaaataaacatattttaaattgttatttagagaagagtgcacaatgactctattttgtgtagacttgaccatgcaaggcagtgcatgatttgattgatcatgttactatttgcacgaatgagattcgctgtggaggctagaaattcccacattaatcggagaaaaaaaaagaagagtccaagtagaaatgcaatctaaaaatagctgaaattcggaattaaaaataagcaatatcgaaagaggagtccatataagaccctaatacgagattaatcaaaattcaaaataaaaataaaataaaatccaaaattagaaaataaaaggagagtccaagtaggaatatattttaaaaataaccgaaattcggaattaaaaataaggaatattgagagaagagtccatataagaacccaatacgcgattaatcaaaattcaaaataaaaataaaataaaatctgaaattagaaaataaaaggagagtccaagtaggaatatattttagaaataactgaaattcggaattaaaaataaggaatattgagataagagtccatataagaacccaatacgagattagttaatattcggaataaaaataaaaataaaatccataattagcaaaaagaaaagaagacttcaacagaaattcggaattaaaaaaagcaatattgaaagaagaattcatataagaacccaatatgagattaattaaaattcagaaaaaataaaatgatatccaaaattagaaaaaccaaaagagagttcaagtaggaatacaattttgaaacaactaaaattcaaaaaataaaaaataaaaatattaaaagaacactatacggtattaattaaaatttgaaaaaaaaattctgaaactagaaaataaaaaaaatcaattaggaatacaatttataacccacagaaattgatgataaaaaaagactattgaaaaaaaagactatctaaacacatgacaagatgaattaagtaacaagcccataaaagagtagagtggttacggttgatacgacatataaaaactattagtaaaacaccaaatataatcctaatgatgattaaaaggaggacgacaggcaggccgtaaagcaaacgggcaaggcggttgccgggacttctagaaagtaaaaaaacccattgataatcatattcgatttttaaaatctcaatgataataaaaaggagaagcagtgtgcgggtgtataggacttctagaaaataaaaaataaattccaacgatagttatattcgatttttagaatcccaatgacaataaagaataggccgtaaaggagtatagtggcatcgtttgataggacttctaaatattataaaaaagaaacccaacaagacaataaattctaaaaactacaaggtccaatttttaaaggttcggaacttctaaaaagtaaaaaaaaaaacaatgataatcatgtttgattttaaaatctcaatcacaataaagaatggaggcagcggatgagccataaaggagtacaatggcaaagccgctaacggtttgacgagacttatagaaagtaaaaaatgaacccgaacgataattatgttcgatttgtaaaattccaatgacaataaagagaaaagacaatagttgggccgtagacgagtataatggtagcgtttgatgggacttctagaaattataaaaacgaaacccaacaagataataaactcaaaaaactataagatccaatttttattggtttcaaggaaaatgtacaaggaaacagatcaccagcagattaaacagaacatctacaaggaaacagatcaccagcagattaaatagtattttgtgaaagtgaaacgagtttagcactgtgcatttactattttgcatgctaatttgcatcaacttatgaattattgggttcatcatgaaggacaaccaaccggcccagtcttgcatgatgcaagctatgactgtagtgagtctgtgagttaaagattacagagtattagaattgagcttatggcactagggtaactttattggtgttaggaaacgagtgacaaagaaacgataaaaaacaatagataaatcacagaagacacaagatttaacgtgaaaaattctctcaaagcaggagagaaaaaaccacgggcgccgacgagcaatctattcaggatagcccactggcggtggaacaccaccaactccctaaattctgacatgtgggcccattattcatcccctcttcaaataggtgtgcagggtctgaaatttgaattagaaatagccagggtttgtgaatatgagtatttcttttctatttttagtggtagaccgagcaagcaaataaagaaggatatgacagaagtaagagggagcagctggtgtgacttttagaaactatataattagaaatatggtgatagctatttaataaatctcaagtaaaatcatacttaaaaatatatatgattttgtttaggtgctagctgcgcaaatgcgcgggccacccagctagttcctttcaaaagaaaagtattttcccaaggataacttcttcgccgaaaaatagaaggcaactgtattggttaatcgagtgagcaagtgcatgcatctcctcctcctggagtaaatattgcagcatcaacgtcactgcccgtgttggctcctggcagttggcacgaacgcacacatacatgcatctggtttcctgagcagaccgcggtcctgcgtctgaccgacgcggggccccgggatcgctgctcggcataggccgtatctcgcttatttggtcaagagacattagccgggtggtggtcatctgccaagatctgccggttacttgcactttgttcggctgcactgcactgcagtctgcacccaaccaaccagccggctatagccgctagcccactcgtcaagtggtcattcacacgaaaactatagcgcgttagttgtttgactcctattgatcctaccatcaacatgttgcaaacataatttggaacatgatggagttgaaaccacaagttgcctcgcgaccacacgcgccgaagaagtggcagctcccctcccattcccaattcgagccgagaatcatcgtgcacctcgtccataaaccaatccaaagcgacgtcaccacaccacacaagtacgccacatacaaggtagtaagtcgtgaaccaggcccacgttgttttttccgaggaaaagtccacgaggcttcgtggcttcgcgcttcgccttactacaagaggggaacgcgcacgaggcgagccacgcgattcccccatctctccgacagcgagcttcgtcgtcggctgtgcgcggccgcggcggcggcgctggtcgtgtgcttcccaaattctctcattccccagcgagcgatcaccatggggctccacaaggaggcgagctcgtcgtcgtcgcggctcgacgcggcgccgctgctgccgcaccacggccacggcggcggcggcgcggggcaccacctgtcgtcgcagcccaagacgttcgccaacgtgttcatcgcggtggtcgggtcgggcgtgctggggctcccctacaccttctcccgcaccggctgggtggccgggtcggtcctcctcctcgccgtggccgcgctcaccttccactgcatgatgctgctcgtcgcctgccgccgccgcctcgcctacgaccaccccaagatcgcctccttcggggatctgggcgccaccgtgtgcggccccgcggggcggcacgtcgttgacgccatgctcgtgctcagccaggccagcttctgcgtcggctacctcatcttcatctccaacaccatggcgcacctttacccggttggggattcgtcgccctcgtcgccgctcctcaccgccaaggcgatcttcatctgggtcatgctgccgttccagctggggcttaactccatcaagacgctgacgctcctcgcgccgctcagcatcttcgccgacgtcgtcgatctcggcgccatgggcgtcgtcctcggccaggacgtgtccacctggctcgccaacaagccccccgtgttcgcctccgccggacccacggagatcctctacggcctcggcgtcgccgtctatgccttcgagggcatcggcatggtcctcccgctggaggccgaggccgccgacaagcgcaagttcggcggcacgctcgcgctgtccatggcgttcatcgccgtcatgtacgggctgttcggcgccatgggttacctcgcgttcggcgcggccacgcgggacatcatcaccaccaacctcggcaccgggtggctgtccgtcaccgtgcagctgggtctctgcatcaacctcttcttcaccatgccggtgatgatgaacccggtctacgaggtcgccgagcggctgctctgccgcaagcgctacgcctggtggctgcgctggctcctcgtcatggtcgtcgggctcatggccatgctcgtgcccaacttcgccgacttcctctccctcgtcgggagcagcgtctgcgtcctgctcgggttcgtgctgccggcggcgttccacctcaaggtgttcggcgctgaggtcgggtggcccgggctcgccggcgacgtcgccgtcatcgtcgt

SEQ ID NO: 64676 - DNA, 7753 bp, Oryza sativa
aaaaaaaatcctttttatatagaagtttctctaaaaactcaaataaacatatttttcaagttggtagtaattaatgtttttttaatcatacgctaatggttcatctcgttttatacaccgtgagttcccacgcaacacctggaatgaacttagcctaagtctggtttggttgtatactaatcttaggttgtgttcggaaggatttgttcccaacacgcacagtgcgtatgaaaaacggaacggtccattagcgcgtgattaattgagtattagcttttttttaaaaaaaagatcaatatgattttttaagcaactttcgtataaaactttttgcaaaaaaaatgcactgtttagcagtttgaaaagcgtacgcgcggaataggatagagaggggttgggaacccactgttccgaacaaagccttaaagcgttttcatgcgctatggtcatctgcccatccttggaaattttccttatgtaaattgctcatcaaaaaatctctacttgcactcaacttgataagttgataaggaagaaaggtgcatgtttctttgagctgtcaatggttgctacatctctttctggggcacaagtaataatcttcctctggcaaagatgagtgctaaatgccagtccaatgggatagttcccttgaaaaagtggccaagcatagatgaattgactgctgtttccatcataggacttggagcaccccatttgggccatgctattgtaatttggaaaaagtccactttagcccattatgtctttgatcttgcaaaaccgtttaaataaggttctttggcagaatggaaggctggttttgctgacgtggcaaattgacgcagtccactcatgctgactagacgcttacatggcaaaacaaatacagccccacatgtcatcctctcctcctcccctctctctctttctctctcccccctttctctccctctcatctcggcacccttgtgctgctcaacaccgtgttcgaggacatcgtctggcttcaccgcatctccttgtcacgctctgacggtgatgacgacaacttgtgtgggctcctcaacattacgcaaaacgagcttgtacagttgtattgttcctcatctgggaccacgtcgcgcgcctgcacaccaacgagggggaggctagcggcgccagggacgagtcattgttacccattggtttaccggcttttaaaggtagcattagtcttgcctgtttgccactgctactattgaaagatgtttttcaaccatgaaaattgtgaagacatttttgcgcaatcgcattagtgatgaaacacttgagggattgtgttgtttgctatgttgagaaacaagaattgatgaaagttaccaaagtgcaataatttgccgatttgagatcttaaaggcacgcagacaaccatcttgaaatgtattttttttcacattctcattctcaatacatatttacattatgttttttactaagtgatctcttctcttttctagacaaaacaatatgtggtattggaggtttttatcctttcttgttttgtaatggtggattaatatttcagtgagcatttcattcctatgcctttttataactctacgtggtagttaattatatactctatatgtcatattggttatcaatattgtgtgttctctagagctatgatatgcataggaccccgaatcattttcgttctaggtttgccactagacgggagggtggaggaggaggacggctggcgttgtaggcggcaccgcatctcttgggagagagttgatggcagcggccgacaggagaggtgcgtggtgactggcgaggagaagctcgaggaccggcggacgcatcctcgcccacctcaactcccaccagccgctcacgcacttcgcctctctcgaggagaaccttgtctcccactccgcattgctcgacaaggccttagccgccgcgacacctacacctccgagtccctcgtggtgttggaggcccatgaggccgctgtccccgcgtgcctcgacaagactgaggccgtgttgtccacggatcccccgctcactgattttcagggcacactccaaattgatgtgtggtttcatggacgccgccgcgcaggcgcttcatggcggcatgccaacgggagctcgtcgccgtttggaaagaggttggtccctcattgtcaccacgtcggtcgacccatcccgcctcatgcttgatgtctgtcttgcgaggtacccaacgaatggttgatggtggcgtcgtggtggtccagaacaaggaggatgtgggtgagctgtggcctatcgttgccgggggttcgctcttgttggacatggagcagcggcggtgcaacggccgacgaaacggcggtggaggaagcccgggccgtggcccgacgggcccatggtctctacttccccgctgccgccacaccaaacttctcttccttccccctcctagcaagttgctcgctgacctcctccgccgctgtcgtcgggcacgccgtagaccaaccaccatctcctcgtcctccgattgcccgtgcgcctcattgtcaccacgtccgcctccagctgccgccaggaccgaaggatggggagggagataaggaagaatatattgttttcattgacatgtgggtcccacgtgtttttttttgccacactagcgccacattggccaaaaccaccctcaatactgccttgggacagaatgtaatccggttttgtaagattagagatatgttatatatggtattccggtttagggatggttttaaaacttgacgataagatgagaaatctcaaatgagctttttccttgtaatttcattgcttaatgaaatatgcattatctagaatttttggcctttcctatggatcatgcatagatggatgttttaccggttctcttttccatcttgtcagctcttgggtgagtggagctggacgtgtttgggtctatgtgctctaggaatcaacgaaaaggaccacacattgacagtttcttcatattccttcttgtctttgtcatgtttgaacaacctgagttgcaaagttaatcagaaagttcagagcagaacactaaccagaacttcaggatagagcggagagcagcactacagcgcacaaccatgagaaatcagtgatatctatcgaacacgtacttttagtggtaagttgttttgttattttgaatattctgttagataaatccggcatatatataacacaacgtaaatgctatgagaaatgaaaatgaggaattttacagtactttttaaggatgataaaattactcaatggaaatagttggatatctgatatccccaagtttacaccaccatatgtttatttgattcaaccatagagtcacttgatttgtaggactgaaaactattttactagaccctgcttaactcaaatagtcaactattttactagaccctgcttaactcaaatagtcaaattcaatacaaactgctactactgaaaaagtttaaagctgtatttttttttgacacggggttattcttcgatcaccttgtgatgtgagcaatgaagtcctccagatcattgcgcgatgaacggacggcatcaccgagcgccttcgcgcgctgccgcaccgccaatccttcatcggaggccatcatcttcttgatcacctcctgtatagtggccgccggcaaaacctcgccgtgcttctcccatggcctcactaggagacctgccttgaagtatttgcacaccagctccgcgtcccacggctggtcggagtgcatgggccacgccagaatcggcttcccgtggctcatgctctccatggtcgagttccagccgcagtggctcatgaacgccgccgtggcgccgtgcgccaggatctccagctgcggcgcccacccagtgatcaccatccccgtgccttcggtttgcttggagaactcggacagaagcttggcgtgccgggtctcgccctcgccggtgtccgtgaatatgttgccgcggtcggcgtcgcgcatgacccagatgaaccgctgcttgctgccgcgcagtgtcgctgcgagctccgcgacctgctcaactcgaagagagcacgtcgtgccgaacgacacgtagagcacagaatccgggggctgcctgtcgagccagtcaaggcactcgtgtcgccgcctgccctgctccgacgagcccgtgttgagcagtgggttcaacggaccgattgcgaagagcttcttgccgccggcagccagagtctcagccaaatcgtcgatgaaatcgccctcgagtgctcggctcgcgttcgcgaggatgccggcgccggacaaaatcgattccgacgctcgggcacgttcgctcgcgtagtccaggaactcctgcgtcatgtaggtttccaagggggcatgattgaggccgttctcacgcaggagccgatgcccggtgtctatgtgaagggcgagggccgacacggctacgcagctcaccgggaacgcctcaccgttgggcagccgcgccgcctcctcgacagcgaaggaattgatggtgtcgcacacgacgacgacccgacggtgggaagcggatagctcgtcaaggagcgccgagagcggggcgcgcgcgtccgcggtgtacgcctcccagaggggcatgaggtgggaggggaagggcgtgtcggcggtggggtcgggaggcggagagacgtacgtggagatgccgaggtcgtggaactggacggagaggagggccttgtcgtcccagccgtgcacgcgcgcccgcgcctggcggagctgcggcgccggcgcagcgtagtggaccgcgagcccgtgcgacgacgacgcgagctggagcgacaggtgcagcacctggttgaggtgaccctgcgccgggaacggcaccgccacgatggccaccttgttcgccgggttccccttctctgccattctccgtgcctctcaatgcctgaatgactgagctgaagtctgaatgaagcctgaaaggtgttaactgttttaacgactaacgaaacgtaattggccgctgcccagtgcccactagctacactagctgcccactagtacgtgtccacgaaaaatctatcgactgaatttgtggctgatttcagtcaaattttttacaccgtccgatcggcatgcatagtgctaggcatctcatagcgtattggatctactttaatatttgtgcatgggccttccgttcagctaaagcaatgagtgggctatagttagtttggcccaaagtttttcatttagcaaaggactaagttcaatttaggtcccttagcttgacatggaatctgattttcatcctaaactgcaataccggatacaacagtccctcaactatcaaaactcaaaactagtgcaaataaggtcctaagccagttcggatggcggtttcggctgatgtggcatctacgtggctgatttgacttggtcttcgtcctatgtgacggtgatagcaaaatatcaaaattaaaattaaatcaaaaggtgggacccacatgtcatcgagtgtttagttaaaaatacagtgggacccatggccacccatcttttctccattctttttctctccccctttcctcgttgtcatcactgtagagacaacatcgtggacgccgctgcgagcgaggagacggcgtcgacgacgaggagtaagctcgcgataccggaaacgcggtcgctggcagagctctggggcggagcagaggggcgggcgggtatcgtggcgaagcaaagcggccgtgggccacgggcggagcagtcaggcggtgggggtggtccccctggtcgatggtggcggcggttgggtctagcaatgacgagggacaacgaaaaggcacccaacatcccaggcagagtgcggcgcgacgaaggggacgaggccggcatgagcagattggcttgagcggcggtggtggcgggtccccctggagcaacatcgacccaccaccgcgggagatgcggtgaccgagatccggagaggacggcgcagtggtggagaagcaatggagttgggggtgccgaagccgtggaggacgatgccagcgatgactcggatggagcaggggtggaaggcgggacgcggtgccagggacgtcgtcttccatgtcgtgcctgccgacgcggccaccgtggcaatgacgatggacgagggcgtggggtgtccacccgacgtggatccatggctctcaaggccatctctcgctgctcccttccctccgcggcggcgtagccctagatagcgttgtcgagttcaccatcgactagtgcgcttgctaccccaggtccaccgaaggcctctcctccgccgctcaccacctcagccgtgtgccacctaccgcatatggggaaggagaaagggaagaggggaggaggagaagggtaggctaaagagtagagaggggatgatgtggaggaagtgggtccactaacatgtgggtcccactattttttgttttattatttgactgatatgtggacccacatattttgctttattttttaattattaaattttgcttcatgtgccacgtcagatgaagacggagtcaaattagccacatagacgtcacgtcaactaaaaccgccatgggacctattttgcatatgttttcactgttgagggacctgttgtatgtggtgttccgattgaaggatgaaaatcggattcgttgataagttaaaggacctttaacaaaaaaaaatagaagtgggttatgaaatactgggcctaaactaagagatatattatgtatatagatatcatattagataaagtctatggtattaatcacatggtagaaagattcgatagattttgattaaaaaatataggcgcatgtcgcatagatactccatttcaaacttaccatacttaatactcactccatctacttttgatagtcatatttcatcttgtcacacagaccaaggataagtaatactacttatcatccatttaaacatgctactagtcatttctcgtaaacaagcgattcattaatatttacatttctggatactcatgtagccaatcttgtgttgaagaatggagagtcatgcattaaatccaagaaagtcattaaaatgataagttgttgaattaaaatatatctatcaattttttttcagatttgtaaatatgactatcaaaaatagatggaggaaatatttaattaaccatacgctaatttttttcaaattttacgtgtggctcataaacttaagctgcgattggttgggccagctggcggctgctgttatgcatcttctgtaccgcgctagcagcaactcggttcagtcgtagtagtagaaatagccgagcacaaatgtactcttttcgtgctaaaataagtgaaaacatgagtgtccatatctaactttaatctttttctaagtcacacgtaaattactactcatattttatattatgatgacaataaaaattctaattataattttttttaaaataagacagatgttaaagttggacacggaaactcgtcccgtgcttattttggaacggtagtaccgtagtagtagtactccataagagcatatgtagtgtggcgtcggtttgttctgacaaaaaaatcgaacgaaatattggttcgatccctgcagtgtgtaatcgattttgatggggcccacaaaaaaaagtctaagtcccacctttcctctctccttcctcccgcgaccaggcggaaaatccgtgtgcgcctgttctctccctcgttc

SEQ ID NO: 64677 - DNA, 4763 bp, Oryza sativa
ccgatttgtgaccggtctgacaatggtcatgtcgtcagcagacagccatgttcccacgtcgcgcctgcttccggcggaagtggaggtaggtatgggccgtcccatcagaaggtcattcggacagcagccatacaaatctccgtccattaatgaagagaagtcaagttggaaggaagagaggatgagtccccacacaaaagaaagagagagagagatggtgcatgtggtatccccttgaggtataaaaggaggaccttgcccacttagaaaggggggatgatttttaggagaaaaacgatcccggaacgatcgggggcgggctcgcactttgtagcttcttcatacacagatccaccaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcatctggcgcgccaggtacggggttctgcgtgtgttcttctaagctctcgcactctttcgtgtgcgccaagcttttcctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggtggtcctctgccaccaagacctctggcgctgctaccaccggctccgtgtcgtcaaggcggagggcgcggcgagcggcggctgttgctcgccattcagccgccactccttcgttagcgcctccgacccaggaagatctgcgtggggggccggatgcccgcatcagtatcgagcgccggcgtaatggccggcgtgctgcccgcgcaacggaaggcgcctcctcgtccggagtgtcacatcaacacggacgcggggatcagccctccgtgcccccggttggtggtgtcggctgtagagcctttgtggcgagccttcggaacgtctgttggcccccaaggttccggcccaccatcgccgaaaagtatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacctacacgcagtacagcgaagggatgatgagtcacttcgctcgtacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctctttcagctcgcggaccgagtggctcgtaaggaggaggcatggacctggaaccccttcggttccggtgtggcagctccggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagtgccgagagggcaagtccccggcggttccttccggcaatcggcgaagtgaggccaaacagaaggcccccgccgaggacatcaatgatggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaatgtgaagctggggcgtgtcctcattgataggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggtgacctcaaagtcgcgcttgcttgtatggagcagcgcgcggaccacctcaccgccgcgtccaagcccgagggtggcgacgagaggcttggcacatccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaaatgcattcattacccccataggaacttattgttatacgacaatgcccttcgggttaaagaatgtaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctttgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctagcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagtagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcaaagaggatcggccccaccgaaaggtgcagcggcccgtctactttgttagtgaggccttcgggacgccaagacccgataccccaagcccagaagatgctttacgctattctgatggctttgaggaaactgcgccattattt

SEQ ID NO: 64678 - DNA, 2092 bp, Oryza sativa
gcgcaaagacggcggcggcaaccaggacgagggcggcagtggcaagagcgcaggcgtgtggtggctatggctggctgtagcgctctcctttttccttttcttttttcttttttttatatataaaaagactaaaaggagatctaacggcccacgtcgtttcaatccctgggacttcgttcgtactccgattgaaagtgtcaattaggcctagaggggggtgaataggctaattcaaaaatcaactaaaagcggaagcagtaattttcggatatttccgaaattttcggatatatccgaaaattttcagagtcagcacaaacaggaaagtaaatcctagatctagttgcctacaacaagaatatgctagcacaaacagcaactagacctatagcggctcaaacaagcaaagctagaggagagggaggaagtaaagtcaccaaagatgaagctcacgaggttgttcccgaagttcgaatccttgaggggattctactctccgttgaggagctcactaagagccgggtcttggctaaccctttcctcaagaggttgcactaagcactcctctttccactaaggctatctcttccctttcggaggtgagatccgaccttcacaaacttcccccggccaaccacaagtagatcggtggctcgggagcgacacctagccgcctaggagtcctcaacctccaagagtaacaaatgaagtaaagaactcccggagatgatgcaagtgctcacaaatcttcacgaagtcaacaagaagcactcacacaaactcgaatccacaactctcacacacacacacaccaaatccaaatcgaacacgggtaagaggggaaacaagaaagcaaggctcaaaagtactaaagagagagagcaagccaagggcacaaatgattggaatggaaccagcagccctcacaagtgaggggagggggctatttatagccacagcccagattctgcccgttatgcacaataattgagattttcggatattccgaaagattttcggacatgtccgaaaattccagctcagcaccaacagcaaagtcaacgaaggatttttcggacattccgaaaacttttcggacaagtccgaaaattttcagtaccaacaacatcgttctggatgttctcggaaaagtccgaaaataactttcggacaagtccgaaaatatacagaagaaaaattgactctactgatgattttcagaaaatccgaaaatcagtttcggacaagtccgaaaatatacagaaccacttttgccttcgcagtttttttcgaaaagtccgaaaatcactttcggacatatccgaaaatttccagaagcgacaatttggttctgtgtgttttcggaaagtccgaaattgagtttcggaaaactccgaaaaaatccagaacacaccaaactgaggagaaacaccttttaaaaatagattttgagcactttgatcactcctcgtatgtcaatgcatcattcctcttaatagtgcggctttcctattaactcaaggaaacgaaaacgtacaaaatatcattttctcatttgccgcatcacatcacatcaacgtattccacgggatatgcattacgctaactctttgaggacatgacaaccttcacatttgcttaaataaaaatgttagtcctctctaatcgcattgtaattaatcaccaaaatcattaggggcctagatgcactttcaatctcaccctttttggtgattgatgacaatacgattagaacacaagagagaatgaatataatttaaggtttttggtgcaaagttttagtggaagctccccctaagagtgtgcataaaagcaagtggagagctccccctaaattattgcatccacattgaagctcacaagagaataaatatatcacatatgctcatcacatccaacacatcacatgcaaatgaataattacatctcatcacaagcaccatataaagaggataagatattgcaccacattaaagataataggatccattacatcacaagcattcataattaaacaatagacttacaaagctttaaacttaacataaaaaacacaaaaaatatcatacag

SEQ ID NO: 64679 - DNA, 2149 bp, Oryza sativa
ctcgctgaaacagaagaatgaccagaagacaaacaagatggatgagtgaaattccgcgttgagggaatgaatacggccacgatgggcgtgggacgaacctgcgagggggtcggttaaacgaccaccttggaggggaaatgaggtttccccgggatggttctgtcccccccatcttgcggggccgtttcttcttccgctccccctcgagctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggacgactccttgaggaatgagggatgcctccacggagctgagattcagcacccgttggaccactatcttgaagtcctcaggagcccagtctcatctgactccctggtgggtcctcatacagtcctcggacccagtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggctggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcacaagcggcgaagacaaggggaataatggcgagaggaaggaagcaaatctcttcctcggcgactttatacccttgccaacgctatgcccggctcctcgtttctcgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccggctcgtcccgattcgcgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggtttgggcaggagcaatcgcccacgaggcctgaccccctcgggggggtcgggcccgagggtgatgtagccgcccccctctttgtcccccgaggggtcggaccgctcccgtttcggccccgagggctggggcgccccgacccccttgtggattttgcgccgcgtgcatgggtt

SEQ ID NO: 64680 - DNA, 673 bp, Oryza sativa
tgtgttggcaggaatttgaagattattaaggtcatcaaggtttagcaaagaacgaagacggaagccccagatgtcagacaactgctgataagaaacagagtaccaggacccctgagtcatccagtatacggtggcgtgaaactgatcaatgatctcgttgcaccaattttgctgcaacgtcatgaaggagcggatatccatgagatcacaattggcaatcacagagttgttcaccagatcattatgtgcctgcagctcctcccaattgatccattgcatggtaacagtgggatgagctttagacttattacagactcataaaaggcttgttgaaagagagttcaaaaccgcggatccatggcggtgcggagaaaggagcgcggatcctcataccgacgaggagcaacaacctcagacttgcgccgccaatcatacacttggggaatcaccgccggatccctctctggggtatgaatgcggagaggcccaatggggacattgggtttggacagcggcgtacgcggttgacgagaggagtccttaccatcaccaccaccatcatgagcatgagttgaccgttgagacacccgggcaacctgaggaagcgcatactttgcaccggaccaatcactgttcgaattataattagaagatgtgtgggagagcgatccct

SEQ ID NO: 64681 - DNA, 3307 bp, Oryza sativa
acaaataaatatttacttacaccacattgttataaaaattacagtgcacttacatgttatatcaactgaatttacaaatgtaatttttgttatatatgactgaaattttgtatttatttttattttaggttcaattgagagagaacgagagagaacagcgtgtatatcaattttttagagcgcaaaaaaacaaattagcgcctctaacccgtccgattgaatcctatgcggattcccagcgctatatgtgcaggaatcttggcacttatcgaacagcctaaaaaacgacaaatcctatagaaaaaatcacacgacaaatctatagcaaaatcgttgctaaaaaacttgcataatcttttctctccaaaaatttcgaactttttaccgttggaccatcttgagattcatgacgagaggaaatctttttttaaaaaaagatcacacacagcacgtactaacgagtggtcgaatacacgattggaagattgatagccaacagggctacacaacattttttgatttgttatatatgaacgagaattacgtacttcctccatttcacaatgtaagtcattgtagcatttttcacattcatatagttggtaatgaatctagacatataagtatatctagattcattaataactatatgaatatgagaaatgttagaatgacttacattgtgaaacagagggagtattaaacaaatacagaatattgcttttgtaattacagtttaattataatacgtttacatctgaaagtttttcatctctactattataagatgtttctgctgatactttgatacatcgactctatttaagtcggtttttaaatccgttcgcttttgacaacacataacgagtccctataagaaattcttttaaaaaacttacatctcacttaggatgagagtcgtacttttaattgcttcagaatttctaccaagccataggaaaacaatatataggatacggccataatccctacaagggatccgaactgaatatcaataatatctcaaaataaaattcccatatacttttttagacaaaaaaaatatctaacaataatacgattaaaatagccttcacccgtagtaacgcacggacatgttttctaatcaaaaaatatctaatgttatatcgctactcctttttttttttggaaaaatatccaaaaatccctatctgcatccaccttaattttatcccactcactatcctactatctcactttctatccatcccctctgcctcaaatatgagtcaaaagtgtatctctatctccattgctctcccatatggtgtcttcccctgcttttttttcttgggagtataagatcgataagatatagaaggatgagatatatggcacaaaattaaaatgatatctgaagcatgcagagaaatatggagcctttaaaaaaagtattatctttcttcagatttagggagttaaaaatagggagatcgatgaagataccttataggataacaaaaagcccgtcaacgccggacatacaggagagaagagtcttgaagtcttaacaaggtgatagtgatttgcgcacaacttgcttgagagagtaggtaaacaacctagtcagtcaatgcccccctcatcaaggcccaattgtcagcagtacggtctccactatacatcagtacatgaatgttcttatctgtgcgacagtgggagtgtgggatgatgtgtatatataagcttgggcattgtcatttgcaggggccaagttgcgcggggttgtattgactgaatggcgctcttggcttacttcaccgttttcgtgttagcagcatctgttcctgccaccggccaacaaggtatgctttttcgttcttcctttttccgtcgattgcgcaattcagcccggccctctctagttttattgttgcacgcgtgtttcagtaagcaagacattcaaaattattttcggtgactactgtttctatcatctatggaggtgctctggaatctccgaaatataaaaccatgtcgattttgggtctggccatctctaagctaaatttgggtaaacttaagaaaacctctccaaaccatccgactaatcaaactcccctacaatctggccaaatgatgagcccaggggtggagctagagcaacatgcatggaggggaggggaggggggtgtgcaccgctatatattgtatagtatttttttttgttagcaaatggagtagtagaacactactaatttttggcatcaataattcaacataagcaaaagtaaggaaaagaatattcttaccgaaatggagaataccagtgacaatattgttcagtaacttatatagtgcaatagtgaagatggtaagactaaaaatcacaaaacagttttgctcgaattatagaactacaaatctaatactacctcatttaatgaatgaaatcatccattatttccaaaacaagaaataatatctcatcatcttaataagtgataaaatggcctaatttctaatttaaaaacgtcaacatatagcctccagatccatagctcttccgtcccttttgctgctcctttttgctaccggccgaggtcgatggggctcgcatagtggcttctagatcccgaccatctcgttgctctcctctgtgaccaccatgtacggccatgtcactaaaataaagctcaaccccctcttctagcccttcccactactacaaaacaccacataaagactgaccttataggtgcctaaaatcggcaccaatagtcttccaaatcatcggtgctggtttttataataaatcggtacctatgaacattatataggtgccaattcatataataactggcacctacaagtgcggtgccatatgtaccggtttttatcatgaatcaacacatatggacttcacatatgtttcgtttcttaattaaaaccggcacttatgagcccataggtgtcggtttatgatgtggaactcatatatgtgcattttttatctattgttttcatataatggcggatgaaaacaaactttatattaactgtagagctcaatgagacctacaccttttttatgactttttgatttatggccgtttcgatggggatctgaacatatgttgtaaggtcttggatctatttgcgtaagtgaatatttaaaatttataaaaaatttcagatggagacgtaacctatatgaaagttgtagatctaaatgggatctacaattttttagttgacaaaattttcatctaagttcatatattgtgttaaatatgttcggatagcagtactctcaaaataatat

SEQ ID NO: 64682 - DNA, 12879 bp, Oryza sativa
gtttggacgagcgcgtcacgccgcatgtatcgcagtgcagcgcgcttgttcatccgatctgtgatcagtcacagaccggtcagatcgtgggttaggtggcgacaggtggtctgacgcacgcctcgccccatcccgtcaggacgagagcctccaagcactcgtccctagccggagccggcgtgttagctcctggagatggctcgttggttccggtcagatatatgccaggcttcatcctaaccattacagacaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacagcagccatacaaatctccgtccattaatgaagagaagtcaagttggaaggaagagaggatgagtccccacacaaaagaaagagagagagatggtgcatgtggtatccccttgaggtataaaaggaggaccttgcccacttagaaaggggggatgatttttaggagaaaaacgatcccggaacgattgggggcgggctcgcactttgtagcttcttcatacacagatccaccaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcaaaactgatgggtgaaaaattcatggaaaaatagggtgagaaaccatgggattgctggttgtttgtgttttgaaaactatggggttgttggttggttgggttttgaggatctgaacttgagattgcagagttcaaaaattttgtaaaactagatgtggagttgttgtccatatttgagggtcaaatttgtggagaaatgtatgtgaatcaatctatgtaaacttgtgtatatatagcagaacacaacgccccaacggctagctaggttttacaacggtaacatgccaacaaatattatttaaatgccttctgttcgacctccaaactcaatttgatttttgctctgacacggctctgacacataccagccgactcccactatgtggttggttcggtttttttttggtctctaaatcgatttcaacgacacactacagatgctctaaaccatcagtgctagagtggtaggttgtcgtcttgtcgatgtctgcaataaaccatggcaagcgacctggctttggcggctctggtcggaggtcattgcagtgaggaaggagaaagatgcattggagcaataggtgtcgtagcagcagaggccgacacacaccccttgtcactgtgaccccgaattttaaaagtttttgttatagaaactaaaactcatttacttaaatcatgtaattcaaatagtcgcattcaaaacaaaactattactcaggctctgtttagatccaaacttcgaactttttccatcatatcaatctgttatacacacacaactcttcagtcacatcgtaccaatttcaaactaaatttccaactttgtaagcaactaaacaaagcctcacacacaaagtttgaagcccttttatttaaggtccggcgtgagcggtgcggtcgaattttattaagccaaagaaagtttaacaggagattgaatcatataccctccacatttagattgaaaaatgagggtatatgattaatttttacctttcggaacatggcgttcttcgatcatcttgtgatatgatcaacgaagtcctcaagatcattgcgcgatgaacggacggcatggccgagggccttcgcgcgctgccgcaccgccaacccttcttcagatgccatcatcttttcgatcaccgcttgtatggttgtcgccggcaccacctcaccgtgcttctcccatggccttaccaagaatccggccttgaggtagttgcacaccagctccgcgtcccacggctggtccgagtgcatgggccacgccagaatcggcttcccgtggctcaggctctccatggtggagttccagccgcagtggctcatgaacgccgccgtggcgccgtgcgccaggatctccagctgcggcgcccacccggtgatcaccaggcccgtgccttcggtttccttgcagaactcggacagaagcttggcgtaccggctctcgctctcgccggagcccgcgaatatgttgccgcggtcggcgtcgcgcagcacccagatgaaccgctgcttgctgccgcgcagtgccgcggcgagctccgcgacctgctccacccgaagagaggacgtcgtgccgaacgacacgtagagcacggattccggtggctgcctgtcgagccagtcaaggcactcgtgtcgccgccggccctgcttcaatgcgcccgtgtcgagcagtgggtttaacggcccgatcgcgaagagcttcttgctgctggcatccaatctctcggcgaaaacgtcgatgaattcaccctcgagcgcgcggcacgcgttcgcgaggatgccggcgcaggacgagatcgactgcgccgctcttgctcgctgttgctcgtagtccatgaactccttggtcaagtaggtatccatgggaatgaagcggaggccgttctcgcgcaggagccggtgcccggggtcgatgctcccggtggcggacgacacggctacgcagttacacacgaatgcctcgccgttgggcagccgcgccgcctccttgacggcgaaggagttcatgatgtcgcagatgacgacgacccggcggtaggacgcggacagctcgccaaggagcgccgagagcggggcgcgcgcgtccgcggtgtacgcctcccagaggggcatgaggtgggaggggaagggcgcgtcggcggtgggatcgggtggcggagagacgtacgtggagacgccgaggtcgtggaactggacggagaggagggccttgtcgtcccagccgtgcacgcgcgcccgcgcctggcggagctgcggcgccggcgcagcgtagtgcaccgtgagcccgtgcgacgacgacgcgagctgcagcgacaggtgcaggagctggttgaggtggccctgcgccgggaacggcacggccacgatggcgaccgcatccgctgggtttcccttcgctgccattgtcggcgtcgtccgagtgggagagcaagtaaaatgcctgaattggctggatgatgatttgctgactgcagaagtatgcgggcgtacagctataaattgtgcttggtggtgaccggtgataacaaagattggaattggctactaccccatactagctagccaacaaatcgtggatccacatgatacttgcgattcattgagcccggctggcggatgcaaccacgcaacttcggcagtgtctcgttggcagtagtgcctgtccagtgtagtagtaggctagtagaagtagccaagcgcaaagttatggtgcttttttttaacgaaaagctttttccccccggtttctccgattaaacggaagtcgcacaaacgcacggtaggcataccacacggctgtgttcgttccacctggttcccaacctctctcattcgttttccgcgtacgtttttcaaacggctaaacgttgcattttttacaaaatatttatatacgaaagttgcttaaaaaattatattgatccaattttttaagcaaatatttaattaatcacgtgctaatagaccgctctatttttccgtgcttggagggtaccgttcccaaccagggaaacgaacgcagccttaggcctggtttagttccctaaatttttttctcaaaaacatcacatcgaatcattgaacacatacatagagcattaaatatagattaaaaaaactaattgcacagttaggaggaaatcgtgagacaaatcttttgagcctaattagttcatgattagccatacgtactacagtaacccacatgtgtttgtgttaatgatggattaattaggctcaaaagattcgtctcgcggtttccagactagttatgaaattagttttttcattcgtgtctaaaaaattatcttttcacgaactaaacagcccgttacacacctgcgtgccccccccccccctccctcctccccctaaaaaaacacaagtacaaagagatgaaaaccaatgggtatatccttgttctaactcatgtaatatttgtgggtaagagaatatatgaatatgaatgaatcatagtggctgaagttacgcacaagtgactggacaatcataccaccgatgctttagaatgaaaaataattatagggaaataaagcatggaaagttgacataaatgattttagactcttaggggatgtcacctattttcttggatgtcatctaaataattatttttaataaaaaataataagtgtcagggttacggataaggtataccctctacccttggatgtatgctatacggcaatgcggtatatcggtgcatatacggatgttctctgaatacgctaaggaagtccatcacgaagtctgccaatgaaaaggttcctacccgtataggactgggttgttactatatcgtgcagggtccgatgtctccgagtcctacttggagaccgcctgacctgcgatataaaagggaacccccgggggacctaagggatcgaatctcatagcctacacaacgaccacagcctacgaagccgaagactatagtagccaagtcaccgggtgatctagtcgaatcaactcgactacgatctcgtcggtaccactgagttctactattccctttgtaatctgtggttatttccatataatcccatatcaactggattagggctattacctgctaaggggcctgaaccagtataatctttgtctcttgtttccttgatgtcgtactacgtagatcctcgtaccagcgtaccccaataccctctatatctggcctaccggtacccaccgtcgacagtggcgcgccaggtagggggacttggtgctcaaggttctactactatgacatcgagcttcgtcgacaacagagtcaacaccggccccatccaaggaatccctgcttcaacaatgctggtgtcgactcaagtcagcgaaatcgtcttcctggtttacaccacggtgccaatctcggctggtccatcaataaccggaactcaggtactcaagtcgaccatgtcgaggctccgcttgtcgcattggaccgccagcttcgcgttcccttagatagtgattgttcccttcgacccgggcatcttgagtacctgatacgcgtagtgagatgcggccatgaacttcgcgagtggcgttcttctgatgatcccttacccagacgacacctagcgttgaaacctatcctcatgtctctttacaccgtcttgacaaggcctccgaagaacctaagtgaacttcggctggggacgcccagagctgataaggccttgttggatccttcagagacgaaagaccatgtaagatctggtcgtgtaagagttctcgccgtgcgtattaaccaagccgtgtaatcggaaatggatttttccaacttcacggctaggggctaggatcagtgcttattcaactaaggcaagtcgagagtccaagagccttatctttcgagaggagttctccgacgacaaggctgggggctagggagagtgtataactcaagtgactgatcgaagtcgagaagtgagaagacactcgtgcacaccgcatccaacgtaagaaagcttagttagatagatttcctttctatttcacaagcattccttacagatcgcaaagaattccagaatatattacttttttcttaagatgtttgtcacaaatatataggcactaccaggaaggccaacgccaatccattgactggaagatcttctccgctagcggagccatcgacttcgctaggtcgtctatctccgcaagattcctccgagaacgggaaaacccttcgtgaaggaactcgaggtgcaactgcggacgatgatctcgtatacacgccagcacgtgccctccggcgtatcggctcgatcgatgacaatcctgcttcagggcctcgtcgatatgcccgccgatgccttcaagctgagcacaagccccgttcagccacgagatgtagccagccgctgattcctcgggatccccgcgaggtactcggaagctctctgcagacaacggccatggttgtgcaacaactcctaaggtacgagttgaaccataccttgcgaccttggagcgcctccagagcccggcccctcttcacctccaatatagtcctctcaagttcggcgacctcgaacttcgtcctccaatactggatgcgacggtcgcgatcagcaagcatactctcgaggtctgctcaacatgcaaacacctaagtcaagctaacctaagtcaagctaatcaagacagacgaggtaaaggaaagggaaccgtcaagaaccaacctaaagaagtcgacgccacgtccgtctcctcgggcagatcctggtctatgccgtcccacggcacgtacggctcgagctcaagtgccagagcgtataggcaattcaggctgcccgcgctgctggacatcctcgacatcgacatctctacaaacaacagacaaagtacccggaatcaaaacgccaaagaaaactaaggcaacgattgcacacacaaaagtagtcggaaccaacgaaaagttttacaaagcgcgattggttaaggggtacaggcaagcggcggccttactcttcaaaaagcgggaggacggactcccccagatcgctgacttcttccatcacatccttgcgcgcgtcgctagccgccccctgatccaggatcttctgaagatcgagtttaggatacgccagcctcacacacgcaaggacatggcacgccccggtatagctcccgttggacatctcctctccgatcctggccgcgtgcttggaggggatcgcctccatcaccatcgccagttccgcaaatgaagtcgtcagcgagaactcgttgggattcgtcgggatggtggtcttgatgccgcactccccggcgagctggtgcagaccagtataggtgacccgcagcgagccacggatttccgacaagttgttctcgagctccgacatacggtgctcgagcccttgccgttgtcgctcattgctggccaccagctccctcatcttctggaggtcctcgcgaacctccgccaagtcgcgcgttagcctgtcggcgcgctcattcgccgccgccgccgccgccgccctcgcctccgcgatctcgcgactaatgccgcaggcaccagcctcgaggatgcgccccatctcgacctggagctccacccaggtgagggaggcagccggcgggccttgaccagccgcgatatcgctagccgggccgctgggcgtcacctcacggctcctgggcacgaccacgacctcggttgaggccactgcaggagacacgctggagtttgctccagacccatcttgcgccgccttcgcccgcgccctacgaaagatggccatgtcggtcatcgcaacaagacgataaaatctgattaagtcaagagcctcaaatttcgtccacttacttctcgccgagtgtcaccagcctctgccgtcgcggaggcgggggagacgcatccgaggcctaagtaaaccgagtacgacatgaggacgacattctccgactacgtaaataaatgacctaggaagcttaccgatggagtgggcgtcttccggcggttgccaagcacagaggaaaatttcctccccgtcttcggaaccttgccgccgctggtcgttgcagcagcagcggcaacagccgcatcggacgcctcccgggcaatgttctcccgcaacgaggccgccgtctgatggtccacgagcggcccgataacgtcagtcagggggagagcctgcgcaacatgaagtcacgatgcggtctaagagttgaaagggaaaggatcgttgactacactcacgttgatcgcggcttcacgctcagccgcctccctctcgcaaagaggggtggggacgttgctcgccgtcgtgggaccgctgatcatcacctgggcaacacggtgctccacggttgcgccgctcagacctgcagatcgagaaccaagtttcgacaagtcaggaggaatgcacataaagggagaggaacctaaaatacaagaaaaataccccgaggagaaacccgggtcgtgtcctccggcccagagtagtcaaaggctgggtggactcgagcctagagcggctggatctgtctaccaacgaagtcggcagcgacttcataccctgacaacccccgtactcggaggtcatcaatgatatcgatgaaagattggagggatggggtcaaggtgggtttggtagtccaagatggagtcttgtctggttgctcctcaggaacaatgaagactgggtccgaatcttttatctgaagatagaaccacctcccccggcatttgctgcgagatgaggggcactggaaggggatgtatcgcgacttcaggccatcccgaagtcggaaaccaacacattcggacacctttttaggttccatccagcgcaactcatagtaaaagcggaagaggtcgagaaacggctctaccccaatgtaggcctaacagatatgagagaaaatgctaagaaaggctatggagttggggttcagatgaagcagagagagaccgtagaagttcaagatgagaagaaaaaactcggaaggcaggggaagaaaaccacagagaatgtagtcctcaaccgcaaccatgcggcccaggacgggttcaggctcagtacctcccggttccctctccatggtcccgcgaccggggagagcgccctcctcttgcaatttcttcaaggacgcgcggctggaggtggacttgtcaagatccattgccgagggggatcgccggagaagaagccgaagcaggcgaacttagggtttgtgtgggagcggagaagacaaagagcgtttggaggcaagaaatttctcacaaccgccggactccaaaatgtatttccaaaacgcccttaaataggcgcactaccgatggtgcgaattccaaggaaagaagagagatggccgccggagatttctgggtccgttgcgcgaggcggtgtgacatcccggcctagggcttaataggattactagaatactcatatcaacaagttgcaacttcttttccggaagccaatctctaaagaactccagggttaagcgtgcttggtttggagcaatttgggatgggtgactgaccgggatcctgggtgcgcacgagtgaggacaaaatgtgtagaaaagacttgtgttggtctgtgagggcagtctatgacttatgaaagctgccagatgtaagcgggcccggcctgggagaggtggggcgttaaaaagtggtatcagagccgactcttgcggtttcacggacacatgtgtcacagttgcgcaggcatggtgcgcatggctggtgtggaccaggagtagtcacacagcatggcatatacgctgtcactggacacacggacgttgccagagaggacgttcctggcctggggagttgatcgacgggggcgtcgatctcttttaagggggtgaggatgtaacatcccggcctaggacttaataggattactagaatactcatatgcaacttcttttccggaagccaatctctaaagaactccaggattaagcgtgtttggcttggagcaatttgggatgggtgaccgaccgggatcctgggtgcgcacgagtgaggacaaagtgtgagcaatttgggatgggtgaccgaccgggatcctgagtgcgcacgagtggggacaaagtgtgcagaaaagacttgtgttggtctgtgagggcagtctatgacctatgaaagctgccagatgtaagcgggcccggcctgggagaggcggggcgttacaggcggtttattggacttcaatttaaattcactcataaccgttggacttcgcatggtgttgtcgaacactctttgtctctacggtcctcacaccgagatcgaccagttgagaacgacaacaatttcgacatcagaagtcgcgattggttacatgagttcatttaagtagaagtcgggggctactgtcagggttacggataaggtataccctctacccttggatgtgtgctatacggcaatgcggtatatcggtgcatatacggacgttctctgaatatgctaaggaagtccatcacgaagtctgccaatggaaaggttcttacccgtataggactgggtcgttaatatatcgtgcagggtccgatgtctccgagtcctacttaaagaccgcctgacctgcgatataaaagggaccccccggggggacctaaggggtcgaatctcatagcctacacaacgtccacaacctacgaagccgaagactataggagccaagtcgccgggtgatctagtcgaatcaactcgactacgatctcatcggtaccactgagttctactattccctttgtaatctgtggttatttccatataatcccatatcaactggattagggctattacttgttaaggagcctgaaccagtataatctttgtctattgtttccttgatgtcgtactacgtaaatcctcgtaccagcgtaccccaataccctatatatccggtctacgggtacccaccgtcgacaacaagatatattaatatgtaatgtgttccacgtaaatttaaattcattgtttagggtaaccaaaaaaacaaataaaattttactccattcgttccatccgtttcatattctaagtctttctagcagtgcccacattcatatatgtctagattcattaacatatataaatatatatatatatatatatatatatatatatatatatatatatatatatatatgaatgtgggcaatgctagaaagtcttataatatgaaatgaaggaagtagctaatatgtgtattgaaaaatattagttaatttgaatttatatgtttgtaagagtgattatcacttattaaatatcatatcagatattttcaaatgcaaataggctgtactctccgtccggaaagcttgatgttccagatattctaagacaaattagcttatagtgtaaattaccgatccatcctccatttataaactgctgttagagttaatgagcatgcactcgattcaaatgagtgaaccagaatgatccaagggaaaaactaatggctcaaaaagtttgaaacaatcacctttttggaatattttgtgaggtcattctcaacccaagacactatatatagttttcataaactccacatcatcaaaaaaaatagtactagacactactcttctaatgtaaacaccactatccataaaatttaatgctacttatctcacatgatgtattggatgttgtgtgcaagatatgatttccttctctttcctcatttattcacttgcaacatcatttttttatcataggtgacagcctatttaatgctatggacactattctagtcattgggttgggaatggcatgagccgtaaaacgctattctttatagcaatgaggaagtatggcataaacgaggcatatcatagatagactaaaatagtttgccgagagtggaccgaccaaggtagttggatttatttccaacggttgtccttttttctttgggaaaatatgtagtgcaaatcacatatgtagtagaaacttggaaactgtctttggattgaaaaatggacgttcgagatttatccacgtcaccatgagtaaaaaaaattactttttactcataagcaaatctgcgagtaatttttttactcatggtgacgtggatgaatctcggatgtctatttttgatccaacagtaattttcaggttttcactgtatacgtggtttccaacatatattttcccttttccttctacctctggaacgaacgagcagcaggtgacagagctaggtaaacctgtcaatggacgaaagttacaggcaagtaaccatgtagcaaacgtgcgcaggctaccagactgagcgaccgaccacgtcaaggttggccatagcaacactgttttgccgagtacatacttccttgttcgtatgacccattgcactgggattaccttaccaatgtggcacggcaatcttattgcaagtagagtacaccagtgcatatgttagagaacacagacactaactctgaatatgttctactagttttcagaaaaaaaatgaatatgttctgaaacctgttaggaccgaccatccgtggccggtggcaggtatacccccacaaagagttagagatctacccaatcattttcaccaaatttgcaaccgacctgtacagttgtaaccattaatcattctaatcctatcttcttgcacaacgattgggggaaaaaaatcagtgcttgacacaatcgattcggggtggataaggtgagcactgaaagttcttcagatagtaccattcatgtggctatccaaaaccagcaagcactgactttactacgtttccaaagattcagccccaggttggcaacacaaactaccttccttttgaaaccgcatcatgtttagcaccttccatatactgtttccacctcatataactttgatcaagtttcaggctttcagcctaggatacacagaaaaaggcaatctcccgatttgcttcagttgcacgtcacccttggcgagatgacatggaggggcctcgaggaaaaggcacactgagacgaaccaaacaacaa

SEQ ID NO: 64683 - DNA, 5771 bp, Oryza sativa
catctgcgatgagtgcgctcttctccatcatcttctacaatcggctccagtcttgggaattcggcttctgtcaaagatggccgattgacaactttcatgaccatcagatttaacgaagtctgcaatagccaccatggtccacctgctccaactactgatctgatagctatcttagctgatgcattattcaacatttggtatagatagccgagaaggattttgcctagaggaaattgctttttcgattctagggcttcggctacaaattaccaattggttgtaggaccacaactggatccacagaagaggaacttctctagccacattagcaagaaagctacatgctcccgaggagtgacagggcctttgcccatatatgccgctatatagccagactaaccccctatgcttttggtcttgaaatcaaattggttcttggtgttcatactcatagggttagccgatgaggttacatctaatccagtgatcatggtgatgtcgatcagggttggagtcatcggcccttggttgaacaaaaaggcattgatagtgttggaccaaatataagtggcggcggccatcagaggttcatctttagctgaattggctatggtaagggcaagcgcttggccgattccaatctcgtcctagtgaactttcttgctagccgatacgcgcttataccatgtagtccaacttttctcgggtggagttttatcgagagatggccaagatttgaaggtatttttctagtgacctagatttgggttggccaatctgaaaggaatcctattggttttgctgataatgaactcggtaggatcagggttgccgactgcgccgaggaaatagtaattttcatgcgacaggttgggaattgcaactaggttggagagatgctacaaatccaaaggaaccgagaaggagaaaacaagatgagttggaaaatgaatctgttgcgaagaaaagggatctagccgatgagaacttacctcagcatactcggccgacgatgcggtagacgggctcgcatagtggcttctagatcccgaccatctcgttgctctcctctgtgaccaccatgtacggccatgtcactaaaataaagctcaaccccctcttctagcccttcccactactacaaaacaccacataaagactgaccttataggtgcctaaaatcggcaccaatagtcttccaaatcatcggtgctggtttttataataaatcggtacctatgaacattatataggtgccaattcatataataactggcacctacaagtgcggtgccatatgtaccggtttttatcatgaatcaacacatatggacttcacatatgtttcgtttcttaattaaaaccggcacttatgagcccataggtgtcggtttatgatgtggaactcatatatgtgcattttttatctattgttttcatataatggcggatgaaaacaaactttatattaactgtagagctcaatgagacctacaccttttttatgactttttgatttatggccgtttcgatatctgaacatatgttgtaaggtcttggatctatttgcgtaagtgaatatttaaaatttataaaaaatttcagatggagacgtaacctatatgaaagttgtagatctaaatgggatctacaattttttagttgacaaaattttcatctaagttcatatattgtgttaaatatgttcggatagcagtactctcaaaataatatcagttgtttttaagacatgtgtttgtaggttcgatagtaaggatgctttcgatggagagagatgtcttgcttgagtcatatgtatgaatataggtgccttgtgggaagtgaattgtgaccatataggtgcctaataaaataccaaatatttattcagatttttttagcaccttcaaaaaaaagccgggtacacccctatataaactggcacctatagtgtgacataggtgccttttcaagaatcagcaccaatgactatccaagtcattggtgccgaataatttgtgtggcactgaaatcggtacctactagaaaattggcgtgccttttggcatgccggctgattagctggtttctctttgtaggttttactaaattttatttattttatataagattaattaaaaatgttatatttggcagggcctccaaaaacgttgtgagtagataaagagaggaattattgcattgggatttgataactgcttatatctacggtgttatgtcagccggtgaatatttcgaagtatgggtgtgaatgttgggtgtttgggatgatatgtacatatattgggtagagcttggttcatcaagtactctctccatctcaaaatataaacatttctgaaggcttcgtgagaattaaaaaaatatgtgaaataaaatatgaaaaaaattaattgttgagaagataaagtaggtgaaaaattaaatgggagatggttgtgattggcttcatgggaattaagaaaatatgtgaaataaaatgtgaaaaaaaataatagttgagaagataaagtaggtgaaaaattaaatgggagatgattgtgattgaatttattttttttagaaaaaaatattttttaggtatattttttataaatgtgtagacttaaaagtaaatattggaaaataaattacaaagaaaaaccatcgaattcaactacaaaattatgttttgaaattcaaaatttatttgtggctaataagttgaagagcagacgaattttgcaattattttgttgtttatgctatcttatatgttatttacgctaataccatacatgcaaaactcttgtagcaacgcgcgatgtttcatctaaattataatcaaaacaagtaacaggtatatgaattaatgatggttacttcaagttgattactccttcagttctattattatacaaaatctaaatttcatatggttatggcaacaaatatgtaagtcataaatgaatctatataggggtatcaaaatttgtaagggtcagaattataaaaatgcaggagggtgcatatcagaattttgtggggtcttctttttccattcaagccgaactgttgcgtgtggtcttttttttttttcttgggactatttatatttatatttatgacgtcatattttttatggaaaaatagttaacatgtttttacattgtaattgtaagttactaaattacatatgtaattttattgtatttaccatgtaggttttaaaattacatatgtaattttcgtgtatttacaatgtaagtataaaaattacatatgtaattagtctaatcacataatgtaattattagtctaatcaccttgtattaccatattgtaagcctgtttaataggtccaaccacgtgaggcccaatacgaaaaccgaatagtcctacaccagcaccgtacctatctccacgcgcatcgaacggttataaaaaagtggcgacagaactatagcaacaccgttttttatatccgagccgaactgcttttatctctccgcgtggcgttcgccgctcattgcgagtcgatctttttatctcttcccttgcccactctttttttctctcagttccttcgctcgccgtaaaaatcgccatgggccatggctgctgctctctctccctatcgcttgcttagcttgtgctaatagctcgaacttgattcagcgatggtggaggatcaggcagcggtgctcggtggcccggcatcgttcattccctcccttcctctttctttctcctcaccagcttttccttcagccacgttggcccagatctggcggtggatcgagtcaggggatagctgttgagaggtggcgagggtggtgttcgctggatccgggccaaagatcctgccgtcctttcctctatccttgtcggattctccatagtccatactcggtgacggcatggtgatcaagcaaggggaatctatgttcttgatgtttttatttcttttgcttggattctttttttttaatttttttcccctctaatcccgactgttctagatgagattgcacattttgtgaaggatccgttgaaggttttttcaccattgatatattatcggacggctgcaggatggttgggaatacgtggcacgttctccggccgagaatccggctggagctctgggcgtggtgctacgtggcccaatgaggagtcagggttgtaaccctgaaatcggtttataagataggacctttagaactggcgcctttgggcttttctgtagtagtgtccgcctacctccgtcatagcccatgatgtcatggatcacacaagagagaaatagaggtagacacatgacggagagaagaacaggggaggagacattgacatatgggatctagaagatttggagaatggaaaatgaagatgctggttgagtgtgtaagtaatatgaagagaaatttatttggctgttgccaaatgagcacatagaaagttgttttatgtgacttacatgaggaaaaagtttgatttgtggcattcaaaactgtctcaaaataagttgatctagagctttttgccttggtcctatttgagaagcttaagattttaaagaacagctagtgagaaaattggaaaaaaagatgatttttttatctttaattttctgctttctagttcgttttctggattctataactatacccctcataatctgattgaaaatatgaattgtttaaaaaactaaagattttaggaagaacatataggtatgcatgctactccaaacagacctagtctctagatagagtccaaaatgatttttatcccttgcagccaagccaggatttcgactctgaaggatcccccagcaagggatttataagaacatacataagaatattcccgaaagaaagacatacataagcatatattgtacaaagtaatgactaatctacaaaatcaacactcatgccataaccttttgtcgtaacatgagaaggtaagcgggcgccattgttaattgacggtgcacccacgcatgcaaccgccgcctcctccacctgtacatgtccatcctatcgacgcatagagcctcggctgggagtagcacctggtggtggccatgacaacggcatcgaacatttcctccatctccaccttgcggtcgcgcttgcttctcaccgtccatcgcaggtccacagcgagccatcacgctgccgcggcagcgcccactgcttggggagccgccgccgccggatctgccactcaaaaacactactagaaaaagcatttccatagtcggccaaaacagtttttgacatgcggctagtcgcgacaactgcaatttaaggcctaaagtgatctgcctatgaaaatgttttcagagtgcaaaaaaaaacctgctgattccaaaatatccccctatggtagatccaaattcctctattccccttgccacccataatccattcacaaacttatcacaatcctcaaaatccattcaataaattgatcacaaaaaggggtcaaagagtaagattccgaggctggaaagtggatccacgcttccaaggctggcggttggtggatccatgcccctgaggctagccagtgctggatgatccggtcccacaaggcctggtgactgcaggcagggtcgacggcaggagctaaggagaaatgccaggctcggtggtgtggatgcaagctcctgaggcctagaggcgccgtggccggtagcaaaagtcatattgtggatccgtgctccctatccatcacgtgcatgggtataggtgtccaaa

SEQ ID NO: 64684 - DNA, 938 bp, Oryza sativa
ttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttggactaggagttgcttagccatgcttagttcaactagcacacaatggggaaatctcatttaaaatatagcctgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccggattcacctaggtatgagaggggactgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagactcatcttagtttagtctaatgaaatt

SEQ ID NO: 64685 - DNA, 18282 bp, Oryza sativa
agcgcccgattttatctcctcccgatcgggtgccggaccagagtcatctccataataatatgtctagaggatatgggatatgaccgatgtacaaagatctctcacctaaattttgttttgagattttgtaatgaggatttaagcattaaaaatatatttaaatccaatagctaacctaaattttttaatatattttttcgaacgcagcaagtgaggctaatctagctccctatatcagctatcatagtggggaaatcagagtctaagttaggcataaaagaagaggttgacattatttgttatcattggatcgatcatattcccctacagaaattgccaagagttaaaataaaaaagaaaacaaaatgcctaactttaaatactaaaattagtagaaacttgaataaggcaattcgtaatgctctctcatttctagacccccttttaggagcacgtgtgatttgaagattaatcattcccggggttcatacagaagctgctaagtagaagaaatatatgggttcaatagagaagaaggaaccaaacgcaacatgtctagttctaattttaggaaaattgttttcatccctcgagaagacatactccgtttcttccatgtcacctaaataattataaaaaataggtaagatagatattaacataagatatatcacttcataaacatgcaatgtcaaaatcaacttcagttgtaaaaaaatatcaaatactagctgcttcctttcccgcgcattgttgtggggatatgtataaaattacataagcaaatttgatgtgacaaaaatttgtggcattggatatatataagaatggtactcccaccatcccaaattataggtatcacttttttaggaaaatcaaactcactagtttttgattaataataatactaacaacatatatgctaagtattatgtatgttatacactagatttatattttgaaaatattttcatgtgatgtttatattcattgggaacatacaatgaaataaattactggtcaaaatatatcatcgaaaatcatgtaaaaaaatataaactggtataagaaggagtactatactaagcagtaatgcataactttgatttctatttagaaaattttacatatataaactaacaaaggagaaagtgatgataatatgttgataaattttgtccatctatcaacctcaaatgtatatcctttagagagaatatgtaagttaatcggccatcgggcacatcatagtgtcagtgacatcataaagagaaaagaaaaaccatgcaaacatatactccctccattaaaaaataaaatcaacctatgtccacatacatcaatctaggagagttacatctcctcgtagattaattttttttagacggagggagtatattatctaatgggagtagaaaatagggaaaattagctgtaattagagtaagatacgtaagaagataataaaataaaaaaacaaaatgatgaaatacgaacggactaacctattcttgattaacacatattcttggttgatgccataaacggtacgttcagcattgagcattgagcagggaatacaggaattgtgggtaaacgaatatatggttatcctgtaggttaattagatacatgccattataaatttaatggatttgaaatatgccattacaattcttgtatttgtaccaatgccattataattttaatatagtttaaaacatgccactggtatacatattttatccatattggacaaaaaaaaaaaacccgtcttcaacctctcgtcgttcatcgtcgtcgtcaccttgcctcgtcaccggagccatcctccgcatccccatcctcatcgccgattcccctcctccggaccatcgccggtttccccacctccgccgctgcggcctaggacttcgccaacaacccgtccgacgtggcgttgttcctacacacctccggcactgtcgacgggggatacccgtagatcggatatagatggtactggggtacgctggtacgaggatctacgtaatatgatatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgaccagatctcccggcgacttggcttctgtagggtttaactccgtaggctgtggtggatgtgttggctatgagattcgatcacttagatcctcccggggggtcccttttataatcgcaggtcagctggtctccaagtaggactcggagacatcggacccagcatgatacaatgacgacccagtcccgtctgagtagtactccttccatctgtgaactccatggcgaatttctttaacgtatgccgaaaacgtccgtatacgcgcaagtataccatatcgatacgtgacgtatatcgaagggtagagggtataccttacccgtaaccttgacagtagcccccgacttctgcttaaatgaactcatgtaaccgatcgtgacttttgatgtcgaggttgttgttgttctcgatgtgaggaccgagagacgaggagtaatcgacaacgcccagtgaagctcaacggtcatgagtgaatttaaattgaagtctgaaaaattgccgcgcgtaacggacctagaaatttccggcggctatctctctcctttccttggaattcgcaccgtcggaagtgcgactatttaagggagttttggggatccatttcgaagtccgcctattgtgaaaagattctccagtctccaagcgttcctcgtcttctccacccccataagaaccctagctagttcatctcggtcccttctccggcgatctccggcggcaatggatctcgacaagtccacctccaccagcacgtcgctgaagaaactacaggcggatggtgcccttcccggtcacgggaccatggagagagaagtaggaggtattgaaccccagcctgtcctgggtcgcatggttgcgatcgaggactacattctctatggttttcttcctccgccttctaaatttcttctcttggtcttgaatttctacggcctttctttgctccatttgagccccagttacatcgccttcctcagtattttttcacatctttgtgaggcctacattggggtagagccgtttcttgacctctttcgtttctactacgagttgcgctggatggaacccaacagggtatccgaatgtgtcggtttccgactcagggatggcctgaagtcgcgctatatccccttccagtgcccttcttctcgtagcaaatggcgggcgaggtggttctatcttcagatagaaaattcagatccagtcttcgttgttcctgaggaatgaccagacaagattttgtcttggaccgccaaacccgccttgaccccatccctccagtctttcatcgatatcattgatgacctccgagtacgggggttgtcggggtatgaagtcgctgccgacttcattggtagacggatccagccgctccaggctcgggcccacctagcctttgactattctggactggaggactcgacccgggtttctcctcggggtatttttcttgtattaaaactgacttccttgtgtgcgtgttcctcctgacttatcgaattctagttctcgatctacaggtttgagcagtgaagccgtggagcgccgcgtcggccaattgatgatcagcggcccgacgatggcgagcaacgtccccgtccccctttgcgataagggggcggccgaacgcgaagctgccatcaatgtgagtgtactcagcggcccttttgcatttttcttccgagatagcattgtaacttcatgaagcgtaggctctccctctgactgatatcatcgggccgctcgtggatcatcaggcggcggcgtcgctgaaggaggacgtcgtcaaggaggcgtccgatgttgctgccgctgctgccacaacgagtggcggcaacattctgagaagggggaggaaattctcctccgtgatcggaaatcgtcggaagacaccctccccctcggtaagctctcctggtgtttcatcgcgtagtcggaaaacttccgcctcacatcatacccgttgtactccaggcctcggacgcgtctcccctgcctccgcgacggcagctgcttgtgacgcttggcgagaagtaagtggatgaatttgaggttttgtcacttcgtcaaacacttgcaacctgtctgaagtgcaacctttcgtagggcggcacgggtgaaggcgacgcaggacagatctggagggacctccagcgcgtcccctgatgtgtcctcgacagatgtcgtggtcgtgcccaggaaccgcgaggcgacgcctagtggcccagccagcgatcttgcggctggtcggggtccgtcgtctgctgtcctcacttgggaggagctccaggtcgagatgggtcgtctccttgaggctggtgctcacggcattagccgcgagatcgcggaggcgagggcagcggcaacgtcgtcggcgaatgagcgcgccgaccggctgacgcgtgatttggcggaggttcgtgaggacctccagaagatgagggagctggtggccggcaatgagcgacaacggcaagggctcgagcatcgtatgtcggagctcgagaacaacttgtcggagatccgtggctcgctgcgggtcacctacactggtctgcaccagctcgctgggagtgtggcgtcaagaccaccataccggcgaatcccgacgagttctcgctgacgtcttcgcttgcagaactggcgacggcgatagaggcaatcccctccaagcacgcggccaggatctataccggggcgtgccatgtccttgtgtgtgtgaggctggcgcaccctgaactcgatctgcggaagatcttggatcagggggtggctagcgacgcacgcaaggacgtgatggaggaagtcggcgatctgggggagtctgttctcccgctttttgaagagtaggattttggctcccttgtactctttagtcatgctttgtaaaactctcattggttctaaccgcctttgtgtgtgcagtcatcaccttagttttctttagcattttgacctcgagtactttgttgtcgtttgtagagatgttgatatcgaggatgtccagcagccgggcagcctgagttgccagtgatcgttccggcgcttgcgtccgagccgtatgtgccgcagggcgatgtagatcagaattcgcctgtggaaacgggtatggcgacgacctccttaggttggttatttttgtctgctccttttcttttacctcgtctgtcttgattagtttgacttaggtgtttgcgtgttgggcagacctcgagagtgtgcttgctgatcgcgaccgtcgcatacagtactggaggacgaagttcaaggtcgctgaacttgagagaactatattggaggtgaagagggaccaagctatggaggcgctccaaggtcgcgaggtatggttcaactcgtacctcaggagttgttgcacaaccatggcggttgtctgtagagagctccgggtacaccgtggggatcccgaggaatcggcagccggatacatctcgtggctgaatggggcctgcgcccagctcgaaggcatcggcaagcgtatcaacgaggccctgaagcaggagtgccgtcgatcgagccgatatgccggggggcatgtattggcttgtatacgagatcatcgtccgcagctgcacctcgagttcctccacgaagggttttctcattctcggagaaaccctacggagatagatcacttggcgaagtcgatggcgccgctggcggagaaggtcttccagtccatggactggcgttggccttcctggtagtcttcgtatcctgtgacaaatgttctggacgtagtgtgtaagagtgtcttctcacttcgcgacttcgatcagtcgtttgagttatacactcttcctagcccccagccttgtcatcggagaattcttctcggaagataaggctcttggacctttgacctgcctcggttgaacaggcactgatcctagcccccagccgtgaagttggaaaattaatttccgattacacggcttggttaatacgcacggcgagaactcttacacgaccagatcttacatggtctttcgtctctacaggatccgacaaggccttatcggctctgggcgtcctcagccgaagttcccttaggttcctcggaggccttgtcaagacggcgtaaagggacatgaggataggtttcaacgctaggtgtcatctgggtaaggaatcatcaggaacactttgattctaatctgtacgtgaaaataggctttattggaactgtaagatgtcttacaagtatggatactattgacttatacattgaatttacgtaattgatcaatgttccaggaatttgccaactcgcgaccatcgccgtctgcaatcttgaatgcgcctggctgcaagacttgtgtgatcgtgtacggtccttcccatttgggtgagagcttgtttcgccctgcttggctttgaacccgtcggaggacgtagtcgccgatcaaaagcgtgcgtgctcggatgcgcttctcgtggtaacggcgaagggcctgttggtagctgactgctcgaacggcaactcgttcgcgatgttcctcgagtagattcacattgtcgtttcgctgctcctcctgatcctcatcggaatacttctgtactcgtgtactttgatgtcgtagctcggtggggagcatggcctctgagccgtacatgaggaagaagggtgtctccttgttagacgttgtcagtgtggtacgcacggcccatagtactgatgggagttcttcgacccacttcttgtcatgtgacatgagcctgtcgtagacgcgggtcttgattccttgtagtactatgccgtttgtcctctcgacctgtccattgctctgagggtaagaaaccgaggcgaagcagatcttgactcctagcctgatgcagtaatcctggaaatcggcactgatgaactgggagctgttgtccgttatgatacggtgaggcaatccgaatctgcaaaatatccctttgatgaatttgatggcgttgtcggccttgatttcccccgtgggtgtcgcttcaatccacttagtgattttgtcgatcgccatgaataggaacctgtagccgccctgtcctcgtgggaatggcccgagtatgtctaggccccagcacgagaacggccaagtaagagggatagtctggagtgcttgcgctggtagctttgtgtgtttactgtggaattgataggcttcacaccgctgaaccatgtcgcaggcgtctttgagggtggttggccagaaaaacccttgtcgaaaagcttttccgactaatgtccgaccggccgcgtgtgacccacagatcccttcatgtatgtcgaggaggagatgtctgccgtcgtcggacgagacgcattttaggagtaccccgtttgacgccttcttgtatagatcgttgccgatcatacagtagatttttgctttacgggttattttctcggcttctgcgttgtcctcgggcaactcttcgctgcctatgaatttaatgagtggggtgcgccagttgtctgtggtctcgatatcggcaacggcgtgctctgcctctatagcccccgagctgttgttgaggcgaccgggctatcttcgccgcttgcctctttcactgatcgccttgtcaggatgtctagaaaggttccaggttcgagtggctctcgtctggacgcacgccgtgctatatcatccggctcgatgttgtcgttgcggtatagatgtcgaacctcgatcccatcgaaccttttttctagcttcctgacttctgcgagatacttggataactcggggctagagcacttgtaatctttatgcacctggttcgcgactagttcggaatcccctttcacgaccagtcgcctaactccgagtgcagctgcagctcttatcccggcgagtagtccttcgtactcggctgtgttattggtcgccctgaagttgaggtgaattgcatgcttgaattgatctcctgaaggtgatgtcaagatgaatcctgcccctgctccttggctgttgagtgcgccgtcgaacgccattgtccacgtttcgttgtcgatttggttgtctgacctgttatcaggcatagtccaatcggctacgaagtcagcgagtacctgggacttgatggctgttcgtggcacaaagtggacatcaaattagcttagctcgactacccattttgcaatgcggctgacaacgtctttgtttctcacgacttcaccgagagggaaggaggatacaactgtaaccctgtgggcatggaagtgtagctttcttgatgtcatgattaccgcgtagagcagtttttggatctgtggatatcttgtttttgtgtcgtggagagcttcgctgacgtagtagactggtcgttgcaccttctctctctcgacaacaatgacagtgctaacggaatatggcgtggcagcgatatagagaaacaattcttcattaggttggggggcaacaagtacagggggatttgataggtagcgcttgagtgcaatgaatacctcttcggcttcctgtgtccatacaaatttgtcttgcttcttcagcagagcgaagaaaggttgtcctcgctctcccatcctagcgacgaacctgcttagtgccgccatgcatccggttagcttctgtacttccttgagtcttgtaggcgacttcatgttctcgattgccttgatcgtcttaggatttgcttctattcctctgccagagacgaggaaaccgagcagcttgcccgatggtactccgaacgtgcacttctctggattgagcatgaggcgatatcgtcggaggtcttcgaacgtttcccgcagatcgtcaatcaatgagtcgcttgtcttggtcttgacaacaatgtcatcgacgtaggcctcgacgttgtttccgagttggtcgctaagtgcgccctgaaccgtgcgctggaaagtgtttcctgcggttattagtccgaacggcatcttaacgtagcagaataccccgaacggcgtgatgaatgctgtcttctccttgtcctctttcgccatgctgatttggtggtaaccggagtaagcatcgaggaagctcaacgactcacaaccggctgttgagtccaccagttggtctattcgaggaagagggaagtgatccttgggacacgccttgttgaggtcggtgaaatcgacacacattctccatttcccattggccttccgcaccatgactggtttggctagccactctggatagagtacctctctgatgaaaccagctttgagaagcttgtcgagctcttctcgtatggcttgttttcgatctggtgcaaatctccaaagtttttgctttactggtggcttggcgtcgggtcgcaccatgagtttgtgctcaatcacctccctgggtacccccggcatgtcggacggctgccaagcgaacacgacagcattgtcgcggaggaaggtgatgagcgcgagttcctatttctcgcctagtgatgccccgatcttgacagtcttgtcggggttggcactggagagtggaacgatcttgattgcaccgtccggtttcggcttcttgtttgtcttgctcactttcttgggtggctcagctgtggcaggtgggctgggcgtgtgctcgaccatgtcgaggctccgcttgtcgcattgcactgccagcttagcattcccttgaatagtgattgttcccttcggtcccggcatcttgagcacttgatacgcgtagtgagatgcggccatgaactttccgagtgcagttctcccaatgatggcattgtatgttgtatcgaattcagcgacatcaaaggtgatctgctccgttcggaagttatttgattggccaaaagtcacaagcaacgtaattttgcccaatggtttggacgatgactgaggagtgattccatggaagggttgatcggtgggcgtcaactcacttcgtgggatcaccatcgtgtccaaggtgctggtgaaaagaaggttaattgagctgccgccgtcgatcagaactctcgcgaccttgatattccgaatagtgggttcgaccacgatcggatatcaccctgggatgacagcagtcttggggtggtcctcttctgagaattctatcttctgttcagaccacttcatcttgggcgcagctccctgccacgtcgaacagacttcacgttccactttcttgtattctcgctttgaggagtatgccgtggaacatccgaagatgtgcgagacatggaaatcgcagtctgggtatgctgagtctgattcctgagtagccgcctcagcgtccttctcgaccacacgtactcgcttgcctttttccaatgccatatgttttgcgagcgactttttgaagacgaggcaatcttctagagagtgtctgtcagacttgtgtatagggcaccatgttttcttcgtgtcgctgccttgtgggtctgggcgcttgggacggtccgcgtattctgttgcgagaacttccgcttgagctttccttttcccactcttgtgatttttcttcttgcttgagtcaggtgcgtccttggctggtttcttctctcctccggtcttcggtttgtcgttcttgcgtctcagagcatcgtccgcgtgagcgcatcgatcgacaatttcgaattatctccgagtagtcgtgacgcgcctcgttgccaactcctgggtagtatagcgatctctgacaccggacttgaaggcgcggattagagaagcgttggtgattttggggattgtatttctacactcattaaagcgccgaacataatccctcaaggattcacccgggttctgtgtcaacgcatgtaggtcgtcttcaattgcgtggcgcttgtaaattccttggaagttggcgacgaactgctgccacaagtctgcccacgaagaaatcgagtagggcgggagatgcatcagccatgaatgtgcagagcctttcaatgcagttggcaaataattcgccaacgcgttgtcgcccgctccggcagtgtagagtaccgtggagtaaacctgaaggaattcttctgggtcggtactcccatcgtacttctctattgctcctggtcggaatctcttaggccatcggacatcacgcagcgaacgactgaaagctctacacccagcgctgggggtggtgggttgtcggcgatcatacgtccttcgtggatgtctatctgatgatgaggatgaggaagatgacgacgatgacgatgggtcacttggttccggtgtacgattatgaggacgtcggccgggttctcgagaatcctgtcgtcgtctcctgttgttgtcccagcgccgatctccatcgtcgttgtcattatggcggcgtcctcgaccagtattgcccagaacccgccgttcgcgatcatcgtgatcgtggcggttgtggcggttatcacggtctcagtcttcgctcgaacggcctcctcattcttcgttatcgtgacgtcgtaaagagacgcgatgtcgggaacggttctcgttgtctcgtgcgcgtcgcgcctctcggcggccattcaggtgatcgtggagatctccggtgtcgcgaggtgaaggggtggctcgatgaggtaattcccgctgttcagggttttcgccatcagcaccgccagttggtggctgttccgggtgcgctgcagcagcggcctcttcgaacgtgttgctgaggttggtcactgattcccgtagccgttctgtccaccgtgcgagatcatcgttcaaaacgggatcgtagggggtttccctcagtattgcgttgacggccctgatgtgttgggccggtgtagtcacttgattttccgcttccgcattagcgcgcgctgacgtgccggtcccgtcgatagccaatacctcgcgtggcgtacttgtcgacgatgagccatagtcttcgagcaggtgtagaactgacggctcgtggggatcgatgtcgattacccccaacgaatcgatctgagatcagcgtcgctccttgttccttgtcctcatccctgagggggatacgtgactgctggaccttaggaggtgacgtcttcatggcgctgagaaagaccttgcagcttgagaggtcgtgattctttgtcttgtgaataggacaatagacatcacgagttggagaagtacgctgaattccacgctctttgtaggcacgaatttcagcgtggacgttgagaaaaacccagcaggcttgcaaggtgtgttttttggttttgtggataggacaccaggaccttgtcacctcggaagtcatcctcgtcggctcgtgattcttgtcggaaagacaaggtttggccgcactaggatccttctcgggctcgaatgtcgtcgatgttccgttctccgcttcggcgggaggatccttcgacatggagttgtcctgggttgtagccactgcgttctcgcttccggtcattgatggaccagccaagatcggcaccgtggtgtaaaccgggaagacgatttcgccgacttgagtccgcaccagcattgttgaagcaggaactccttggttgaggttggtgttgacgctgttgtcgacgaagctggatgatatagtagtagaaccttgagcaccaagtccccctaccgggcacgccactgtcgacgggggatacccgtagaccggatgtagagggtactggggtacgctggtacgaggatctacgtaatatgacatcaagcagacagaaaacaaagattatactggttcaggccccttgataggtaatagccctaatccagttgatatgggattatatgatggaaaccacagattacagagggaaaagcagaactcgatgataccgacgaggtcgtaatcgaacaggttcgattagatctcccgacgacttggcttctgtaggcttcaactccgtaggctgtggtggatgtgttggctatgagattcgatcccttaggtcctcccggggggtcccttttatatcgcaggtcagctggtctccaagtaggactcggagacatcggacccagcatgatacaatgatgacccagtcccatccgagtaggactccttccatctgtgaactccatggcgaatttccttaacgcatgccgaaaatgtccgtatacgcgcaagtataccatatcgatacgtgacgtatatcgaagggtagagggtataccttacccgtaaccttgacaggcaccacgtcccgtccaccgccgcgccagagccgcgcggaacgcgatgctcgcgccggcgcggctgccgatcaggaacaggggcctgcagccgggcgagcccgcggcgtacgagcgcacccaccggaccacgtcggcggcgtcctcgaacgcggcggggaggcggtcatctgcgggttcgtctcggcgtgggtgctcattgggctcaacgcgctagcggcgaggctcaaattcgacgacccgctcgagaccgcgtagctgcacagcgagtgcggcgcgttgggcgtcatcttgtgggctgttcatgggcagtggcggcggccggctgctcggggcacacatagtggtcatcctcgtcatcgtggcgtgggtgagcttcaccatggcgctgctgttcctggtgctcaacaagctgggcttgctgcgcatctcagccgaggcacaagatggctggcatggaccaggcgcaccacggcgggttaccatgacgacgacgtgagtggcaagccggaccgcggcatcggcgggttcatgctcaagtcggcgcatggcacgcaggtcgccgccgagatgggtggcaatgtctagtggcatggaggagctgagctagtaatacacacatgtagcatctgcggattcatcggtgtcgacggaggcgatgaccgcggggatggtggccgtgagggccgtgcaggagttgtggaacggctcgaacaccgagcagaagaggacatacccaccagatctgctcgatggagagggaggggaaagcgattgcggtgtccatcaccggccacgcttgccactgccattgccggtctcgtggaagagaggagaggggagaaagaggaagaagaagaaaacaagggtaatttggtcaaaaatttattgtaaatgcatctcagtggcatatctcaatatgtgcaaaattataatggtatgatccaaattcacaaatactgatggcatattttaaaactggcatatttttaatggcaatgtatctaattaaccctatcctatatagggcgcgttcttaattcttcatcaagcatatatatgcatgtgaaactgacactgaagatataaattaaatgttaacaatgtttctagaatttacggacgttgatgacttattggttcctagattaaatggagagagctttcagaggagaggagcggtgattaatttatggcatcattttaatttaagaaaaaaacaataaataccattgacaaacgccaaaatttaagaaataccatcgacgaatgcgagtttcataaaatgccattgtacaaatgattttgttccagaaataccatcatcgtcagggttccgtccatcccgcgcccttaaatgtgatgttcatcctatatcgcttaacagagggatgctagcaaaaccctaacagcgatgatatttttggaacaaagttacttctacgatggcattttatggaactcgtacttgtcaatagcatttcttaaaactagcatgatgcgtgtgcgctgcaacggcattttttttctatttgtctaatatattatcattgtgcttgtctgagggtgagctcctccaccagggaaccataaggcacccttttttttagttttggcctagggcggtgattgaagttcgaggaatctgtggtgaagtatgcaggagagggggtctaacccctcgggggaaagacaatggtggtttaaacaggttcggaccgctgagaagcgtaataccctactcttatgttatgctgactgtgagaaagagattacaagatttccttgttggagtagaaggtgtttatcatgaggggcaggagactgctctagtgaaaaatgtctcatcccctccctcataaggccaggacctctttttatatctcaaggggttaccacagggacccgccgagcctatctagggaggataatcacattgattgcaagtcttgttccttgcattggtagtctcttacacgccttgctgcgccgtcgggcctgccgaatctatccagctgacacgggcgatgcgcttgtcactcggcatttaagggatgaggacttttcggtcctcatttataccgggaagttggaaccctgccctaaacgggttaggcaaaccgtctccggctgacgtgagaggctaagctgcctctcaccatcgtgatgtgacggggtgagggggggtgttaggcggctggccgcctgacatgcagccagggggcaggcgcactaccccggccacatcagtcatttgaccggtcacagaccagtctgtcgcaccacgccgcattaaatgtaacacgtggggggaggggtgctcgctcagaccacctttagtgctgttaggtgggcactaggagcgcccgccaggcgtggcacacggtgccacgcggagggggttggggtgacctgacccctggacacgtggggaagggtcgccgccctgcctcgggccgaacctccccgggggaaggccacatggctgttaggggcaagcccttcctcacagtatgggtaccccaggcccatattaccgacagtgctaattttgctatcatttcgtaaagataaaaaaaattcataatattatattgtcatattattctttcgacgaggtttatgacatgtgggggctagaaaataagcaaagttttgtgggtcccacatggtagttgggtggtggtaatgacagactcaccaccaccactaccatctttttatcgcagtgttcggtaggccggctgcagccgcggctgcgcacagtgaataaggcattgttcgtgccgcagccccgacaaccgaacataccctatattagtatataaagattggacgtttgttaataaaatttctttggattttctcttttaattgagtgtgaatcccatcataataaagtgaagatgggctagcagagtatctaatgctccgatttaattgaatggtttatatcacacatattttcttttctattggctggaataatacggatgatgtggccgtacctgatcatagctaattgggattcttatatactctatctgttttacaatataagactatttcataatataagactttctgctattggccatatttatatagatgttaatgaatctagacatatatatttgtctatttattaatagctatatcaatatgagtaatgatagaaagtcttacattatgaaacggaggaagtagaatttatttatatatcgctgaatgtacgttaactagtttcagcttaattttttataacttgtagaaattaaatttgacatgacatatttgtgaagtgatatatctcatattaatctatcttgatattttgttttaaaaatattatttaggtgacatgaaaaaacgaaggaatgtgccctcgagacataaaaatccatctcggcaaattttccctaacacgccaacttgcaagattttaatcaaacaaattttagatgtatttaagtatcctgcaaaatgtaacatttatcccaaattgcaaagatcctgcagcaaatgttagtttttttagtagcaattaataggtaaaaaataaccgtagttccttaacagcgacatcatcaagaaaaaccaataactaatatcatcgcatgattaggatttaccaaaccattttagatgtaattacctaacccccacagtttaacaaacagcttaccatgtagtataccgtagtttcaaaaaccgaaaaagttaccacacacaatggctgtgataacgggggatgctaatgcgcgggtgatcacccgcacccccccctccccctatacgtcctcttctccccttttctcctccccttcttctctttcctactacagtataccacaaatttttttttaataaaacaaaagttagaaaaatttatgtaaatatatattatatataaaaaatttgaattcaaattcaaatttgaatcgggtatgtaaacttttgacttataaactttggatctataaattttaggtgtataaactttagatgtatagaaatactatgtatagaaaatatttgaattcaaattcaaatttaaatcagacataattcaaattcaaatttgaaacgcgtatataaacttttgacttataaactttatatctataaactttataaactttaggtctataaactttatatatattagaaatactatatataaaaaatatttaaattcaaatttaaatttgaatcggatatataaacttttgacttataaacttttggtccctgaactttagatgtgtaaacttgaggtgtataaactttaggtgtataaatttactaaaatagaaaagtaatgcggtgccagaaaaaaatcaggtgggcgaactgatcgctaccagatcgcccaggcgatcgatcgcgcatcagcttttccgtgtgataaccacgtgataatcgtacaaaagtacacgcagaagaactagacaagccagaacggcgtctgacgaggtgcacccgggagagactcaaacgtgtcgaaggtctcgacgctgccgtcctcgacgctgaacacgtacaggttcctcttctcgtcctcgctgaagccgttgatccagtagatgcggttggccttcaccccgcacccgctcgccgagcacgacgcgccgctggagttgtcgccgccgacgaggaacgcccggtcgccgatgtccgtcgccctgcgccacgccggccccggcgccgccgccgagaagtccatccggaacacgtggacgtcgtacggcccgccgatgctgtacccctcgaaggcgatggcgacgaggaacaggtcgccgcgcgactcgacgaggaacgtcagcgagctggacatcacctggccggcggggaagtagtccaggacggggatggcgatggcccccaccaccgcctcgccgccgccgccgccgccgccgccgccggtgaagtccagcgtgccgagctcgcccttgttctcggcgaag

SEQ ID NO: 64686 - DNA, 739 bp, Oryza sativa
attttggtaccttgctcctttgttagctcgggttataacatgaatagattttggactaggagttgcttagccatgcttagttcaactagcacacaatggggaaatctcatttaaaatatagactgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccggattcacctaggtatgagaggggactgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagactcatcttagtttagtctaatgaaattggatggtataggggtaccgagctcgaattcgccctatagtagtc

SEQ ID NO: 64687 - DNA, 1519 bp, Oryza sativa
ttggaatatgatatattatttaaaataaatgctcagctagaatcctagaaaggctaagaaattcttgctcgaaacaatatttgaacatggctgaaactactatttcttttctaaataatgttgtgttaaccgacactggttgacattcagcaagaacattcaacctttcatttgatgttccttaaacacaggtcctgattctgaacgaagagagcgaatcacgaattgtaaagatggttttgcctctcacagaagcctgccaaggaatggaacttgtttcagggcttagtgacccaaataagcacaaacaaagtgctcttgttctcttgttgaaatctggtcaaatttgcttatatgatgattcagagattgagcgctaccttcttcatgctcagtcaagatcgccactagcacttccaaactattcatctgtgaagctaccttatggtgatccaagcatcaccgctgcaaagttttataccagtagccctacagctgcgacttctttggatgaggcatgtatagatttgtaaattacacctatcaaacaactatgaatgctttgaccagatagcgtttttaatgggctttgaccaaatagcttcatattttgatgatggacaggactatttttcatcattggccaccaaatacccatggttcctttcaatgaaagataaacatcagacttccacaggttctgccgacattcataagaccagaaatctctatgtaactggacatcttgatggaaccataaggttttgggatgcatcatgtcctcttttactgcagaatttaatgataaagcaccaggtgacttaaaactccaattatttttgctggccactctctaattatgtattttgctgaaaattctctagttatgcattttgcacacaaattactacgttttacttcgttctaacaactcattattgttattgtttcagaatgaagagaatagtccaagtggcacccctattacatcattacagtttgatatgtcatccagcattctaatctgtggggataggagtggaacggtaagctatttcatggatataaggtgaattataatatggttttaatacacttccagtgcagtaaaactttttttcttcctgttaggtccgtataatcacattcagaaaggactccagcgataacatattctcctttttacatggtataatttactctctgtcttgctaatatcaacagttggtgcttgccttactatgtggttaggtgttcattgtccaaagaatttgcactgcgatactatctatgctcgtgctagctacataatttactccatcagttaattttgtggaacatggaaactaatggaaacatgtccgatcttagaacttcttgatttcaccatctggtccaaatacctttgttaatggtacctttaacatatttttcaagtgcttgtatgttattttaacacattcatcttttacatggactggtcagcgaagcaaggggagagctataatgtcagatgtat

SEQ ID NO: 64688 - DNA, 14857 bp, Oryza sativa
ccagtgagctctatagagtgctcgtcatggcttcgccggcgtcggtcgccggcggtggtgaggatagcaatggctgcagcagcctcatcgacccgctgctagtgagccgcacgagcagcatcggcggcgcggagaggaaggcggccggcggcggcggcggcggcgccaaggggaagcactgggccgccgccgataagggggagcggcgcgcggcgaaggagtgcggcggcgaggacggccgccggccgctgctgttcaggtcgtacagggtcaagggctccctcctgcacccgtacaggtacgtacatccgatcgagtgtacgatcgaaaaatcagcgacattgcaatgaaaatctttttatgcataaagattattattagtactgagcttgctagatacagaatctggacgctatacttttgttacttcctctgtataagttattttagtatttcccacatttatcttgatgttaatgaatctagatagatatatatgcttagatttattaacatcaatataaatgtggaaaatggtagaatgacttacattgtgaaacgggggagtatctaaaaattagttaagccgggaatgtatgcgttttctagttggtagaatgaagtatatatatatgcaagtcaatgagcacgttgatcatttggatggatcgtgagtgatatatattctgctcccggatttctttcagtgctaatccgttgactcgtagtaacccacagtacggcctcatgtttccaataatgtctttgcagcttataattggatcaagaatatttaccctttctggtcacctgggcatgtgcatttacttgcatttctagaaataattgtttttaagataataaataaaattcagccttcgtttcaatagaaattaactacagtcggatcatgttttttttaatctcttacagggctctgatctttgcacgcttgattgccgttctcctcttcttcggatggcggatcaggcacaataattctgacataatgtggttctggacaatgtcagtcgccggtgatgtttggtttggtttttcatggctacttaaccaactcccaaagttcaatccggtcaaaaccatacctgaccttactgccctaaggcagtactgtgatctcgccgacggaagctacagacttcccggcatcgatgttttcgtcaccaccgctgatccaatcgacgaaccggttctatacaccatgaattgtgttctctctattcttgcggctgactaccctgttgataggtcagcctgctatctctctgatgatagtggagcattgatcctatatgaagcattggttgagacagccaaatttgctactctatgggttccattttgccggaagcattgcattgagcctagatccccagagagctactttgagcttgaggcaccatcgtatactggaagtgcaccagaggagttcaagaatgactctaggattgtgcatcttgagtatgatgagttcaaggtgcgattggaagcacttcctgagactattcgtaaacgatcagatgtttacaatagtatgaaaactgatcaaggagcaccaaatgcgacttggatggctaatgggacccaatggccaggcacgtggattgagccaatagaaaatcacaggaaaggacaccatgctggaattgttaaggtacataactccaccttaattttttttctaatgtattactaaggggataatatcatattgtgcaatccgcaattaccttgttaagtggattcaccataaattttccattaacatgacctacatatttgtcaatttgaacaggttgtgttggaccatcccatccgtggccacaatcttagcctgaaggatagcacgggcaacaatcttaattttaatgccactgatgtgcgcatcccgatgcttgtctatgtgtctcgtggaaagaacccaaattatgatcataataagaaggcgggtgcattaaatgcgcaacttcgtgcctctgctctactctccaatgcacaattcatcatcaactttgattgtgatcactacatcaacaattctcaagccttccgtgcagcaatttgtttcatgcttgaccaaagagaaggtgataatactgcctttgttcagttcccacaacgctttgacaatgttgacccaaaagaccgatatggcaatcataatcgtgtattctttgatggcacaatgcttgccctaaatggtctccaaggaccttcataccttggtactggttgcatgttccgtcgcttagctctctatggtattgatcctcctcattggagacaagacaacatcacacctgaagctagcaagtttggtaactccatactcttattagagtcagtgttagaagccctaaaccaagaccgatttgctacaccatcaccggtcaatgacatatttgtcaatgagctggagatggttgtgtcagcttcattcgacaaagaaaccgattggggcaagggtgttggatacatatatgacatagccacagaagatatagtcacgggttttcgcatccatgggcaaggttggcgatccatgtattgcaccatggagcatgatgcattctgtggcactgcacctataaatctaacagaacgtcttcaccaaattgtacgttggtctggtggatccctagagatgttcttctcccacaataacccacttattggaggtcgtcggctccaacctctccagcgtgtctcatacctcaatatgacaatctacccggtgacatcactctttattttactctatgctatcagccctgtgatgtggcttatccccgatgaagtatatattcagaggccattcactaggtatgtggtgtaccttctcgtgatcattttgatgattcatatgatcggatggctcgagataaagtgggcagggatcacatggttagattattggcgcaatgagcagttcttcatgatcggctcaacgagtgcttacccaacagctgtgcttcatatggtggtcaatcttctcacaaagaagggtatacattttagagtcacttcaaagcaaacaaccgctgacaccaacgataaatttgctgacttatatgagatgagatgggttcccatgttaatcccaacaatggtagttttagttgctaatatcggtgccattggtgtagctattggaaagacggcagtatatatgggagtatggacgatagcacagaagagacatgctgcaatgggactcctattcaacatgtgggttatgtttctcctttacccatttgcactagcaatcatggggagatgggcaaagaggtcaatcattcttgttgttttgttgccaattatctttgtaattgttgcccttgtatatgttgctacccatatcttactagcaaacattattccattctaggtgcatagataaaagattgtattgtttaacttttgtaataaataatattgttcttgaactaatccaattgtgtcaaatatttttggacttaccttatatgagaactttcatatgtattaccaactgtctttacatattcatgtcatatatattcttcatattgaacatatagaaaaatcacttgagtaaatagaaaagcgagtggtttacatcttaggatgttggtaatcggtataattggcaaggatgcgtcaacctctttaatataactttcttggtgaactttaaaaagaccacacttgggctatatctatatgaatacggtggaccgtgaggtttaacactgaaaaaatgctaccactgtagatgcatgctaccattcaacaagcatctaactctgagtctgttcaattttacttctttggacttcccttatatgagaactttcatatgtaccatcaactgtctttatatattcatgtcctatatctttttcatattgaacatatagaaaaaccacatgagtaaatataaaagcaggtggtttgcagaaagaaatttaaaaatatactgttcatttatttttttaacaaaaatattcgggatacaattgttttggcagaaatatacgtccgatctcacacgatcgttgtgcgaaaatgatgtgggtatgacgatacggacggtatcgcacagcaatggtgcgagaccgcacggtctcgcagatgaaaagagcgagaccgaacagtctcgcgaaaggaaagagcgagaccgaaacaatgtcgcataatgaaacagcgataccgaatgtgttgtccaatggtttcgtttaactagtgattgattaccataattagtgattaattaatgatgattagggattaattagtcgctaatcaatgtgattaaacattaattattggccctgtcgcagccatgccgtgcggtctcgcacaagcaatgtgcgagaccgtacgctctcgcggctaaccaatacgaaaccgtggcgcatcgtcaccccacgtcattctcgcatagtggatcagcgataccgtatcgttttcgcgctttcatccagcgacgatggtatacttttgtaaaaaaatttgtatcccgaatgtttataagaaaattataaataaacaatatatttttaaatttaattcgtggtttgcatcgattttaggatattggtaatcagtagaacatgcaaagatatgtcaccctcttcaatgtaacttctctggtaagttttacaaagatcacacttggagtggatctaaatgaatacggtggaccgctcaacactgaaaaatgctttaccattcgacaagcatctaactctgattatgtttgttttttttccttagaaaggaatttgaattgttggttcaaagcagacaaaagtaaaatccaatatatctgtctatgctattcggttttgatttttttttcacctttctagttctccagaacagaatttagaccgctatttagaaatacctattactaactctaattaaacaagttacaagaactgtgcaataatgacaaatcaagtggtgtagctttcatgtgtccaattctgctggtaaagaatctgatgaactgttaaaaaaattagatgtctaaggacaccaattataaagtgttaaataaaaagaacgagagtatgtgtgtgagtttaggcaggtttaggaagcacacgaactgattcggagcaaattgcacttagttaatatggatttgctgaaacactatattcaacgggcatgatttggtcagaaattacggactaaagtacagacttctctcttttcttttgtgctaacccttcctcagaaaaacttaaacaactccgctggttctttccaaagaaacataaataaactaataaataactcaaatggaacatctcagttattagagtatcttcccctcgaaaaaaagttattagagtatcagtgggcgagctcgtcagctgctgatttcatttcaccgttgctatccccatcaagtttggctgtccaccacttgatcactgtctcatatatactcgatcgatgctctccttgacctctctcccttttatttttcctcccctctgaccagcacggcagctaggtacgtacacatgttttaactctgtcttctcatacaaaacccggcaatattttttttgaaaatttgagcttacgtacgtacgttcgtacgtacgcgcttgataacatcatcaggagttcagaactcagaaaggccaacacatgcgtgcacaattttgggcataatccatgcacttgtttcgatatatatactagtagtaattagtaacaacttgagtacgtactcggttcggttttttgttcgtgtccaagtggacaacactatgttctcccgtacctttcgttccagctgtttttatgattttgacgtggaagctgcagcctatctctatcttttttaatcacctgagttaatcatcaagtgaatgatcactcgtttattacacataaactaaggtgattataacttttttaaaaaaagaacgacaagaatgatttatatgaaatatattcctttctctatctcaagatataatggattttgaatggatgtgacacatcttaatagtacgaatctggtcacctaaaatataagagatttaggatggatgagacacattctagcattacgactttggaatctggccaggttcctgtccgaattcgaaatattagaatgtaccccgtccatcctaaatctcttatattttgagtggtcagattcgtactactaggatgtactgccacatccatctaaatctctaatagtttttgaacggaggaagcattcaacaagcatatattaaatttaaattcaactagtataaattgtaaaaaaaaagagacaaatttgactacaaatatattacttagagtttaatttgttataacatgttgaatttaaatttgaacttatatgtttgtagagaatgatatattgcatattaatttattttgttaggtactccttccttattgtattataaaatgttttgattttttttaagtcaaagcagagtttatagaaaaatgttgaagtattttttttataaaaatgtatcaaaatatatttaatgttagatttaatgaaagatgttatagatgttgctactacgtttattccacaatataatcaaattaaagaaaactaaaaatgtcttgtaatataaattagatggagtaggtctctactgttgctggtgcagatgtacacgttttatttttccttgtttctgaagatgtcacacgatcagctgacttggctgctagaggagaaccgagaatctgtagtttctgcgcccgactggtgaccttgtgccggtggtttttgatcgccaacacgacgatcgttgccgagtttgatcgaaagagaggaacgaaaattacatacgctgcagagaggaaaaatgctcatcagcttgctgcactgtgacagtggcggcttctcttgtaccacgtaggtagcagcagtattttgaccaggcagggtgagacgatgatttaattaaactcatgtcgtttcgccgcgctatataagccaccacgatgtgttcaccagttcgccacggagcttacgtagttagctaggtgcgtttgcgtgcatggagttggctacggcctccacgatgtccgcggcggccgtgactcgccggatcaacgcgggcggcctccgcgtcgaggtcaccaacggcaatggcgcggccggcgtctacgtggcggcggcggcggcaccgtgctcgccggcggccaagcgggtgaacgacggcggcggcaaggatgacgtgtgggtggccgtcgacgaggcggacgtgtcggggcccagcggcggcgatggcgttcggccgacgctgttccggacgtacaaggtcaagggcagcatcctgcatccttacaggtctgaccgcctgggcccacactgatgtcaaatactactaactactcttataaacttataatcaaacttagacaaattaattgcgaatcaataaagtgtgattaatttacagcattcattttggttgcccttatgctgttctctaatatacgaacaggttcttgatcctagttcgactgatcgccatcgtcgccttcttcgcgtggcgcgtacgccacaagaaccgcgacggcgcgtggctgtggacaatgtccatggccggcgacgtctggttcggcttctcgtgggcgctcaaccagctcccgaagctgaaccccatcaagcgcgtcgcggacctcgccgccctcgccgaccggcagcagcacggcacctccggcggcggcgagctccccggcgtcgacgtcttcgtcaccaccgtcgaccccgtcgacgagccgatcctctacaccgtgaactccatcctctccatcctcgccgccgactacccggtggacaggtacgcctgctacctgtccgacgacggcgggacgctggtccactacgaggccatggtggaggtcgccaagttcgctgagctgtgggtgcccttctgccggaagcactgcgtcgagccgagggcgccggagagctacttcgcgatgaagacgcaggcgtacaggggcggcgtcgccggcgagctgatgagcgatcgccgccgcgtgcggcgagagtacgaggagttcaaggtcaggatcgactcgctgttcagcaccattcgcaagcgatctgacgcgtacaacagagcgaaggatggcaaagatgacggtgaaaacgcgacatggatggctgatgggacgcattggcccggcacatggtttgagccggcggagaatcaccggaaagggcaacacgctgggattgttcaggtacgtaacgtacgcatgaagcgagaatttattccttttccaatatctaaagacagagttattgcattttagtttctgtttagggcatccacaatgtgaccataagagtgagccttaagactttttttcagctatatacattgtggacatggacataagacattaaatgcttaaaaacagctctaaccttacagttgaacttaagagattaaaaaatgatatctaatggagcctatcagcatatgattgcgaattggtggtatgtttcttctttgatgggacccagtgggacccggcttgtttctcatccaaggccataaccattgtagagatagatatagctaaagctatctgctcattcagcaacccaacattgaggttgcccttataatcttgttctgacgacaaattttgtcgagtggagatggactattgttcatagagggacgtgtccctcgtctcgtttagtgcatatcatttaaaaaaacattaaactttttttttagaaaaataaataagatagatcaatatgtgacatattattccacaaacacaccagttcaaatttagtctatacaataagaaataaaagtaatagatttgactaaaaattgcacgttctatttagaatcaatatattttgttatttttgttttttcttatataagttcagtttaaacttgcaagtatgtaaaatatcatatcccatattgatctacttacttaaaaaaaactagctaaggcccctacattgcaacaaatactgtaagagataaaagaaaacacaaaaaaaaatacaagtttatagcatagttaatggattagaatataatgcaatatctaaaaataatatttacgtgtggaccttatggtcacatggcagcttgtaacattaacgacaactagcatggcggcccgcgcagattgcacggctagcattgttagattttttttctcatacaatagtttaaatattttcatattttattattgacaacataattttaaattcttggttgaactaacaaatgtgtgatatttttattgtattgtatatatgtgatagttatttataaattatatttctatatggactcaagaatcatattttaacattccttattttaaattttgaattttctttgttcataaattatattcctatatggattctggactactcttccaatattcattttttcttagctctgaattttagttatttataaattgtatttctatatgaactctaaactcttctttcaatattttttttattttgaatttcaattattagtaaaccgtattcctatattgactctagacttcttttctcaatatttttttaattttagttatttctaaattgtattcctatatagatgctggacttttttttcaagatttcttatttgttaattttgaatttcagttatttataaattgtattcatatatagactatgacacttctcccaatcttactttttttaattttgaattttattaattctaaattgtatttctatatggactctaacttctaattttagttttcctattttttaattccgaattttaattaattctaaattgtatgcttgtatggactctagtatactctttcaatattcattatttttaattccaaatttcagctatttttaaattgtattcctatatggactctactttcgaatttcctttgtttataaattctattcctatatggattctagactactcttccaatattattttttcttaactctaaattttagttatttataaattatatttctatatgaactctaaactcttctttcaatattttttagttttttaattttgaatttcaattgttggtaaagtgtattcctatattgactctagagttcttttttcaatatttatttttttaattttagttatttctaaattgtattcctatatggacgctggacttttttttttccagtattccttatttgttaattttgaatttcagttatttataaattgtattcatatacggactatgaccttctcccaatcttaatttttttaattttgaattttagttatttctaaattgtatttctatatggactctaacttctaattttagtttttctattttttttagttccgaattttaattaattctaaattgtaggcttgtatggactcttgtctactctttcaatattccttatttttaattctgaatttcagctatttttaaatagtattcctatatggactctactttttatttttcttcgattaacgtgggaatttctaagccgtgagagcaaacatggtagcttctttttctattactttccatctaggctcttttttcatatattagaatttttatttctctctaattcatgtgaaaatttttagtctatgagagtggtggctccttttttatttctatttctttattaagataatagattgagtttgccttcttgttttgatatcgtttcagctctatggtattttagagcatcagttagttgctattttcctgaaacacttgcttttatctcacaatttttttcatcgctaaaagtcggattcgtacagagtttcatcactattttgtacttaatctttttttcctttttttttgttgcggtggattgtggagagaagatttctagcgtactatttatatattaccatggcatgtaatttgtgtacaattcagattgcatgaatctgacgatgatttttttttagtctgtcttttattagtgtctcacacggttttcaaaattagtgtctgatacgttttctaaatcgaaagaaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatagatataatagattttagacaccatcactaatatcttttaatgcagtataaatataattttttttaactttgaggcaacatgcacaacctagacattccctccgagaatataatagactttccccaaagtgagtggttttctttgtgtttttgacaggttttactgaaccatcccaccagtaagccacggtttggagtggcggcgagtgttgacaacccgttggacttcagcggcgtggacgtgcggctccccatgctggtgtacatctcgcgcgagaagcgccccgggtacaaccaccagaagaaggccggcgccatgaacgcgctgctccgcgtgtccgcgctgctgtcgaacgcgcccttcatcatcaacttcgactgcgaccactacgtcaacaactcgcaggcgttccgtgcgccgatgtgcttcatgctcgaccggcgcggcggcggcgacgacgtggcgttcgtccagttcccgcagcggttcgacgacgtcgacccgacggaccggtacgcgaaccacaaccgcgtcttcttcgacggcaccacgctctccctcaacggcctccagggcccctcctacctcggcaccggcaccatgttccgccgcgccgcgctctacggcctggagccgccgcggtggggggcggcggggagccagatcaaggccatggacaatgccaacaagttcggcgcctcgtcgacgctagtcagctcgatgctggacggcgccaaccaagaacggtcgatcacgccgcccgtggcgatcgacgggtcggtcgcccgtgacctcgccgccgtgacggcgtgcggctacgacctcgggacgtcgtgggggagagacgccgggtgggtgtacgacatcgcgacggaggacgtggcgaccgggttccgcatgcaccagcagggatggcgctccgtgtacacctccatggagcccgccgcgttccgcggcacggcgccgatcaacctcaccgagcgcctctaccagatcctaaggtggtcgggcggctcgctcgagatgttcttctcccacagcaacgcgctcctcgccggccgccgcctccacccgctgcagcgcatcgcctacctcaacatgtcgacctacccgatcgtcaccgtgttcatcttcttctacaacctcttcccggtgatgtggctcatctccgagcagtactacatccagcagccattcggcgagtacctcctctacctcgtcgccatcatcgccatgatccacgtgatcggcatgttcgaggtgaagtggtcgggcatcacggtgctggactggtgccgcaacgagcagttctacatgatcggctccacgggggtgtacccgacggcggtgctgtacatggcgctcaagctcttcaccgggaagggcatccacttcaggctcacgtcgaagcagacgacggccagctccggcgacaagttcgccgacctgtacaccgtgcggtgggtgcctctgctgatcccgaccatcgtcgtcctggccgtgaacgtcggcgccgtcggggtggcggtcggcaaggcagcggcgtgggggttgctcaccgagcaggggcggttcgcggtgctcgggatggtgttcaacgtgtggatcctggcgctcctctacccgttcgcgctggggatcatggggcagcgggggaagcggccggcggtgctgttcgtggcgacggtgatggccgtcgccgccgtggcgatcatgtacgccgccttcggtgcgccgtaccaagctgggttgtcaggtgtcgcggcttctctcggtaaagcggcgtcgctgaccgggccatctgggtagggacgacatgagtccggatttgaatttgatgaatgatctcgcgggggtaataatccgggtgttcagatatatctcgttacgtcatgagggcggcagctgattatgtgctagtctactctgatcgagtgagacttgaattattttttaaaatgtgaagacttgaattattttattttattttatttgttcagtgtgatatgttggcattaaattcatggagaactttttttttctctgtgttgttttttcttaaagagtactcctatatactgctataaatatagatgacacaacattacaagtttaattaattaagtttaagtaccattttagtgtgttatatacactactagtcacatgcccatgcattgtaacgaatctaaaggaaaaccgatgaatgggtatgggttcacaatttttaagtcatttttaatactttttcaattcgagtaaaattttgtaatagaacttctttgtttcattatttaaaaattcaatacttttaacataaattttgaaacttttaacttaaaatttagaactttcaaattgaaattttaaaaacactaacccaaattagaaacttttcggctcaaaatttgaactattataaacacgtaataggaaaaaaaactttaaaatgttccatatatgttgggcctacaagtctgcagggccatggaaaggcctggagcagaggcatagatgcgtcaaataaattttccataggagtaagtctattttgcctttctcatctctggttgttgattgaatcacttccctcaatcacaaaaccgggtaaaatgactcccccatctttaaaaaccggtgcaaatcagcttctttggtggtttggaaggtgtttttttgctcatgtagcatattgaccatggttgactagctaagtcagcgggtgggatccacatgtcataaaaatctcatatacttttgcccctctcccttccccctctctcttgctaggcggcaaacgatggcggccagcatcgtggggccctagctcgtagccgctgaagggctagcgcggggtgaagacggcatcaagggctaagtgggagggtagggatgaggagcaggtcacccttgacgtgggaggatggaggtggaaggatggggaggagatcgctttggcatcgacagcggaagagagagaaggcggctcgagtagtggggagtggagtggggggtaggagcgacagtagaggaggagcgttgaggaaaggaggagggagggtggcagaatatagtgggaggaagtagtgaaaccgacgggtggaggcggagtagtggtcgcggcaaagaactgcgccacctccacgataggggagatggtgtagagttcacaagttttgggaggaggacgcggagcgcgcgagtgcatggggtgtcgtcgacgccactgctgtccggacaccatgaggaagtagatgacgaggttgttgccccgggcagtggagactgaggaagagggggtacacccccgggcgtgatgtactagctacaaaaaggagctggagcatgcaccgccaatgcacagcgacgaacatcgaggtggtggtggtgttgcagccgcggtgacgccgtcgtcttgtccctcgccgactagtcttgctgggccccaaatccgccgcctcccatctctatctacgcgaggtaccctctggttagggagctgtcaagcttctccccc

SEQ ID NO: 64689 - DNA, 8712 bp, Oryza sativa
acgtcgaagagttgcctcctcttgggcaccgggcagtactcctccggcaggtcgtagcacccgatgtcgtagccgtgcctcgaccagcgctcgccgccgacgcggcagaacagcagcgccgggctctccaggtcgaacacgaggacgccgcagccgggctccggtggccggcccgacagcacgcaccggcgatgcgccgggagctcgccctcgccgagcggcggcagctcggcgaccctcgacccgtcgcgtgggtcgaggaggaacgccgacgccggcggcgagctcgtcgtcatcagcacgaggaccaaaccctgcggcgtctcgaggaacgtgttgccgcacatctccaccgaaaggttgacgtcgagcagcttcatggcaggcagactgaagactctcgtcgccattgacgaagacgaagacgacggagtgacaccagcaacgccatatctctgcaccagcaacgggtaagctgcggccgccgctgtcgatgagttcgccatcgagatcgatcgaaaattttacacaccggatattaatcagggtgccttaaattagccgtaaatctctccgagtctgagtcctatacatgttcctggccgagtggccgcgatggattgcgcctgatgatcgggaagaaacattaacgggcatcgttccatactcaacttatctaattttttacaccctccatcccataaaaattatatttctagctaatttaggacaaaacagtaggattagaaaatgaccacaatgaccttatttaatgaactcattgcatgcacacattccatatatacaaatgattaaaaggaagtttgagagaattaacccatataattagcatacttaaattataagctgagagaacgtaaggaaacttatctagatgaatcaatttgttgggccccacatggctagaaatacaatttttgtgggataaagccttagagctagaaatgtaattttattgggatggaggtagtatattatcaagatttcggaggaaacaaactaaacataccatcaccaatataatataacctatcaaattttggtaatttcgaagtttatattctcaaaattggttttcactaaaatttggtaaggtatcaaactaattaaacatcttatcctagcattattaaagtttcataaaggttttttttccacagtaaacaagcccaaaatataaaggtattgtgggaggatggagtggtttttaggcccaaatatttttttttacaaagccttaatgtaagactattaatttcgagtcttttcttaataatggaatgaaacatttcggtctttgcttaagagctacagccaattattactaggttcacataaaaacaaacttacaccgtgagtatgaagccaaagtaaaaaaccaaaagtaaaagcaaactaataaaaaccaaacaagataaagcccccacaactactaaattctattggtgaatctccacccgaagtttgcaaagagtagcatgatcgtcgactcaaatttatgacacatatcttttattaacttgatatgatcatcatacctttgtagttgagtctattcccggacccactatgttgccctggaaagaacctgcaaataagattttgaaggtgatctatcaaaaaccatttcatttctactaagccagagagcccaacatacagcagaagcttcaacaataataagttccttgatctttttattaacacccacaagccaattcccaaacatataagatatactacgtggagggtataatccaaatgcaaatagtatagatctcctaataaatatggcaaaatggcaatctaggaaaagatagtaaatcgtttcatttttcataaaaaaacaacatctcaaactaccattccaattcctcctagccaaattgtcttttattaaaacaatccccttaaggagatatgacataaaaatcttaatcttaagaggcatattaagttttcaaataaacttatttctctcgatatgcccattaataagagccaaatacatagatctaactgaaaattgaccactttgatgaaaattcaatctaaatatatcatcctccactgttaagttaattaacatgcacaattgaagcacataaattcaaccatctaatcaagttctgatcaactaatgctctcctaaaagagacattaagcggaacaatactcataacacttgcaactgaggagtttttccttctaactatggaatataatgatgggtatctgtcctttaaagatgaatcacctaactacttatcctctcataatctaacttgttcaccattgttaataaaccaggaacccatatttagaaaagaacttttaaccttcatccatcctgaccaaaaatgggaatcctcttgtttccgctcaacttgagttatagatttagtatcaagatatttccttttcaaaagatcttcccacacaccttgttcatttattaatttaaacaaccacttacttagtaaacactggttttgatttctaaattatgaacaccaagtcccctttaatctttaggctgacaaatagtatctcatcttgtcaatatatatttctttttatgttcatcactttgccaaaagaaatgggatctataataatcaattttttgaagaacccctttaggaatctcaaaaaacaaaatcataaacataactaaacttgataacacagagttaatcaaaaccaatcttccacctacaggcatatgcttacccttcgaactactaagttttttctcaattctttgtttaattgctaaccaatctttattactaagctttataaaatgcatagaaatgttaagatatctaacataaaaatctcctagtttgcacccaaaaatatttgaatattgctcatgactttccttagcttggccaaagcaaaataattcactcttgtggaaatttatctttaggccagataaattttcaaaaccagttaaaatcaatttcatatttttagctttctataaatcatgctctaaaaaaatgatagtatcatcggcatattgtaacatagataaaccatcatcaatcagatgttggaccactctagaaatttgaccatcatcttttgctctctttattaatatagctaacatatcaacaactatataaaaaagaattggagataacgggtccccttgccttaaacccttgtatgtttgaaaatttgatcccacttggtcattgactttaatgccaacatgtccaccttgataaaagacgcaatccaatcacactattttttgtgataaacccttcattctcaaagtttgttgaacaaaagaccattttactttatcataaactttatcaaaatcaatcttaaaaagtacaccactcttttttatcagtgcaattcatgtatcatttcatgaagaataacaacaccctccataatattcctctcaggtataaaagttgtctgtgtgggactaataaccttctgagccactccggaaattctatttgtagcaactttagtaaaaattttaaaactaatattaagtaaacaaatagacatatattgttgaattttcaaagcctcattgcacttgggtagtaaaataatagtaccaaacttaagagagtaaagaggtaaattaccactatgaaaatcatcaaataaatcaaccaaatcgggcttaagaacatttcagaaaatctgataaaactcagctgagaatccatccggacccgagctttattatgttccatttgaaaaatcgcatcttaaatttcctcctcagaaaaaacttgtactaaagctttattttctaattgagagacctgtggaatatcacttatttggctttcatctaacgttaaagaagacttttataataagtggtgatttgcgccttttcacatcaccattaattacctaatcaccatcctgtaactgataaatccttgttttcctgtgcttaccatttgctaccaaatgaaaatatttagtattcgagtccccttccaaaatatttttagtcttagctcgctaataccatttaatttcctcttcccttagaaaacaggatagcttattcttcaaataaagtctagaatcaagttccacttgagttaacaaagttcatcataattttttatcaagaaaatcaagtttttctaacaaaaacttcttcccttttcttataaaggccactagtctgtttggcccaaccttagtctatttggcccaacctatttgatggttattataagtagatgaagaatttgtgtttaagagtaaagaagtatcgtcaaagatatctctattaggagtataattttgaagtactcttggagttgaccagaaactctctccggagtccaacatatgtctactccaaaacatcaatggttaactaacgtgccgtgttcatgcagaattttgctggtacatgtacgtatccctatttcgatcggatattacgtgttttccccgtagtgatagagattttcgtttgcgactctgaaatcgtctcgtactctcgtcaacaacaatggcagacgaatcgatcccgttgttcactgttggttaccctttgttggtgtagcagagccatgccgacggccaaccaggctcaccggcgatggcctatagcctgcttgacgggaagacgcccaacgatatcagcctgcagcccgagatgcactctaacaccttcctcgagacgccgcagggctaggtcttgtactgagcacctcgccggcgctggagacgacgacgatgttcctcctcgacatccagaaagaaggtcggcctatcacctctcgactactatctcacggcaaatcacaatgtttatgctacacactgaccacgacggtagcctgggaacaatggccatctccgatcaagtgcagttgttagtacaatgacggtatttaaacagttatatccatctacaatcgttcgttaagctaatgaacgtcaaagagatgtgccacgtcaccaactggctgctagcgctacggaccatgctacagtgcacaataggactaagggcttgtttggttgctaccctgaaacctgagtccaagcctgtgacttgcctgtgttgtgtttggttggtgccctgaagatattggcctgataaaacttgcctaagtgcgcacgcctaagtcaggcctaggaaattggtcgcctgatcaccccatgtactgaccaagtaaaaaaaatgggcatcactttcccccttcttgctctcaaaagtgaatataaaagcctaatatcttcacttctctaacatttggcaagtataatctcaggcacaaattgaatcaaacaacacctgaccattgtatcccatcaggcttatttttagggcatcaaccaaacacactactctcagggagacatgcctgaccaggtaactttgctatctaagctcaggctactctcagggatgtaaaatgctcaggcaggttgctcaggatagcaaccaaacaagccctaaatgtgcgggctacagtagcacacattaccctggccgaatctgagctgctcttatttgatatgacggtcacccaatgactactaaatttgtagtccctactacaaccgctggggtcctgatccgcttgaggcatgatgaaaccaacctgcttgtgatgacagcatccagtagaggatggcagcgtctaggccatcgagacatttgaccatctccctttatctcaaaacacaacagactagaccatctaggccatcgacaccgttctgtcacgttcttactacctctgtttcatcattattatacattgttttattttttttccaaatcaaacgtttttaaatttgattaagtttatagaaaaatataatgatatttttaaaaaaaaactatcaaaatacgttaaatgtaagacgtaatggaactaatttggcgctataaattttactatatttctatagaaacttggttaaacttttaataagtttaactttaaaaatatcaaaaaaaagagggaataacttttaggcaacaattttcatcaacatgttgcgatcatttttatcttcagccacgttgttttgtgttgttaattaattatataagttctaaaattgttttcgatttgatttgggctgtgccgtagaaggctggatcgtggcgctgcgtatggggctacaagacgggccgacccaggtgcgtatcgttcgacggaggcccaagttcggaatttctgatagccactaacttgatcctttttttcttttcaatctttccgtccatccgtcaatgtcctcgtatgaattcgcctgtgtggattggaggattggttgaaatgaattactttctgaataaaatgttgccgttaatccttttaattgaaacggctattgtttcacctactccgtattagagtatctactcctcttattgccatttgactgctgcacgatggtggtgtactcaattaatgaagattaagtaagcatatagaagagaaatcattactacatgattaattaaattttaattattataaatttgagaaataaatttattttgatactctcttcatccaaaatataataaattagcaccagatgtgacatatcctaatcttaagtatctagatatgcccctatccagaaatgtaggaatggagtagtggatttctctattttaaaatgaatggagtagtttagagcaacttttatatagtaaaattttttcgtataggacataccattcagagttagctgtttaaaagcatgtcaataaaaatagagataaattctactccctccgtctcaaaataagtgcagttttgcactgttcatcttcaacgtttgaccgttcgtcttatttgaaaattttgtatgattactatttttattgttattagatggtaaaacatgaatagtactttatgtgtaactaattttttaaaaaaattttataaattttttaaataagacggacggttaaatattggacacggattttcagtatttattttaggatggatgtagtagtatatcttcaaaagaaactgccatatggaggagacgaggagtatcttgcaactgaaacgcaagtactctacagcagcacctcgctgccgctactggctacgctagtactccaacgtggaccacacagtgaaacctgcaaacatgcaacgacttgtctcgtcacaacagtgtgtgcagattccgctcgatgagtactgtgccggtaaaaggcagctggggcatgcacagtactccttaacaaaaatatatcttcccaaaataattgtattttctatacaaaatttgttcaaaaataattttcactctagagtactaattattccctgaatgaccttttatttagatttctccttattctacttactcttaaccactctcacactctcacctatacatcatttaatgaagggtaatatagtttttttactcaaaccttagtactccatccgtcctaaaataagtgcagtttaacagttcgtctcatttgaaaaaattttatgattagtatttttattattattagttggtaaaacatgaatagtagtttatgtgtgactattttttatattttttttcaaataagacagatggttaaacgttaaatatggatacccacgactatatttattttagaatgaaggtaatatattctaaataatatagaattataattattttaaaacggaggtagtaaatcctagctaaaaatttagattggttatttttttttcggaagggtacattacaattgatacaagcaccgacaggataggataggataggagtggcctcggatatcagtgggctttttatttatttaccacgaattccctcgctggtgcgtaacgtacgcagagtgccgtggtagcagactgggagcacgtactttgccggaccctgatgggcatggcatatgcaattggcagcgtgatgtgagcaaaacaacagttcggggaaggccaaaaggattcgagacaggatggacggacgtctctgatcatctctgaatgagaattggatgatggaatctggtcagttacgcatcacatcagtgttttctgctgtcatgattcctggcctctgcctgccttgcctcaccctgttctctgtcagaacaactctctcgccgttttctgccgttacggtgagcgaactctttttaaactcttgagggcacaaacacttgagggcatgcccaacgctccaagcgtggtctcaccccctcgcgaggagtatattcacgttagcttggccgagaccgcatcctggcatagcgctgcgacacccagagaagtttgcgtggatttgtcagcttttgatgaggaaaaggtgaagaatggatgaggaaccgcgttgagggagaggcgtcgctacataccgtagccccgggacattgaggccaactacctcgcgccaccgcacctcgatctgccgctgccgccgctcgatctacccctgccacgcctcgatccgcccccactgccgctcgatctgctgccgccacgcctcgatccgtccccgccgccgctcgatctgccgcctccgcctcgatccagcgtcgccgcgcctcgatccgtgacaccgccgctcgatctgctgccaccgccttgatccggtgctggggagagaggcggcgaccgccggggaggggagagaggcggtgtcggcgaggggaga

SEQ ID NO: 64690 - DNA, 13169 bp, Oryza sativa
ccctcccccctccccccccccccgccctctttgcccccacctctcgatgttgtctacttgccatcctccttctgcgtcggcatcgatgaatttgtggagagcatattgacttctgcaccgccatgccatcgcgctgcccactgccgcgtcctcctttgcatcaccgcttgtcgctgtctctcagtcgcccgtaggtaagagagacggaggaaaggtgaagagaaaggtatgggaggaaagtagagagaaggatgacatgtggaaactactgatttttccgtagaggcttacctgtgagtctatgataacataaagcaatctaggccatgcatttgtgaaggctatactgaagcgcttctcaataaggccttattataaggtggtggcccattattcgttcaaaatattagtaatcagttcgaagccaatgacagcaccggccggaataaccagccaaaatatgctaaatttgaattgaagattcatagttctatttttatgaggaaagtttcaaagccccacagcttggccgatttcattggatgccagaaacacaactacacaagtgacaagaccaacgattactgcttgcagcggaatgagctgtagctagctgcagcaagtacaaccgagcaaggccataatttaaattggaataagatttggatatgattcgtatcctttaatcacaatactagatatctcgacccctcaactattaaaaccgatgcaatttgactctctcagtgtttttggaggacggtttcgctgacgtggcatctacgtggccgtgttgacttggtttgtggcattgacatgacacttaggtgtcattagagttaaaaacatatatgtgggacccatttgtcattcacacacaaaaaattgtggacccactgacacgtgggacccacacgtcatccactcctcgctccttcttccttctcgctccctcccttctctctcttctctctccccccttcgaccccatcaccgcctgccactgagtgcgaggaagagggcgaggagtcgtggcggtgaggggcgctcatggcagtggaggacctgctggctgctatcgctgctccggtcctcgccgttgtcggagtcggcaccgctcgcgttgacggagaatcccgaggaggcgacgagcacatgccgaggcttggacccagctttgtcagcgggataaaggggggactcgacgaaggcggtggagctctcctcctgctccttcaacaccatctcgtgcagcttccccctcggtgtgccagcaggagggggtatccgccaccgtgtaccctgccgccgcgcagttaattttatgaattcttctatagtttacggggcttaattgcaaatctattaacttattaaagtaatagaaaaaagaatctccatgttagttctcacggcctagaaattctcctattaatcaaagaacaagaaaaatagagtccatacaagtatataatttagaactaatgaaaattcgaaattagaaaaaaaataaaattaaaagttgaggttagagtcatatagaaatacaatttataaataactaaaatttgggattaaaaataaagaattttagaagaaaagtatagtgtccatatagaaatacaattaaaaagtaaaagaaattcagaattaaaaaaataaatattagaagaaaagtatagagtgtatataggaatttggaattaattaaaatctagaataaaaataataaaattaaaaatagagtttagtgtccatatagttaaaattagtacacttgtggacgtatggtacatagatcatgtgttctcatcttgatctgcataataaaaaaagtttatatgcataaattcgctaaaaagatctttgagaacttaaagtcaaaatgtcatgcagaacaaattcaagtcttcacatttttctctactattataaaagttgaagaagtttttgccggtattttggtacgtctcatccgtgtttgagttggttttttagttcgttagcttttgaaaatataattccgtgtatgagtcaaattttaagttcgtttgtttttttttgaggggaagagcaaagatatattactcaaccagaggagtccttacagagaatctgagatattatgctacaagtattttctaaccaaaaatcagagatgtgatcaccacgagctttacaagctaaaacatggatggcttgattctgggatctctgtatcttctttatggtgactcctctctcatcttccagcaaacatttaatctcgctgacaatatgcgagaagacagatcgatcttggtcttttgaaagcgccaaattaaccactgtcaagcaatctgtctctatgacgatggggagaatcgtccactggagtgccaatccaagtccttcgacacaggcaagaagttcagattctagcgcctcctggcatctgttcaaaaacctgcaagaggagaaaattacctctcctgaactgttgcgcagaaccattcctactcctcctgtttcctcctgtggatggaaggatccatcgatattcagtttcatccaccccgctggtggtttctcccacgacacggggacatccttgacagagcagcaaggggcaggagcccgcttagcaataccaacagccagtttccctttcttcaaatttgcaccaggattctgcttgatttggacaattgttgacatatagctttccaggaaccgccttgacgcccacacgggggcagccggcttcccatgagttatatcattacgaacctgccaatttcgccaaaggatcatgagaatcatagggtgctcctcagctggaactctccccaaccagtccaagaaccagtaagaaccccctctgatcgaattaatgtcagatacaagatttcctgccttggccatttccatccaaagattcctggcatgactgcatcgacatagagcatgtccagtatcctctctttctctatcacagatggtgtaggaatcactcatctccagtttccttttctttttattctccatcgttgccaaactgtctgtggctactctccaggagaagatcttaaccttgtgtggaacttcacatttccagattaaatcccaagaattctttgcacaaattgaagaggatgaagagctctcatccttggatgccagcctcactgcaaggtgataggcgcttctcaccgagaaccggccgttcttgtcggggttccaggatatgaagtcctccgtttccctatagggtagtctgatttttaaaatttcctctgcatcaacattccaaaagtattgagagaccttatctacatcccaagcaacattctcatcaattagctctgaaacccatttcagacgacaatgtcgtttgactgtaattggtcttctagtaaactccctcggcaaccaaggatctctccaaattttcattgatttcccgtttcctatcctccaaattaatccttgtttcagaagtaccaaaccatattccactcctttccatccaggagaggcattaccgccaaaaacagtatcaatgagggaaccattcggataatacttcgctttcaacacccgagcacagagactatcgggagattcaatcaaccgccatgcttgcctagctagcaaggcttggttgaaccatctaatatccctgaaacccatgccaccactctgtttcgacttcattagcacatcccatgccttccaatgagtttttcgccgtccatcctgagatccccaccagaattgacgagtgagtttgttcaaatcctcacacacagactctggcagtttgaagattcccatgacatacactggtatcacttggaggactgctttgatcattatttctttgccgccagaggacaggaatgtttccccccactgaataattcttttccatatcttctcttgaagactttggaatttccctctcttcatcctaccttcgggagtagggaaccccaagtacctttcttcaaattcgtctttctcaatgtgaagaatactcttaattgcttcctgtattcctggtggagaagcctcactaaacataatagaacatttcgctgggtttattagctgtccagtcccagctgcataagcactgagaacctcacttaccgcaatcgcctgttgttgttcagccttgaaaaataacaaggtatcatctgcaaagagcaaatgagatataccaggagcgcgtcgacatatctgaataggagagatggacccctgtgcaactctttctctcaacaacatagacaaaccatcagctatgaatagaaacaagaatggcgactgaggatctccttgacgaagacccctggagggtgcaaaggagctaaggagagttccgttaaatttgacagagtatctcaccgaggtaacacatgccataatccagttaacccaacggtgagcgaaacccaacttgttcaatgccatttccagataccgccaatccacacgatcgtaagctttcgataagtctagcttgtaggcacacattgctctattctgtcttctgttagtttgaatggtgtggaagcattcaaaagccagcaaggcattatctgtaattaggcgacctggcacgaatgcactttgctcacaggaaactagctcatcaagtatagtcctcaaccggttgaccaaacatttcgataccaccttgtacataacattgcataaacttataggtctgaaatcctttagctccatgggttaatcaatcttcgggataagaactatcgttgtgtcgtttaccccatcaggcatagtgcttgtctgaaagaacttgctaacagcatgtacaatatcctgtttaacagcaccccaattcctctgataaaaccgagcaggaaagccgtcagggcccggtgccttcaggggaccaatttgaactatttttcttagccctccaaactgcccggctgtgaaagaatcgagtattacgatcaccttccttcaaccaactaattctggagcgttggagccacaacatttcttccttgtataacaattcattcatatggtctgaagcttgccgaacaactgaactatcagctccattctctaacagagccgccagtctttttcttgccttttctgactccctgcctatattcttaaccttcctgttactccaagaacgcagtgaagccatcacccgatctagagctttgttaactttccccaggtcgcccttatcccctgcatcagaccaagcatctgccacaacctcagggaaatcagcttccctttcccacaatatctcatagtgcaagcacttgttacgtacagtgctagtatccttcatcttacagtttaacaaaagaggtgaatggtcagagcagggagaaaccaaatgaacaacatgtgcctcagagaaaatatccctccaactatcatctacaatcactctgtccaatctcaccttcacattgttccagccttccctacggttatcataagtatggggtagccctttgaaacccaggtcactcagaccacagatctgcaagacatcccgaaaagccttcatctgattctcatttctcggtgttttcgaaaagtgttcgaattgccataaggcttcattaaaatcgcctatgaccatccacggaaagtttgacgattgtcgaagggcattcaaagacgaccacatatggtgccgattctccacccgaggttcgccatacacaaaagtaacatgccaaacaggatcaatcggagacaaacgaacatacgcatcaatatatcttgcattcacatctttaatatcaacaatgacagattcgtgccagaacaaagccaaaccaccactcataccttcactactaacaccagtaaaacctctaagacccaaccttttactgaggcggcttaccttctcaactcgctgccttgtttcacacaagaagactaactgggaactagtgtccttgactaaggtacacagttcacgaactgtcgaggggttccctatcccccgacagttccaagccaagcaactcattgtccctggcgggaccctgccgtaggtctcgccagtgaaccagcagccccagcgctggtagcttccaagccagtcacctcccctgttgctccaccatccttcctgagtctctttagcgaccgtcctatggactcaatgtccttcttgctttgagctgtgctctcctctagctgtttgtactccaacaaagcttgctgaacaatgcctgtcttctttgtatctgacaaactgcctgttttcctcttgctcggactgcttgtttcatccatagagccttcatccaacgagtcctgataagcgctcagatccctgacagccggtatcatctcatttgaagggattggcaacagctccccccctctttcagccataatcaaatctctagagagccccttatcagtatttatgggtttatgctgggaactattcatgtccgacacgcgtatctggttggcctgttctgctagttgggcatccacaccttcatccccttttctctctcttgactcaaagccatcaaaagtatcaattcttaccggtggttctgtcgggtgcagcagatccctcttttcccctatcgaggatgagctcgcagagcccgcttctctgaaaataatcttccttggcacacctgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgttgtgaccagaggggttctgcggcgacgtcgacggctgaggcggagcggcgacgtcggacagcggaggcggagcggcagtgtcgacggcggaggcggcgacggctgctgcagaggttctcaacgcgagcagcgtgaaggaggagcagggcgcacgctcgctggttgagctgcgcaaggatttggtgcagcacaagctgtagggagcacagcggctgagagacgcgcagctgttggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaagaagaaaacaacagtgcttggcaactttattaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggtgttaggcataatgggttgtggtatctggatagaagagggacggacaaagcactatgtagtgctttgttagctagcacaagtgaagaggaggctaaattgattctaaaacattgtcaattgggacatatgtcctttgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgtttactcatgtatacgatgaatgtaccaaagtttctatggagtgaggcagtcatgacagtaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggctcatcaggtattgaagaagacacacaatcaagaagcatgaaatttgtggttggctcaatcccatatcctgttagtgaacccattcatgagcaaaattggagaaggccacgtgaagaagaaaatctacaagtttatactaggaggaaaacaaggtctttggaggcgcaaacaatggggcaacatgagtctcctatggatgggatggagcagcaacaatcttcaattgttgctgaagtaggtgataaaccatctgatcagtgtgatactatacagatttcatcggatacggaaggagaggagtttgaaacagggggagaagaaactaatcttcctattgttataagaatgggggtaagaagcaatgcaggtaaacctccacaaaggtatggttttgaagctcaaggtgtgaatgatgatgagaataacatagccaattatgtctcttatgcttctttgtcatccacatataaggcctttgtgacatcactaaattcagtggaaattccaaatgattggagggaagcaaagcaagacccaaggtggcatcaagctatgctagaggagctagaggctcttgaaaagaacaaaacatgggaccttgtaccattccctaaagggaagaaagtggttaactgtaaatgggtttatacagtaaagcaaaatcctaatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaggatctgggccaattaaaatattttttgggtattgaaattgcaagatctcctagaggaatagttctttcgcagcgaaagtatgtattggatctgctcagtgatacaggtatgcttggatgtcggccagcttctacaccaattgaacaaaatcataagttatgtgctgaatctggagatccagttaataaaaagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgataggaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttcgagaggaaaaatcacaaaactacacaccaccactagggacagctttcaccctgctcactctgcgttcaaacggtttcaggggagaacaccggagttctgaagaaaacagcattggctctccttcacctgagattaaagtcgtacaagaaaatctctaaaaaatttcgtttgtcaccagagttcgtttgtttttggaaatataaaatgaatcgtacaagaaaatctctaaaaaaacttgtacgctaacttgagattaaagtcagactcctaattgcagctcatgattttctaaaaaaaatttatcaaagcgaattcccacatcaaacttcaccctagttaaaccgtataacaataataataataagattaaaatagtattcatccgttacaacgcatgggcatattttctagtaaaagaaaaattcaagtatcacccaaggggccgagtagcacagaatagcaagtatgttagaattgaacgtaagctaaaattagcgcacttgacttttagatctgcatgtatggtggtggatgtgtgaacgtctttcgtttaatgagtaatactgtaaaaggtctccgagaatttagcgtcaagatatgcacactggacaaattcaagtcttcatatttttaaaagaacaattaaaatatcaccctagtggcagagtagcatagactacaaatatgctagaattgaacttaggctgtgtttagttcagtacgaagtttggattttggttgaaattggagatgatgtgactgaaaagttgtgtgtgtatgacaggttgatgtgatggaaaaggactgaaatttggatccaaactttggatctaaacacaaccttaagctaaaagtagttcacttggcttttaggatttcttgcaaagtgttgttctccctccatatttctatatagttagcaccgttaattttttaagttacctttgattatttatcttatttagaaaactatacaaatatgaaaaatagaagtcataattaaagtattgtagtgatgagacaaatcataaaaagataagtaataaatgttttttaaaacgatgaatggtcgtatgtaagttaaaaaatcaacaatgttaaacattatttaaaaagagagtacaatttttatagaatggtaatatttacccaacatttgtatccaatcggatatatgcatctttttaaattggtaaacaaccaaacttgaaattcgctcttatggatatttgaactcaggatcttggggtgctactcagatcactgcaaccactaagctaaatgccttttagcgaaaaaaaagtcaacgtgttaagaatccaaataaagtaatatatgtcgtaaaagatatccgagcatataaagtcaacatatcacaccggagaaattcaaatgttgtcatttttcaagaagaacaattcaagtctcacacggatagagcagactagcataatcagccgctctcatgacgtaacaacataatagaagtaacaaccagattattgcacaagaaaatcatcaaatactcaaatcaaattcaaacccgaaccgtccctacccagatggcccagtcagcgatgccgccgccactttaccgagagaagcagcaacacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgaccatgatgacgatggtcgggatcagcagaggcacccaccgcacggtgtacaggtcggcgaacttgtcgccggagctggctgccgtctgcttcgacgtgaggcggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatc

SEQ ID NO: 64691 - DNA, 906 bp, Oryza sativa
gtcgatcttagccgtagccgattcggactacagccgatcttactatgttctccgatcaatttccatctcgaattctactttgattccatctccatctctgatacttagattaccaaatttggtcgttaacacatgccccccaagtccggaatattggataatgttttggatttgccatacgtcaattccgagaaaactccgttctcgccgtttcccgaccgttattcaagcgctttaaatactaaccattacccccaagaaatctcacaccgtcttcttccgtttccaccgctgaggccaacactgtcctctctctcttcggcgatttctccgacgcacaaggcgatccccaagcgacttcatctccggctagatctccgcccgcggcgatgtcatcctctgccggcccgtctaccgcatcgtcggccgagtatgctgaggtaagttctcatcggctagatcccttttcttcgcaacagattcattttccaactcatcttgttttctccttctcggttcctttggatttgtagcatctctccaacctagttgcaattcccaacctgtcgcatgaaaattactatttcctcggcgcagtcggcaaccctgatcctaccgagttcattatcagcaaaaccaataggattcctttcagattggccaacccaaatctaggtcactagaaaaataccttcaaatcttggccatctctcgataaaactccacccgagaaaagttggactacatggtataagcgcgtatcggctagcaagaaagtcactaggacgagattggaatcggccaagcgcttgcccttaccatagccaattcagctaaagatgaacctctgatggccgccgccacttatatttgggccaacactatcaatgccttttttgtcaacca

SEQ ID NO: 64692 - DNA, 16877 bp, Oryza sativa
aggtgctgaaacataaaaataagatgagcgtataacttgcaccgtgtgaggcatatacctatctaggtgcttgattacttttgcttatgtggatgatggaggtgctccctgccttgggcatgcccggagaaacgtactactcctacaccgtacacggtacagcagcagtattagtaggagtaaattcggtgaaggaaatcgtgcagcctactgactactgtatgccctgtgcggctgtggcctgtggtgctgaacgatcagcttgcgctgcgccgcgacgcgagagaagggaggggaggcgactaggcgaggcgacgtcgtgccgtctcggtggtgggcgatgatgcgagcgcgtaattacgtaggtgggcgtcggtgttggagcggtgaattggagtcgtttctctctctttttgtctcgctttgcgcccgcagaattcacgccttaaaagccgcgcggcgctcatccctgacttggcctctcttttgccgccggactgaactgctactgctactatttgatccatcacaaaactcgtagtactcgtcaactcgtatatattttgctatcgcgtttagaaagttttcaacttatctttttcggaaacttttcaacgtatacgtgaaaagttattgaaaatacctgttgttcctgaacaaataaatggtttcatcagaaaatcacacgaaaagataccgtggttgatcaatcaaaccagaccacccgtcctgaaccacccaccccacaaaccgaacaaattaaaacaacaggaatcgagagcttggaatcatacgtgcagaaatctaaccaccgtccacgctagcttcaagacaaaaaaaaaaaacccagccgcgcgcgaggtgcaggtcgaaatcttcaggagacaaagacgacgcgtgcaatgtgtctagagctctcgcgtactactactccactactaatacaggactccctccgtcccataatataagggattttaagtttttcttacaacgtttgaccactcatcttatttaaaattttttaaaattattatttattttaattgtgacttactttattatttacagtactataagcacaactttttgttttttatatttgtaaaaaaaaattgaataagacaagtgatcaaacgttacaagtaaaaactcaaaatctcttatattatagtacggagggagtactagttactagccagcacagccgatcgacgtctctcaaattaaccaacgctgctagctcttgggcgagtgacacgtctcccttaattctttacgtggatccatcgagaagaagaggatatggatggttgttggagaggaggcaaagccatcgcctgagctgataacgacagctacacgccttcggtattccacgcgtgtatatactggacggttgaatttttgggctcgtaccaccacgccgctgtcaatcacttggtcgttttttttttaaaaaaaaatacgaattacccctgaactatcacggtcgactgaattactatttgaaccaaaaaccagatattactcagcctaaatttttaataccggacgaattacctccttcggtctaatttggagcgatttgtcctgcgcatagtggtgtcggcggtggagggcgctaccgggtggcggctgcacgccacggaggccgagttggggcgaacgtggagctcgacgagattccctctctctcgggtgtgggcacaggtcgcgcggcggcgaactcctggaaagatgagtgcatcgcggatgggtgctcatcgggatgcggcggaagcagcaggacagacgacacacggcgcccccatactcagctcgagggatggagatcggtacagcctgcttagcccgccgcctacctcagctcctcacccgccacccgccgcggcctctgtgcccgctcacctccggcctcggctcctcgcccgcagctgcctccgtccccgcccgctgccgcctccgtcccagcccgcctcgactcctctcccacccgctgcccgcagccgccttcgcgcccaccagtcgtggcctctgttcaccgagagagagagggagggagagaaggagagaaaaaaattgctgacaagtgggcccatcagtttttatttgtttttgctgattgtatcgccacgtgtgtgccacgtaggctgaaaaccacttcaaatcgagttagggtggtaatttatccgattttaagagtttgggggtgtcaaatgtccggtattatagtttatggggggtaaattgtactaccgcaatagttcaggtggtgtaattcgtacttttccctttttttggttaagaaaaatctaaaaataactgattcgatacataaatatgtaacataccaatttcatcggttgctcatatttttaataagccaaaattgcttattggaggacaaaaattaatttataaataaaacttttatatatgttcttagtgacctgatttgataaaaaaaatacattaaaaatatcttaatattaacttaaataaaattaagttagaaaatttgaattttggctttgacttattaggacaaggatgaaactatatcactcttcaaacatgcaagctcaaatcgatttgcacgtataaaaacaaaagtaacaaatttggctataaataatactccctccatcccaaaatatttgacgccgttgacttttttaaaaaattttgaccgtttgtcttattcaaaaaatttaagtaattattaattcttttcctatcatttgatttattgttaactatacttttatgtctatatatagttttacacatttcacaaaagtttttaacaagataaacggttaaacatgtttaaaaaagtcaacggcgtcaaatatttagggaaggagggagtacatacgcaatactacccacagtctaaattactattttatttttgttttacttatgtaagttcaatttgaacttacaagcttgccatcgcatatttatttattttattaattttttaaatattatacaacatgcatgaagcgaggagacgtcaccttctgaaacagatattcacctcccatagatattcttgttaatcttatgcgtgacacttccaatcctagaaacttttcttttttgggtgagataagcatcaggcaaagcgaaggaccagcatgtgtcgctcccttttccaatggataatatgccttttatttattaaaaactcgttttgcaagtgataatcttggcttaataaatgggagcagagggagagtgagacaccaccgcctcttgattctttcaagatttcacatgtttgaatttgagcagtccgtttttcatgacaacatgtagaagaggatttctatctctttcattatcttaaaaaaagtactaaaaaaaccactcagccttgctctcacgttagatcaaaatccggcggttcagatggagccacgtgtcagttggagtatccatgctctccgggtaagaaaatggaggccataccgaaccatccctacatcaaccggtcctgatcattggattgaatgatttgtacaaataactccaggaattagtggagtaatagagtaattaggagtactagtagatgcaaggcattgatgactggatatgtgactggaaacctgcatgattgcacttgctatggctcacaaggccacaggagccatgccaagctagccagctgattgaggcatggtttcctggcctctgataggcatctaccacctcatcaattcagagggtgatgggttaagtagtgtggtgcaccatgaccttttctatccaatattttgtccctttttcccccatgatgaacatggtcacacttggaaattggaatggaggggccaatcatctttcctccctctatctttctttttaattttatcaatgaattggttggagatccagggcaaatgatgttctcattgtgaccactttttatgtataggctatatataaaggtttgatgggatggccctacttctctaccgttatttcacataatcattagtttgtccttgccgaaattagttagacctcctttggaattaagaaatttagagatttttcagagagaagtgaaatagttcctgtaaaattcctactcattccatcctaaaatgtagctatttttagagtttaaatttgttccaatatatagctgtttctccatctgcaccattatctcaaccaatcatgcataaacatctcccatttaactttacatattttttctcaaaccatcacaatctttcacaatttaattaccctattttttaaaaaaaaaatagaaatatttagattttttttgacaccgaaatatttagatttggggatgaagagagtatgtttcacaaccggtactttgatatggtgtagaagaaatcacaaccggtaaaatatcatggatccttgaaaaaaaaataaagggcagctggctgaaaagggtcataaaaacacgctcctttcttttttcaagtgaaacaaagtcgaattttgaataggaaaagtcagcagctacagttatactaaaaaggtgggcataataattgttctatcaatgaataaaaacaaacaagtggggaaaataccagccaactctaatgcaaacattgacaataatacagacattcaactactaataagaagccattataaaaaaaaatcaactaaggctctgtttagttcctacgtaaaaacttttcaccctatcacatcgaatatttgatacatgcatgaagtattaaatataaaaaaacttattacacaggttgcgtgtaaattgcgagacgaacttttaagcctaattgctccatgatttgataatatggtgctacagtaaacatgtgctaatgatagattaattatgcttaataaattcttattagtagttaatactttaaatatgtgtacatatactttaaatagtttattgacggattctgtaatttattttgttattagtctatatttaatactttaaatatgtgtttatacgtcaaaaattttcaccgctggatataaacacagcctaagattctcctgtcttgcttttgtgagtaagttctaatataagtcccctgtttgctgattccctttgaatatattcttcgacatacacatccacccatactcgatgacaaaaacagttggaaacagctcttcatggaaatgctacattggccaatcatgctctttatttactcaacggaattatgggaatgctaccctaattatttattagatggagggtgatagttggtactgacaaaaattccttgttgtcagcttacattaagccaagatttaagggacacttctcttgatatggtactgaagctttttcttagagctgctttaatagacaacctatcataccccttctttagctatagagaatcaattccttcaaccccaccaatctaaactttgttacaaatcagatttcctttttcttttgcgattacccgaaagaccaacacacatacaacatatacatcactatacacgcaaaaaattcctagctcacagaattcttattcacaaatgaaccctgattaataaagtctttatttgtagagaagggtatttttactcggcctctatatccaaccagaaatatgtagcccttttaaattagtaaccgaactcagagctttgggtgctactcaggtcactgcaaccactagactacatgttgtttcacgattaataaagtcatacagttatattccatgaccacatatttggcgctgctctactaaatccctctaaaacatggaccaaaaaaattcatatggtgagagttgcaacttacacttattggtaaacaaaaattccagagctctctcagcaaaaatcttttttttttgtttttgatacattatatactccctccgtccaaaaaaagacaaaccatgattttcgtgtccaacatttgaccgtccgtcttatttgaaaaaattatgaaaaaaattaaaaagataagttacgcataaagtattgatcatgttttatcatctaacaacaatgaaaatactaattataaaaaaattcatataagacggacgaaaaccatagtttgtctttttttttttacggaggtagtagactgcaatttgcaggtaggactacataactacccacgacatgacatcatgccagccgatccggaccatccgttacttaaaagtggacggccaagatgagccaaaagtcagcggcacagtcgcacagtaacggcaaggactgacgaccctgaaaaaaaaacctcgtagcctcgcaagaaattcagtcgcgtctgcatacaggtcatccatctctctcactctgcctcgccgggaagcagcagcgagcgaagtagtaggcgagagaatccgagcgaggaagaaagcccgagccgaggagcgctttaaagcgggaagaagaaagaaagcgcgcgagtaaagaaaagggaggaggaggaggaaagagagccgtcgttttcgttctcctctgcttcgcctcggccacgctgcggccacctcctttctgccacggcaaaagcctcctcgggatgctccactgatcgtcttctacttactcctctttcttccagcttggccggcgtgtggctgattattccagaatttccattagcttaatcaccggatcaagaagaatgagagaaaggggggagaggctcttttctgtgggatgacagattccgttttgtaggagcagcgcaccatttcagatttcttcctcctcctcttcttctttccgttgtgcttgctgcttttctctactaccttttccactgttgcgaagtcgggttggtgggtggttgattgattgttctttccttcctcgtgagggttcttgcttcttggcttcttggccgcttcttgagttggggctagctggttcttttgctgtctctgtcccgtcaaactgaagcgagcgagagattgaccgggtgggtgattcttcttcgaggagcttcttcttggagctcgtgagagtggagtgatcgaggtggtggtgtgagagcagtagacaggtttttcttggggagcttggaggtagccggagttgggggaggaggaggaggatggccgccgcgccgccgcccaaggccgacgagctgcagccgcacccgcccaaggaacagctcgccagcgtgtccttctgcatcaccagccctccgccatggcgtacgtgcgctctgcttctctacttcacttcagggtttcttaatttttctgatctcgagttctcgattgctgcttaaagtgttctttgtgatttgtcctttcgtgttgttttttgtccatgcttttgtttggttgatgcttgagtttttcatcggtggatacgtgtggtgatcatctgtttatgtgaaagtggaatgttttagtactgaacttttggcctacttttggtttgatgctgatgcttttgcgtataaaattgtgtattagtttgtacgacatgcttttgttcttcttttctctcgttagttctagtattttcttactttgctcagctgaggaaaaggagacttttgattaactagtctataaagattaagttcaccttttaaagttttaatccatcataaaaagggttttgaattgcaaattctttatgcagttgcctagcagtaaactgtgtgtatgttcagttcagagatgtgttcaagtatatatgctattttttttctctgaacttgttatcttatcttatatgcagccgaggccattatattaggattccagcatttcattgttatgctgggcaccactgtcatcataccgagtgcacttgtacctcagatgggaggaggaaatgtgagtcccaaaacttatgtgttacagtacatctcttagttctattcacttgcttgacaattgatttcagtactactgaagatttatcagtgttaatttacacaaaaaaaaattgaacctctacatgctgaatatctgaataattgcttctttatatcaggatgaaaaagctcgggtaattcagacgctgttgtttgttgccggaataaacaccttgttccaaacattcttcgggtctcgtctccccgttgtgatgggtggctcatacactttcgtcgcaccaaccatctcgatcattctggctggacgttacaacaatgaagcagaccctcgtgaggtagtgcccagtggttttggtcttcggattagcggtgtctctgtctatttatgacatttttttttgtgggggggtgaaagctaacatttttctgctgttgttgttgtaaagaaattcttacggaccatgaggggaacacaaggtgctctcatcatcgcgtcgacgattcagatgatacttggtttcagtggtctctggcgcaatgttgttaggttggtatggttttggtctttatttgattgaagctagagctgtgtcgtgtagagttttgatttttgcaattaactgtcctgtattatttttgcaggttgttgagtccattgtctgcggttcctcttatttcacttgttggatttgggctttatgagcttggttttccaggggttagtagttctgctccttctatttttttatgtttttaaatcctgaatataccttcatgtttttttttttggaaaaatggatgcaggtagctaagtgtgtggaaattggtcttccagaactcatcctacttgttgcattttctcaggtattaatgttactttactactctctgcatagtcagagcaatagtaacatattttacatactgatcatgtttgtattcttgatagtatttgcctcaagtgttacattttgggaagcctatctttggccggtttggtgttcttttcaccgtttcgatagtgtggctttacgcgtacattctcacaattagcggtgcttacaagaatgctccaccaaagacacaggtgcattgccgtgttgatcgctcaggccttatttcaggagctccttggtaggattctagaataaccatagtattattccgtgcttttatttcgatggaaatccttacaaggtgttgattttttattgtaggattagagttccttatccctttcagtggggagctccaacttttgatgctggtgaagcctttgcaatgatgatgacttcatttattgctcttgtggaggttggtctgcagtacttaatcaagaatagaaagaaaaggctatgctagcatgcattctaagctatccatttagaagtaataatatgataaaattttgcctgtagacaactggagctttcattgctgcttcaaggtatgcaagcgcaactatgatacctccatcaatcattagtcggggcatcggttggcaggtaagtgaatcaattgtgccttttgtaccatagaatttgtcccatcttcaatttgttacattgattatcctaaaacattatcttcagggaatcagcatcttgattgattctttttttgggacggccaatggaacctcagtttcagtgtaagtatagcgttagtggataattagaaccgtcaatccttgattgctcagatagttcctttttttccctttttctaactgggagtgtgaatttggtattcacagggagaatgttggtttactcgctttgacacatgttggcagcaggagagtagtgcaaatatctgctggtttcatgatcttctttgctatccttggtaattctgctcatgtccttatagctatcttaacatattttttttgttgtgtagaagtcattttctctgccacacttggctaggctaattataaattattttgatgaaccaggaaaatttggagcacttttcgcatccattccattgcctatatttgcgggcatgtactgtattttcttcgcttatgtcggtaggttgagatgcctgaatcaaataaacatcagttccttcatctgataattctcaacatattattccgctgtaatgattcactgttccttccatgcgcaggtgcctgtggtttgagtttccttcagttttgcaacctaaacagcttcaggaccaaattcatcttgggttttgctttcttcatggggatctcagttcctcagtacttcaatgagtacacagctgttgcaggttatggaccagtgcacactggtgccagatgggtatgagaaatactacatcctacagaatcctcctttttttttcttcatagcttgttctttgttctgatcacttgatgataatctttgctctctctttttttttcagttcaatgatatgataaacgtgccgttctcgtcgaagccgtttgtcgcgggtcttgtggcctacttcctcgacaacacgatcgagacgcacaataacacggtgaggaaggatagaggctaccattggtgggacaaattcaggagcttcaagaaagacgcgaggagcgaagaattctactcgttaccgttcaatctgaacaagttcttccctgctgtctgaatgatctagcaaatgtcacccaagcaaaaatggttcatgtctgaacataattctgctggccttcttcagtgttgctgtgcgtcagttttgtgtacttataataggcgaatcttactaattggacaacggagatgtgccttagaatgggaatatcatgtctatttttttgtcctacaatgatttatgtgtcattacctaggtctttctcttatcaagttgtcaatgacccaatgtacatgtggcttttctatcggatagtattagtatcacatttaacaatatgacctgatgctgatctgcaatttagtgagtaaaatactgaagctgtcaatgcacatgtggcttcctcagtacagatataggagtaataatcatcagcaatctggcctgatgttcttctgcccttttttgggttaagtaaatagtgaagcgttttatgctattcctactcctgttacttgtagacagctccatcgttggcttatagccgtagccaaaatttaaacttagctaaattttaatttttaatactcaattttagagttaattttgagggttttttcaccataagattataagtttttttaccgtagtttatttccaacattagcttttaaatcactataagcacgtatataaaagttttactcataaattatttatttttagttactcaattcagttttgcacggcttatcagttccatctgaattgttaatttgcaccttgcattgctccatgtgcttggcaatgtttgttctgtattctggttattaatcaactgttaaagaagccatctggaattcggggatgggcctacagattggaattcataagagcccattgggcctatgccttgcagtctccttcgagtttttttttttaatccagtctcctttgagttgttggcttgttgcatgagacttgacatgctttaagctctagcacattggaccgagtcgtaatttacagcgtagaagttacgatgttttggtggaattttacaaagtatccatttcaaatattgccacctcagaattcaccagtcaggaatttcacatgactctcataggatttagttcaaattatatgaaaatcctccaaaaatcttccatttcagaggatgccaaattcatagtagcaagttgacagcagcgaatcctacagagcacacctatccagtgataaaatggcagcacaggtgtctccaacagaaagatcatgtgactgatttgaaatgtcatttgattggcacacttcaaatcttgcatggatctcatcacacaaccgaattgcagtttcaatgacgaagagacttgataccaattactacctagtattcttggcatgccaacttccatctgctagggctttgtgtggctggcaattgaaatctggcccccaaaaatgggagagatgatggcatcagagcccccaaaatctgcatggagttgaggcccatcctcagtgctgatgacaacaccttctatcatcatagggaaaatcctcaacaaccatgatgccatatgatatgatacagctcctgaaatagaggaacaagatcagagatttgattacgggtacaaagcccatgatacaaaaatgtcacaatagttgcagatcgatggcatttgatgattttgcatctgcagtggtcatggttatacacaggtccaatcatgaatcatcatcatacaagaagacccaatagaattatccgcatcaaattgcattgtgcgaatagcgcaaatatagcaaccggcagaaatgttttttttttagccgggcctaggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccataacctcctctttaatcaaagcaaagaggctacccgctgtccggctctgactctggaaaacacgtgcgtttctctccttccaaaccatccaacagacaagcaaaactagcatgtcaaaagcgcccctgcagctggtctgaactccttgccgcgccaagagccaccattcccctagttccaaccctgcttcagccggcagttggatgccaattccagcccaacccttgatcatcctccatactctggtgatgtatgggcaggaaacaaagagatgctcacagtcctcgtcgctgctggtgcatagtgagcatgtttgatggtgtggccatccgcgcttgctcaggttgtcggccgttaggcaacggcatttttctgccaaccacataaagaacttaacctttgtcggtgctctcgtgtgccaaactagattgccacaacgcgcctctgtgtttgccataaaaacatgtcataggcagaggaaggggtaaatcttccattcgaggcccacttccatattgtctcatcctcttcccctcctcgcagctgcacctcctggatcgcatcccaaatttgaaagtactccccaatgccccggttggatggagctcctttgatgtcgcgcacccacctatggttctgtagtcctctcgccactgtcaaacccttgcgctccacatgactgaagattaacggaaatctcgcctttatgctcccaattggcagccaatccgcaagccaaaactttgtgttttccccatctcccaacacttgccgtgtggctgagaagaacaggtcatgtaactccttcggctgcttagtctcaacggttgtccaaggtctgtcgcgatgctctcctctctttgccaaccatttaagccgtaacgccatgccgaagaagtttaggtttttgatcgccaaaccgcccttttcatatggcatacagaccgatttccatgccactaaacaatgcctgccactcacctcctcctgtcccttccacagaaatccccgacacttcctatcaatctccttgattgcagactgcggtaattcgagcaccgacaagtaatgaacaggcagagcgaaaagaactgacttgatcaaggtcagacggtctccagtggataggaacttaggcttccaaccggcgaacttcttagagaaccgatccaacaaaggctgaacatcttgcttcgtgagcttccggagtgaaagcggcaggcccagataagtgattgggaacggctccaatctacaacacagaattgactgcaccaaaattgcctgatcctctaagcatcggattgttgtgattgcactcttcgcaaaattcgccttcaaaccagttgcctccccaaagagttgaaggatcgctttcactgcccacgtatcttgctgcatcggccggaaaaagaggaccgcatcatcagcatacaaagaaatcgctggtggccacagcctgcctcccatcccgcacatggcgccagctgagattgccttgtttaccaaggcctgccagacgtccatcaccaacacaaagaggagtggcgacagcggatctccttggcgcaaccctctcatcaaactgaacgggtcacattcctccccattcatccccacagtcgtccgtgtcgtgcatagcagcgaacaaaccccgcgtcaccagcgcataccaaaccctctgtgttgaagcagctgcagcagaaagggccaagagaccgagtcaaaagctcttgagatgtccaacttaagaaggaccatcggctggtgttccgtgtgaaaacgacgagccatgcctctgacaaacatgaaattctcatggatcgagcgtccccttatgaaggccgactgcgtgtacggaatcaggtcccccattctgcccgccagccttgttgccatcaacttggtcgccaagtttgagaaactgtggatcagacttattggtcggtaatccttcaagagcgccggcgcttctttcttcggaagaaggatgatcacagccgaattcaatctctcaaggttttgcgaattgccggagaagaatttctggagggctgctaagacatcacacttgattgtatcccagcaagcttgatagaaaagccctgtgaaaccgtccgggccaggagctttttcagccggcatgtctctaattgtcttccaaatttcctcctccccgaagtcctccactagctctgctaggttcagctgctccaagcctaaattctgaaaattgagccccctcctactagcatcagactcagtcgtgcccatcaccccttggaaatatccccttgtcatctgaagcatatcctgctgggttgaagcccgctcggcagaaatgttgggagccataaaatggtatatgatggaatggaactgaaaatggattacacatctagtacttaaaataggtactcaccttttctttttaatcaaattcatcttccaaagtattgaagtattagaaactattaagagtggcgggctgggcggccgctcggcgtgtccacgtcggatagctacagtgcaggggtggcgattttgcgaaaaaaccctcctctttgtgcgtaattcgatcgaggttcctaacaaacagtatccatgaggtgttactttacgtgaaggtccttcagaaatacggatattccatgcgaaggagagaaaaatcgtgatttaggaccgtgctctaaaaagtgaaaaacgaggggcttttttgcaaaactacgcgcactaatccactccccctcccacaaaccctagccgccgccgccagtcccctcctccctctcgttcattgctcagtatgtatcatcgagaatggtcagttgtattgtcaggttaatgacgtgatagtatttgtagcactgacattacctactgttttcctgttgtattgagtggttttggcaatgtttgcaggtacggattcccaataaactgatgttgggtgatctaataactgaaggcaaaatgaagtaatataatcgcatcaatttgtaatgttgtggggagttgattttgtttttgtttttctgtactgatgaggtgtaggctagcagcgcccgccaaccggcactgaggtaaggagttccacaaccacagcactcagatgcaaataatgggcatgcctctgtctaagctactaagcagagaagcacactgcaaataagagctgagtgagctgggagctgccaatctctgttttctctttttcttggattgcaatttttgattttagattggatatttgagagaatgcataggaaagggaaaggaaaagggaaagggatgcctttacattgtacttatctttccttacgttacctatctcagatgtggtcatagtaatatacttttttctttgtgccacttatctttcctttctatgctccactgatatatcagctggtccatgtgccatttggtgattgctgcttacatagttatttttatttatctccgtacgctatgtgatgttatattcccttctcgatatatgttcagccattcaatcagttttgattagttaatgttcatgcatcagatttgttaatacaaaatgttctctgatctggtattcagcttggctaccagtacatgttacaagttcaatcttccacaagcaattgagaaaggttgcaggtgagaggcaagcagaagcatgacaggaatattgatttacttacatgataaccgttgtgccattaggtactaatactaacactattattttaaatcatgccccttctatagcttgcttctttggctgcatgtactatagctgattctttgctgttatatgatattttgaacttcctacagatgttgtatatgctatttaattttcatttttgttttcatgctctgcagtttcatctgcatgtaacctaaataatttcacggtgctcaactggatcactgtgggtgtagtttcattgctcatttcccatgtgaatattaatttattggcaatcctaattgtagctgccatttgatctcctttgtgatgttttacctgtccaaatttttatcccaacgggcatccttgaggtatatctgtgtttatgttataggtgcgcgctgatgcttggttctgcttcatttaatggcttagcttgattaacctgaaaatgtgaattgtgctctaggggtttttataccatataatgtaatctcttatctttttcagccttggacaatcggaggtcattgagattaaactctgcttgcttcgcatcctccagtaagtgtaagacttaaaaaaaatccatgggtattttttcacttcccagtcgtaacatacatgtcataatgttaagcactaattgatttagttataaactatgtttgagattacactagcaggtcccattaatcaatggaaaatattcttttttttcgcacatagacaagttatatttccaagtaaatttcttcattc

SEQ ID NO: 64693 - DNA, 3077 bp, Oryza sativa
gacctcctctgggcagcattgaaaatatagggctggcaaagttcaggagcaaaaactttgacagatggtagggtgaatggaaactgcatctattccatcaatcggcttctatgtacatgacagatctctttccagatgttatcccttaggtatgccttcatttaattaactccgtttaaataattgcttagccgattcataacgtaattaattttctttcctgacttgcagataagggagttcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgtggatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcagccgattttgtctaacacttgtctcttttacagcctcctcctcctccttcttctcctgtacaacaatcatcgagtgaccaaactccatcggccgtagagagccatcatattgaagaagaagaacaaccaactgcttctgctatcccagtaagtttccttttgacacaagaatttagatcggccatgtctatttagctctaactccctttaaataattattgcaggtcttagccaatcttttctcttttgacataagggactatcttgacgagacagaagaggataccacaagcaaagctttagcccccttatccgatgatgtgaagaaaattcttgaagatatctctcatcggctagaggcaacatcgttagacagcttagtggttgattgtggctcaattagaactcggctacatgaggttcaagctctgatcccagatgagctagccgatgtccttactccagccgtctatcttgagcagcatcaattcaagctggagaaagccaagcaaagattagctgaacgtcaggggcgcaaggatatcgaggccacaatccaggcaaatcgacagcttgttcataaagagaaggccaaacatgatcagctatttgagggcccgattaaatctaatattgatcggctcgaagctcgtaagattgagctcttggcacaacttgaagaatgcaacgccgagctggatatggaacataaaaagctagccgatctcccaaaatctatcgaagaacataaggcaagactaaaatcggctatcaagaatgttgctgatcttaccaagtctttaaaagtcatccccagaaccaacgctcaagatccaaaagccattgaagaagtagaacaaatcaggcaaagggctatttcagctatccagcaatatttgtctcagtgatatcttgtgtaatatgtcctagaaatgttttgtaatcggctaagaaactttggctctttatcgaacttatcttaataacttttatgtcgattcaatagaactccatattgtgctcaaaaatctgcagttttcatatatatgctgtcgggtcccaaaactattaacttggatccgattgagattaatatatcaatccctggatcagtaaatattgatacatgtaatacagctggttcttcattgcatacgataaagtttacaatactaggggttttacaagggtaggtactcacctaattaaacatagatgctaatattacacagcggaagttctagtacattctaactaggaaggtataacctctaaggattttctaagttatcagggtcatcatagtaatagtcataggggtcctcctcttcacccaaatctgaaaaagggttaataagagcaagggtgagtattcgcaatactcagcaagttaccataaaaatatgttatgcgttggcaaggagtgaagttctttgcagaaagcaataatagacaatctggaaatattaaagcaagagtttgtaaaatatatactttaggtttctaaccagggtaccatatgagtcccggtactcaattccgtgagtacggctattcgaatagtttcaaagatattctactgcagcagatgtaagctttacccgcagtccatgacttgctgataatcatcagctttagttatggcccagtattaggttattaacaattgtggcacctattccatgaacttatatcctcatatgctctgaacgtaatgttaacagcagcaagaggagttctggcgttcccgaggtatttaagaggaactggtcgtatgacaccacgtcatctcggtcagggtttagaaatataccatataatttatagtcgagtatcacaaaccattcacctgtacatggtaatggttaaatttgcctttcgcggctatagttgcctcctgcgcgaggacttaaaaataagaaccactatacagaggtaccacattgctaattaacataataactaggtctgtccccattctacaaactgcgttgtacccgttcgttcgacataagtacctggtgataactatatcgatcgagacagtactagccacccgaaaattatccaattcttacgtactgtcccaatctaagtataaaatattttaaccagattgtaagcaagataagcaatactaaattatctaggtttctatggttgaattatgcatataaaatagagtattgaatagaaggctataaataaataatttgtaaaatataagcttaaaagatcaaaaggtagatagtaac

SEQ ID NO: 64694 - DNA, 670 bp, Oryza sativa
ggtagatagtaacttgccttgctcgatatcctgagattgattgagattatctaataggttaggagactcctcaagatttagggttaaacatgtaaaattcaaattcaaaagagattcgaataaaatccaaaaataagcaaaataaaataaaataataaaatagcaaaagtagcctcaaaagatagagaaagattttggtccaagtttcattggaattgggtttatattttaaaagatatgggcttctaaagattgaatttgaattaaattgagaaattagaaaggttactgtagaggggcccacccgtcaatcttcctttctttttcttattttcttcttcttcttccttcgtttcttctcttctgtttcttccagggagctgagtggagcgagagaagggcgccggtgttctagttgacgggggacggcaacgtcggcggtgaaacatgttcctgagcgacgcgcatccagggagggtggtgatcaggagagggagtgagggaggaggccggaacggcgatggctagggcttagctccggccggtatgggaggtgccggtggtggctagtctcagagggggaaaggcaggggaaggttaggaaatggatttgcctcgtcgaggcgaaggtattggcgagagggcttggccggtaatgctccgataaggg

SEQ ID NO: 64695 - DNA, 1294 bp, Oryza sativa
gacgtcgagttggagattaccggattagcttagcatcaaaatgaacctgctactactacggctaataaccttaatataaaacgacaaagtcacaaaaactaattacaagaacaagggctttggtgcgtccggcggcaactggcaatggtgttttcttctaccggttgtgtacgtagccgcttcatgtgaaaaactgtcgatggtggttgtttcatggtgttttctcctctttgacaggataatcccagctagggtatggagtttcattttttttaaaaaaatataatggaaagaatttcattaaataaaattacacccggcctctgcatcaaccaggatgtgcacacagcctaaccaggatgtgcacacagcctaaaaagaataaggaaaagactaaggcaaacatgaacatatcatgttgccttctagcaactcacccacacataaccaagacaaacgcatagagtattattcgcctactccctccgtctaaaaaaaaaagacaaatcttgggtttccgtgtctaacgtttgaccgtccgtcttatttggaaaaaatatgaaaaaaattaaaaagacaagtcacgcataaagtattaatcatgttttatcatctaacaacaatgaaaatactaattacaaaaaaatttcatataagacggacagtcaaacattagacacgaaaatctagtctttttttgggatggaggaacggaggaagtagtccacaacaatgcctttaaggacccaacccatatttgccattctcacccaaaaataggggtagattttcatctagaaccttgatatgacaccttcaataaggaggtgacacacagctcaatccaaatgtctagatcagagctttcaccctagagtcattgatgcttgtactttatgtctccgtgtggctaaagcgagcacataggagcaacaaatgcccccccatcttttaaatgacgggtgcccaccaaaaaagatacgctcacgagtagtcatagccgctgagtcgattttagttgtcacctactaatctttccaattaagacagcggtcacaaccagggttttcaatttgatttcggccattttggttcttccaaaatttccaaaatttcggtatttttggaaattttgaaccaaaattttctgaaattttgacataatttaactgaatttgactaaattttgatcaaattcgtaaaaaattgagaaaaaaactgaagattttggctgagataatcacttgttggggggtccaaaatttcaaaccaaaactgcaatcactggtcacta

SEQ ID NO: 64696 - DNA, 13036 bp, Oryza sativa
  unsure (1)..(13036): unsure at all n locations
ttgcccttggaaattgcattgccattatatcatctctggctactccagagcaatcagtggcaataatggatctgattgaggagcggtgggaagagctagttggtgagatgcctctgaagatatgttaccctgcaattgagaaccatgaatggagaataatcactggctgcgacccgaagaacacccggtggagttatcacaatggaggatcatggccaggttaaagttttccttttgcactgtgctaacttgagatgattctgttgctgatccttactatgcattactcttcataaaaattagtcatgtccaatattatggctgatagcttagatgtcaattcatcacacacaataataaataggtaaactaaagtttattctgaaatcgatcacataatactattcaacattcacctcttctgataatgactttgttctaataatttttattaatcaagtcttatactgtaagatccttaatgtcatacagaagctgtaaaaactaactttttgggggtagctaaggtgcttatggctatgaaattttgacttcttcatctgttttcatcaaattgaacagaaccgacagatccctttgagggttgagtgtggcacttttttttttcctaaagttgatccgatcttcgtgttccctagatagttggcgaaatgtgattctgatgttcacaaccaaagtcacctgaatcctcattccaagatcttaacgtttatgtgtgtgttctcccatctgcagttctcctgtggctgctgacagcagcctgcatcaagactgggcgtccgcagatggcgaagcgcgccattgagctcgccgagtccaggctactgaaggacggctggccagagtactacgatggcaagctgggacggttcatcggcaagcaggccaggaagttccagacatggtccatcgctggctacctcgtagcccgtatgatgctggaggacccgtcgacgctgatgatgatctccatggaggaagaccggccggtgaagccgaccatgcgacggtcagcatcatggaatgcctgaaatgttttgatagaatttttttttcccaaagagaggttcaatgtggaaacttataggagttttgtccaaacatgaaaatggggttcaaaatttactgtaactgtactgtcagttaggacagaagtgtatacgatagatccaagtcgtttcagagcaattttgtccaacttttcgtatctggcttcatcaatccaacagagaagaagtttttgttggtgaaacatttttgcaataattaaacagttttgtcttgacatatatactagcatatgtttctgtgatggataattctttgtaatactttgtaggactttctgttaatatactcctcacatattttcattgtggaaggaaacaccaaggacttttgtatgattgtggcgccattgacgtttacgatatcctgtgaacataagtctttcgtgcacacaccaattaacaaataccattgaaaattttagaaaaaaaaatctgtgcatttactttcaatattattacacttttagttgcagattgagaaatacaataagaaataagtggcattacggcattcagtaattcagtaaaaagaaaaaaaaacaacgacaagatcgtcggtttggaaatagggtaatatactggtggcaaacagtaaaaaaatccaaaatattttatagtctaaacaaacggaaggtttcaaaacttcttgaaatttaaaatcaaggatatatatcagatttctgataggacaggactagaggaacaggccggggagcagggttcgatatatcgcaccggcactttctatcggagggcaccgatacgacggaaaaattcggtccgaaataatttgaaatttaaataaaatatggttcaatttgaataattttgctaaattcaaaaaaagaaaaaaatccaaaatttttagccgaactaatttagttccaaataatccgcggggagggggggggggtggcttgccggtgaggcggtaagtattccaaataaactcatctagtttttgtacccatacgtaaataaacacgtgatctccaaaactccgatcgatcggctcgcggcgccgctcatggaaaccctacggccggttgcgacggcgacggcgacgctgccttccggcgttccgccgccggcggcggcggcggcggccagaggctacccagggtgggtgatgctcatgccctacgccacggccgaacgcgaggtcgacgactcggagtactccacctccaactccggtggagccaagatcaccggggcggcctcccgctcctcgtccggccatctcgtccgcgtctccctccgcctcgagtcgccaccggcggcgtcggggctaagcttccactgctcaccgtgcggcggctccggatacggagctcatcattaccggccctcgatgtacgtcgtcgctgcccacggcgactccgtgctcctcgagatgcattaccagaaggaagggtaccaacaatacgggatcgattacttcttctacaatgccggcgacggcgacgaggacccaccacggcggccgccgtcgttgtcgctctcccgacttatcagggtaccaataccaagccgccccggctgcgtggaggtagcaccggcctcctcgtgcgccgctgcggcgacgacgacgacgacgagctcgtggtggcggcgctcctcaccgaggagtaccgcaggcgcgacacgctggagggcgccgagctcgtcgtgctccgctccggcgagtggagcgccacgccgatcgcgccgatcgtccacgacgacggcaagggcgaggagctctcctactgggagaccgacatggccgtccccgtcggcgaccggctgctgtgctacgtcgacctgtaccgcggcgtcatcctctgcggcgacgacctgttcgacgaaattcccccgcggctgcagtacgtgtcgctccccgtggaggcccccgccggcgcgttcgacgaggagcacttcgaccgccagggcgacaactatcggcgttgtctgctcaacactcgaaccgtcgtctgcgccatcgacggcggcggcgccgcgctcaaattcgtcgacatctcctcccgctgctgctgcggcagcctgggcaagcacaccacctgcgaccgttcgagccgcgccttcgtcatcagaacctggacactgaggatcgacggcgacggcgacgacgacatggcgtggaccatggacgccatgatcgacgccgccgagcttggtccctcgacgcctactccgccctcccacggagctttccactacaccccatagtgagcatggatgatccaaatctcgtctgcctcattgtggacgaagaacgcaaacggggtgcacattacgtcgccgaagaggtggtatggaagatcatgatggatacaaggagcaaggcactagtgtcggtttggcgcggcgacggtcggtgccattggcgacagccacatggatacacttgtattcctgtcaaaatccctgactgctttgctacctatgtgagttatagcaaagccacgacaatgttgccagcgatggtcgacaagataccaattgcaacaccaactgcaaccggaactggcactaatttgtcgcaatctttgccatccgagtcatctccccaaagtctgtatgtgttaatggcttctcctggggagatcttggtagcacttgaagagatacctgggttggattgtgatgatttgctaacagcttatagcattctttgtcgtgacaatggccgtctattcaaagcccttatggggctcccaatgagtatgaggaagaaattgttgctgatagaaattaaggcttatctaaactgtcatgtctgctctacatgtacaacatgatcatgatatattggaatgtcttttgtaaattacttttgttggtactaagtatacattgtgtgattaactattggattgtgttgattctggtggattgtttttcttatttttaattcttttacacttggaagaatggtgccaatattatggttcatagcttagatgtccaatattatggttgatagcttgttgacgatccttaaatgttaagtgtgccatccattcctgcagaaaaaaaactaaaatgaaacactgggcatagtggtagagtttattactaactatttccacaggtgttagtgaaatatttgtatgcaggtaattctgtatgaaaactcacctgccatgtgaagaaacattgtatcacaatcacccgctatgcgaagaaacacatatctggccaatcagacgtgaccacacggatttaagggctcataaatcagagtaaaactgatataattaggcttatccaccatgcattgtcataagaacccacatgtcagcctcacagaaaaggtcggtgtcttgaggcggtggaagtggttgggccgaacaaccaacacggccccccgcccccaccttccacatggagagttctcattggctcccaatgatggttatgggtggtaaccgccattcacaaccgtcattaaatgctataaaaggaggagagacactctcactttacatcacacaactcaggcaatgatctttttattttcattcatactagagtcgagctcaccgagtcttgcctactgaaagacggctagctggagtactacgacggcaagctcggacggtcaagtaggctagaaagtttcggacattgtccatcatcggctaccttgtggcatgtatgatgttggaagacccgtcgacgctgataatgacctccatggaggaagactggccagtgaagccgaccatgcgatggtcggcatcatggaatgcctgaatgtttcgatagatttcattttccaaagaaaagtttgatgtggaagcttataggagttgtgtctaccaaacatgaaaaagggttcgaaatttagtgtaattgtactgccagttaggacagaagaagtgtatacgatagatcgatccaagtcgtttcagaccaattttgcccaaccttttggtatatgtggtttcatcgatccaacagagagaaagtttttgttggtgaaacattttgcaataattaaacagttttgtcttgacatacatactatattatatatgttcatgtgatggatatttttttggaataactattttcattttggaatagctaagaattttcatatgattgtttgtggcgctgttaatgtttacggtacttgacatcataggaatctatcgtgtgcacacaccgtatatatatctgccaataaataaacaaatgtcagaaaaaaagtactgctttcaatattattttatttttgagagcggattgagaaatacgacaaagtggcattatgacattcggtcaaaagaaaaaaaaagatgacagatgatcagttgggaaatactagtgaaaacaatcctaaatattttgaagtctttttttgaacggataaatattttgaagtctaaacaaacggaaagttataaatcttcttgaaattaaaatcatctgtatcagatttcgagaaacgtccgggggtcagatttcgagaaacgtccagtgatctttcggctagctccacaagatacatcctgagtttaaagtcccatcttttttatttatttatttaatattagatcctttcttgatattcgtgtttttttatactgtttcagatttcccatagaactagagggcctagaggcacaccggccggggaatattttgcaaataaactcatctgggttttctttgtgtaattaattccataactccgtcgaccactcgagccccattagatcggctcgccgatgctcatggaaaccctaccgccgccggcggcggcggcggccggaggctgcccagggtgggcgatgctcaaccactacgccgaactcgaggtcgagggcgatggcgaggactccacctccaactccggtggagccaagatcaccgaggcggcctcccgctcctcctacggccatctcgtccgcgtctccctccgcctcgaggcgccaccggcggcgtcgcagctaagcttccactgctcgccgtgcagcaagcacagagttcacggaccctcgatcaacgtcgtcgccgcccacggcgactccgtgctcgtcgagatgcattacgagaagggagagaacgacgagcacttcgattacttcgtctacaatgccggcgccgccgccgtcgccgacgaagacggcctaccacgtccgccgccgtccttgtcgctgttcccgacttactgggtcccattgtcagaggttgagaaaacggcgtatcgtccgcatcagagcgccaaggcgcaccagctgcgtgaagggagcaccggcctcctcgtgcgccgcggcggcggcggcgacggcgagctcgtggtggcggagctcctcaccaagaggcgccgcaggcgcgacacgttggagggcgccgagctcgtcgtgctccgctccggcgagtggagcgccacgccgatctcgccgatcgtccacgacgacggcaagggcgaggagctctcctactgggaggccgacatggccgtccccgtcggcgaccggcggctgtgctacgtcgacctgtaccgcggcgtcatcctctgcgacgacgtgttcgacgagcaggcccccctccgccgccggccgcgctacgtgccgctccccgtggaggcccccgccggcgcgttcgacgaggagcacgaccgccgcggcggcaaccggcggcattgcctgctcgacacccgaaccgtctgcgccatcgacggcggagccacgctcaagttcgtcgacatcttcccgcgatgctgctgcggccgccgcggcgcgacgcagtgcgaccattccggcggcgccttcgtcatccacacctggacaatgaggatggacaacgacggcgacatgtcatcatggaccatggacgccatgatcgacgccaccgagctctggtccctcgacgcctaagcggcctcccacacacgaatccacagttacccatcgtgagcatacatgacccaaacctcatctacctcagtgtgcgcggagaacgcaaacggcgtaaacaccgcgtcgacgacgacgacgacgacgacgagacgatgtggaaggtcatgatggacacgaagagcaaggcactagtgtcggttttgcgcgacgatgatattttctcatggctacttccatatggatgcacttatattcctatcaaaatccccgaccacgtagtaagctgtggcgatgtcacaacaatgccgccggcgaacatcgacaagctgccaattacaaccgaaatcagcagtaatttgtcacaatttttagcattggagtcatctcccaaaaatctgcaggtgtcaaggatggcttctcctgaggagatcttggtggcactcgaagagatacctgggttggattgtgatgatttgctgaaagcgtatggcattatttgtcgtgacaatggctgcctgcttagatctcttttggggctcccaatgagtatgaggaagaaatggttgttgatagaaattaaggcttatcaggactgtcctgtctgctatgcatgtacaacagatcacctacaacatgattgattgaaatatctgttgcaaattaattttggtggcactaagcatgcattgttgattctatcaaactgtgatatttatttttagattttctttacatttgtaaaagttgagccaatattatggctaatagcttagatgtcaattcagcacctacactagtaaaaaaaaaaaaggtaaactcaagtttattcttgaattgatctcataatgctattgaacattcacaagagaagaactttctgttggtgaaacattctgcaataatgaaacaatatgtcttaacattaatgcatatgcacatttctctgatggatatttcttaagtaggatttttcattgatttgtggaagcacccaagcctttaagatgaacacaatgaagattgcttgtgttgccacaagcaaggttcacaatttccgaaatttcagttcttttagaggggtccgatggaaatggctaccggtcaaatattttgatcaaaagggtcaaaatcagtcaaaattcttaattcctccctttctcttccctatttgtatcacttgattcacttccctggtcccttgctattgtttcctcacgaggcgacatcttccttgcagctaggcggcgcgccgcagctattcctcggcggcggttggaacggcggaggagcagcctctccggcgaagtcgacgacaggcgccgaggtggggcgggcgctccccacaccgatgcggcgcgcagcggtggagcggacactttggaagacattgatagccacaatctccggcgacatcgacggcaactgctcttcatccgtgtcatgggcgacggcagcccaagctgcaggtgtgttgttcctatggtgtccttttcattgtgaatcatgaatgccctcgtttgttttgttgcagaagttgctagaaatgacggatctcttgtcaaatttcctcattttttctgttcgagagtttaaagtttgtttgaatatttcgttcgaaatatctgaaaaatatccacaatttcatatttttctaaccaccaaaattcccccctttctgatacattgaaccctggcaacaagcttataatattgttcaataaacaatcaatgttagacttttaataacggattgacacataagaataatttcgcaccgtcggccgcccctttcctcctcgtcggggtgctgccgccgccccgctcctcgctacatccagcgggtcgatggctctcggcggcgcggcagggtgatggctccctggtggcatggcgggtcagttgctccttgacgcagcggcttcccggtggcgtggtggttcaggatctagcccctgagctcgggacctccacgggagcgaggcggcgaggtagaggtccagcgaggagcagcggcggcctcccgctcgctccttcctctcctctcatcatctcttgtgttgatattttgtctcttgagttgatattttgtgatgatttcgattttgatttggattttgtttttgggttggattggattgtgtgataatttggggtttgcagaggaggtgcgcgctgggcgacggacgaaaatcctctatggaagccttatgattttttttatgaggtatagatttgcacttcagcattaggttaaaaaaaaacaatgacatatcgtcaggttgaaaatatactgttgacaaacagataataatccaaaatatctaagtctaaacatacatgccaacagaaatatccaaaatatctaaagtctaaacataataatcaacaaaccatcaaaagtgcattcgaggcattaggagctaaagacaaggaaacctcacgaattaatacatatagcagcaaacacattnttgtcacagattagtacaaacatcttgagtcaatgcttttcccccttttcggtggactgaccaaaacatgtagcttttgctatttctcagaccaaattatggctatagccgctagaatcctagttgttcttcaagatcataatgagtcataattgagttgttagatctaaacgtacatcaaaattatttcatggtggtgtcacgaggtacacaaaaggtttaattcaagcggtgaaggatgaacttaacaggaagaccaaaaggattataacacaagttgacacagcattaggtgaggatgtcaactaccgtagaaatttatcacatttatttttctctccaccaaacacgtacggagagtcacatcgcattatcttaagaatcaattctcataatatgtcagaaaaaaagaggataccaataaattactcaatataagcaggcacataataaatgttgatatagctaaaagtagagatacaatctgattcttctctgctgaattaaggctgagtttgttcactggctttcccaactcatcttcatcgtttttcgcgcgtacattttccgaacggttacatggtgattttttctaaaaatattttgatacaaaagttgctttagaaaatcatattattctactttttattttaaaaagctaatacctaattaataatgcggtcgttccgttttatgtatcggagggattagttccaaaaggtagggaacaaacgcagccgtactgcagccgtactgatcgagcgggggtcgttggttcgttgagatttttttttggaataagtccactttgactttcttaactagtgcccgaatctgattcgtatccctacactataataccggatatcttgaccccctaactattaaaatcggtgcaatttgactcctccgacggttttggagaacggtttcgctgacgtggcgtccacgtggcatctcagtcatcaaataaatttaaaaataaagtgaagggcccaccctaaattaaaaaataaagcggcccgcggcgtcggtggcgattacgcgagtggtggccgccagagctgggcggtggcggtgatgctcgtgctgtcatgcgctgagaagaagaaagaaggagagagagaggggaggggggaggatgggagagaggtagaggaagaagatgacaggtggggcccactctatttttaatttatttgatgactgggatgccacatggacgtcatgtggacccccgattttggaaatcggaaatcatctgtgtttatccgtaccaatccctggatcagtagttggtacacacatagttgaatcacaacatatcacgaatgaattcaggctaaaagatttaaatacttacattagggccaggtaggccaacaactatcagagaacaacagcggaagaccaaataatataagggcccggttaacatgccacaggcagtcgactggggaatgagacctagaacaagaccgcactccgatcatcttgttggatacgcaagcgtaccgacaagggcttctcttcaacactctcctaaaagatatataattagcaagggtgagtaccaaccgtactcagcaagccaccacagcaacgatgcatatgatagagggtatttcaaggaatggcttcaggttcttttgcataaagctagttttgcagttcttttcacaagcctaagacctagcatagactgatcaaattttagtaccagtattcacattaaacaacgacggttctgtccactatccattatgatcccaaggatagcttcccgccattgagtcgttatggttttctgaggacgtccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatctggtttactcacactgcagtggatgtacactttacccgcactccgcgactgcccaacacatgagcctcgtcccaacacatgagacgcgtcacggcaaagcttttcgataaccttgcattggcagtacccgctccatgaacttaaatcctcatgcactctaggcatccatgtttctagcagtgagaggagttctggcgctcccggggaaagagaagtctcacacgcatattaaattatggttcaagttaagttctctctctcacacactcatggcagtcctaccaatggcaacaccgatgtagggcacgcctctcggccctacctcaacggctgtcccatcgtagcgcacctgcctcactcaggggtgaaccatctatgcagggatactgcctccgctcggctatctaatctgctaggtctatacccattcgagaagtacggttgtacgggagtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaatttttacttgtaaacaaaacaatttcgcaattaggatcaacatgttcgaggaatagtgatgacttgccttgctcaggatagtccttattcttgatataattcttgatcaaccttcacctcctggaagttgctgacattgcctcacgactaaccgatacacaaagtctataatacgcgagaaaaaccaatattcaagcaacaatcaaatatgcacaaacaaaatatatttgttgaggttgaacctaaggttgctcatattattcgcgcttgctaatggtttccaacatgctaagggctaaagtttcttaatctttctgttatcatggtggtctatttaggagctagccaatgtagtatgaatgagatacgtatctggctactatgtggtttagtctagcaaatggctattcatgcatctatctagatagaacggttatacactagaggttttgttgccggatggatttggatcggtcaaataattactgtgaatcatttgtattattattttattgatggaggctttattttaattatgtacatattttacttgtcaaaataaattataaaggttaacaattacccttgctttgtatgttagaattgtttaggttaatcatagtatggttacagattatcccatcacataattttacaatgaataatcctaatttacagttgaactataattataattatatgaggtcaagatttataactagtatttatctaatatacatgtttgtcatacactccctcttaatttcatatatgcaatacgcaaattaatac

SEQ ID NO: 64697 - DNA, 1532 bp, Oryza sativa
ggggacgccgcctttgtacgcctgcgtcttcatcgcgaagtagttctccggcgacctcggctcgacgcagtgcttccggcagaagggcacccacagctcggcgaacttggcgacctccaccatagcctcgtagtggaccagcgtcccgccgtcgtcggagaggtagcaagcgtacctgtccaccgggtagtcggcggcgagaatggagaggatggtgttcacggtgtagagtatcggctcgtcgacagggtcgacggtggtgacgaagacgtcgacgccgggtaggtcgccggagtgccggtcggcgagggcggcgatgtccgggacgcgcttgatggggctctgcttcggtagctggttgagcacccacgagaagccgaaccagacgtcgccgaccatggacattgtccacagccacgcgccgtcgcggttcttgtgacgtatgcgccacgcgaagaaggcgacgatggcgatcagtcgcgccaggatcaagaacctgtaaggatgaaggatgctgcccttgaccttgtacgtctggaacagcggcggccggccgccgccgtcgctgccgcgggcccccgacacgtccgcttcgtcgacggccacccacacatcgtccttgccgccgtcgttcacccgcgtagccgcgggcgaccagcatccgttagtccagcttgtcaccgctgccgccgcggacatcgtggaagccgtggtggccgccgccaagcatgcaatgcacctagttagctagcccctccttgtccatggcaaattatttcacgccaagggggctttatgcctttatgtagcgccgcaaacaacatgagtttcatgggtctgtttgagagcttcttgcaactactgtactgcttcttctaaaatcagaatctcttttaaacattattttttaaaattctatgaatccaacaatataaattagaaaataactaccaactagttaattattagaattttaagcttcaccctaaataatgacatgtctacctaccaagtcaatttgctactattgctactatacggcctccaccagaccaccacactagcgcaagctgagcattttactttctccgtaccaaattattgctacctagaattagagaattttggtgagagagtagtgatttctatgcccacggtttctttatcaccaacactatcatactcctagttgctgcaagtttgataaaagagaggacaaaaaatacatagctcgagtatagtgtgttggctgcaggaagctactacctccgttcgatcaaaatatcttatattttgagacagaggagatactagtcgagtatagaaacagaaactacagattaattcttgttcttcgttgactagcagatccaagtcacgtcttcaaagaagaaaatgttactacgctgcacgcctgcaccagcaagttttcatgttgttttatctaaactagcatggcggcccgcgcagattgcgcggctagcattgttagattttttttctcatacaatagtttaaatattttcatattt

SEQ ID NO: 64698 - DNA, 23260 bp, Oryza sativa
attcctgcagcccacttgcttttatctcacaatttttttcatcgcttaaagggggattcctacaaaagtttctcaccaatttggacctaaatctttttttcttttttttttggtggcgggggattggggagagaaaatttctagcgtactatttatatattaccatggcatgtaatttgtgtacaattcagattgcatgaatctgacgatgatggttttttagtctgtctttttttagtgtctcacacggttttcaaaattagtgtctgatacgttttctaaatcgaaagaaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatattactttatagatataatagattctgaatttctgatgatgctatcaagcgcgtgtacgtacgcgtgagcttgatcggatctttacaaaatttaattacagtatttttttttgtgaaaagacgagctgaaagttgaaaccagtgtactagcttgctgctgtgctggtcagaggggaacaaaaaacaatttttatttttttaaaaggcgaggtcaaagagagcaccggatacgcgaagctgactggtgtacacagcccaattgtaccaacgcagcctccggctcgtacgaccagctcgcccactgatagtaactgagatattccatctcttacggtcttacctaaccttgtcagttgccagtggagttgtttaagttttcctgaagaaggttacggagtaattagcataagtaaagcgagaagtctgtacttatatatatatatatatatatataacatataactctgcgaaccgctttctgtttctacaatatttttatagttgtctacttgtctatttatagttaacttgtttgttctaggttttttatatgcttagacttctttccactcagatattatattatacaattgcttcaggaatacatttatgtttgggaagtgctggacattgcaggagttgtgttccaagaagggactgaggaatgaggataaatccaatggagatggtcggccaacggcctctatacggcaaggtctgcatacaccatgcagttcaggggaaaacaagatcagagtccgctattctcatatagaaaacttgggcgtcggccaagcaaaagttctggccaaagagcaagaacagaatatggacgggggatcgattacaatgccgaggctggctaaataactatttttgccaactgtgttttagaaatctggaaactgtgcagcacctcttcaaggagtgcctcttcatacaaaggagtgcctcttcatacagagggtttggcaggagataggccaccagatcagaccaaatcgattcttgaacacgagcaatgatgacaccctactcaattggtggcaccgaccacgctttgggtggtttggatagaaagaaacaatcgcatcttcaggaacatcgaatctacaccaccggtacttacaagcaagattatggatgaactccaattgtgggagttggcgggtgctaagggagtgcagtgtataatgtcgcgagaataggcttgttttaatttctactcccttcatcccaaaatataacaacttttagttcttaggatttgtcccaaaatataacaacttctccactaacattctcttctcaaccaatcacaaccctccaccattcacttttcccacctacctctactgctcatccaatcacaatcctccaccattcacttttacctaattttttaataaccgtgtccaactttaaaacttcttatattattatgggacggagggagtagttacttgtgggagacatttttgttctaggaatgtcattcctgctcctgtatggttattctcttccttctataatataaaaccagctttgttgggttctttaaaaaaagatattatattattatatatattagtacctcttctctatcaatatatacgaggcaaagcttttgcccactttttttaaaaaaaatgttatatttaaagagatggatataacaaatttataataaaagtcattaacttgattagaatatcggactgaaccaataaagtccaaactaatctgatgtgagtatgtaactttaagcaacaatgcataaaaaattagagacgacatataagataggcaacgcttgctttagcccgaatagagcatcggacctaaccgagaaagtcctagcaacgccaatgaaagcgaagatgacggagctcacttctcgtcggagatcgaacttaaccgatgtatcccccctcgaaattaactaagaactcgccgggataaaaagggtggtgatgcgttgaaaataattgtattgatttatgaagattgattaaaacaactttggttgtacatatttatacctccgggttgatactagtcttgatcggacacaatataagttttctaaagataaaaataaaagatataagtcaagatcagacactaaacaaaactttttgaagataacagaaaattactaaattatgtccaattaataggtagaattaaattgccacactatgatcttcacgattccttccggagattggtctcttctgcataggtttacattagttgatcgacttctttccttacatttttttttgagaattacacagtacaacacagacactcacaacgcacgtgcactcacccctatgagcatcttcgaagactgggccggcaaatcctggagagattgacgaagtcaccacaggcgcctcgctgtcgacgggtacgtcgtctaccactgaaagcacaacgccattaaatcctggaaaattcgctcccatggggagtcgaacccaggacctcgggtgctactgaggctcttgtaaccactaggctacaggccctttcgctctttcccttacctgaatgcagtaaaaaaacataccatattttggcgttaatagaaggacaacatgaagtcatccagacatataaagagaatactaatatagtctgtcaggaagctgaaaaactccggagtgatagcattgtactatgttcagactactaaaaatctggcaaatcagttcactaagggtctatcgcgtaatgtgatagacagtgcatcgagtgagatgggcttggatccacttgagttacacaatagtgataatccgtcctttatgattagagatcctgtgaattaggatggtgaaacaagctatttggtagctaggaggagagacccaaagctcatttctatgatgtacttatctccttatttgtatggtgggttggtgcattcccttatgtgacctgagtggcttttcttaaacaagatatgttagcctacagaacatcttagaaggaacacacctatatgagtccgactgctagccaaagtctatgagatttaggtgatctctagatactcatgaaaaggcctggagtacaacttatacacaccacacaaaggagatgctaatgacagtctagtatcaattaagaaattgagtaaagcctaactgcacaagaccgacaattcaaggaatagtccattgttcagttgtggtcaggtgtaactcctttttctaggtgaaagttcaacttcacagtctacgccgaaatactgagaacatttctgtgagctctgaaattaggtggggattattgttagaactaaatgggttaggcccaatttattcctagtaaattctatgggtccacagttagtgttaatggattaataccagtttgaaaagtgtaacgcctcatttttcgcgagacgttaaaaaacctaattaataaaatcctaattgcgaaaattttcattctttgtgggcgagtctaagtcatgtcgtggatctcagtttaaatctccttgatccctctcgtcgaaatcaaaaattgtctcctcgaaattcccattccaaagacaactccgacattcaatctattcctttgaatcctcgccaaatacttgtccccgattacaagaaaatattaaatccctaccttaaatccatccatgtctatcgatcgacctatctatcgccctatccatccatctatctattgctctatcgtcatctcccatcgttccgtttttgaatgatgactttctccttggatcctttcctttacctctccgtccgtgagttcgaacatcacatttgaattcaattctaaatccaaatccgaatccaatacctccaaatcaaatcttttggaaaagtctattttgcgtccctcttggtcgttgggccgtttctctcttgctcggcccatcctcttcactcggccctcccattcctcacgtgcagcacacgtgcaaaccgagagagaagcagccctctcccccgagattgctaatccgcgcagacgcgccagattagcaactcgcgcgcactccgagtccgtagcgcctcgtgttccttttttttttccgttttctgtattttcggttccacttcttgcatgggaggttaagcgcgtgggcccactagtcattagcactaataatagtgctaagcgtgtagattaatttaattatagattttattatatcaaaataatatacaaatagttaagttgaaaagtttcagaaatatgatgaaattttcaaaagttgagttgaaagtttttttaaaaaatattttgaaagttaaaatttcaaggtgacggttttgaaatttgatttgaaagctttcaaattcaagtttggaagttttcatatttgagttgaaagttttttaagttttgagctaaaagttttcaaatttcaggtcgaaagttttcaaattctggtcgaaagttttcaaattcaggtagaaagttttcaaattcaagttgaaagttttcaaatctttcaaattccggtcgaaagttttcaaattttgagttgaaagattctttcaactcaaaatttgaaaactttcaagtcaaaattaaaaactttcaattctatatttgtaaagaggtgtgcgaaagattaaaaaaatcgaaaagaaacggcaaaaaagaagaagaaaaacacgcataaaatttaaaaaaaagtgtaaacattaagaagaaaaaaaaagacactgggagaaggccagctgccgcgcgcgctagctaaattgctggcgcgtacgcgcgctagcaacccccagtggaagggaagcagatcctctgactcaactgcacacagagtatccctttcccggtggatggcagcgtgggcctttgagctttgaggcggacagtggtggcgtgcgcgcggcacgccggccggacggcaccgcctccgctctatccgtgcaaggacattgtaccagaggagatgccgagatgggcagtaggcggtgacgcctcttcatgtgcctcggcaaatgatggctgagacagccggagaacgacgctcacgcaagattgattcttttcttttcctgtttcactcattgtgttggagaggagtcgaggcgcatcagtcagaacctcgtccggaacagcgtcctttcttggacgctcttcgaaagtgcgtccaaatctgaacgttattggcaacagagttcattatttttacaaattcgaagaaagatttactaattatttaattcaagtacgtcactaataattactataaataaaaaaaatcgagaaaaagcaagtgcacctggagtagattgggccaatggaggaccgcggcaagctgatccactgccgacgaatcaaagccgtcctttgccttaagcaacttagagcaagtataatagtgggctataagaaggctgaatgctgaggtggataggagaaaagaggagagagatgagaagcgggctgtaagtttacagccggcttagacacaggaaccaagaaaatctgtgagacagacatgtggaccatatatttatagtgaagagttaaccactatatgagtgaggtgatagataggctataagtaagtagctggctgcattattatccttgctcttaaggggttgtttggatgttatgctaacattattgtcattaacctgatgtgacatcccggtccagggtctaatagaattaatagaatactcatatcaacaagttgcaactttttttggaaaccgatttccaaagaactctgaggttgttggcggctgttaaatgtcaattctataccgccaacatttacataaagttcaaataataaaacatccaacatattaatagttgcttaatctcacatattccacaagtgttggtgtatatttgtatgcaggtgataaaccccgatgttgggaggaaatctagactaaagtgaggaaaattatgtatccctacaaggatgagttgtgaacttaatcaaaacatcagtgaatcaacccaaaactccgagaaatggatagaggccaggagggcccagcccaggttcggccgaaccccctgatcgccgttgatcctagggtttggcgtggacgttccagatgttctcccaatgacggttgcggggcagttcggacatttccccttctcacaaccgtcataactgccctataaaaggacctcacttcattcactctcacacacacttccaagtttgagccgaattataagaggctctattgtacaatattgtctactagaataggaagagagtagagtagaagaggtcggaagaattccggagttgccggtaatcttgtcctatttcttttattctgtttattactctgaattcaatataatatttttcttgagtaatttagatttatcttgtgagaattatctcttagttagttcctaaataacatacaggattattgttcactataatcaactaaaatatagtgattactttggtgagttataaacacaaaagtagatagaaattccttagacgtggtgtttaggtaattattatccagtaattgctgcgtatcccacagtacgtttgaggtaggtgtagaggtggtgacagctctcgagatcatgtcacaccccaatctgataccgccgtacaacggcacctgacaggagcgtgtcgtagggaaagcggcgcgaaccgcttcctacgaaaccgcgatctcggtaccagtcccaggacatagtgctggtacccacggtgacaaatatgaatcataacaatccttaaaataaatagaggacttatttaccttaacttaggttgcagctcagacagcccgagaatacaaccgacgacacggacgaggcgaacaccaacaacaacagcagcggaaccaacggtctaacacccaacaccacaggcgacggctgggaaccagggcgaaaccccaattcttcacttcacttcaccatctcttcagggcggaggaactatatatatatatttatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggtaatgtaccgacctcccaggtcagatcattacttctcggctcccagagcctttttcattttctcggactcccagagtctagctacccagcagcacaacaatccgcttccactcgggaagcctagtctatgatgcccgcagacatcccgaatcacacagattcgtttcttgaccactcaggtcatccatctgccacataggctgattctggttacgattcccacaccacaacaacttttcacaaagcacaggcaaacaaatctacgcaacgggaaccacctcacatccgcccatgaccgtgggcacggctgtttgaacagttagttaacctctgcagaggggtacactttacccacaagacacgaacttactccagacactggccggtgtcagaggttcgcgacaaagcctttcccaagccgacccagggatacctcatgccacatcgaaggatcaaatcctcacataaacataggccattttaggcgttcacaaatcaaactccaaccaccttgatcggtaagtgagcaagcttctcgtccttgccttaccaggaacccggtttgtctgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgctacataggcacaacccccgcatcgcgagtttttacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacagaaattagtgcgactactgggtagatccgtcggtttggcacgcaaaccgaggccaagcaagttaagtgtgtgattctaataatgcaagttgcaaacaaaataataatgacttttcaattataggggcgattgatcaaagggtgacttgccttgctcaaggtcttctcgaagcttcacgaatcttcgagaaaacccgcgatcgacgaaaatccgataaccgcaactatacacaaacaatcgaaaacctaaacaagagaccaaaagaaagatcctatttagacctattagtagtgccattaaatagatctcaattttacggaattactggaagtggaacggaggcgatcggagctacggatcgagggatatgaattttggaggtctaaatggattttctggacaaggaaaaggaattattaattcccttggaaaagaaaaggaaggagggatcggatttagacttcctcgggcgacttaggcgcggcccgagggattcacaaggcttggccggccattgggccgagcgcggccacggggaggcagcccattagggcgcgcggggagagagggaggcacgacggggtgggcgcggtccaccgcgcgggacccacatggcggtggttaggttcacggtgggaagggcgcacgcgggggcgggcgctagggtttcggttgcgcgcggttcgggcgcggcgcgccgggtggactgatggcggcgggcccacgtgcagccgcacggcttgtcgtggaccgcgcgcacgggagggaagacggagggaggaggctgactgggcgcgacttgacccagtcaagcgggcccggggctgaggtggctgccatgtggtcggccacgcgggcaggagcgaaaggggaggaggaggaggaggaggaggcgcccgggatcggacggccgacgacgcgcgaggcgttccggcgagcggcggcgaaccggagcgagcggccaccgccggcagctagaggaggtcagggggaatccgtttaacggcacggatttgagaggagaggtacgacggtggctggcgacggcgaccaagctcgtcggatcggggatgtggtcacgcgagggaagggacaagggggcgcggactcgggcctagccgaaacggtacgcgaccgcgatgcgcacgcggggacgcgggacccgatggtcaccggcgacgcacgcgcggcggcgttaggcagcggcggaagcggcgacacggcgcggagacaaaggagaaggccgacggccttggggcagccagggggaggtcatggggatccccgggagcgtggcggcgagaggaatcgacgcgagaggagccgacgacggtggattgcggcggcggcaatcactggagagcaaaaggggaaaacatgacgagacgacgagggttcgattcaaaggggtgggagcatctccggggttcaaggaatccgtttccggcgtcggattggacggagcggcaccgagattggctggcgacgagagacggtctttgggagcgggcggcaatggcggcgaggccgtgccgggcggcgacggcgctagggaatggtttggggaggtcctagggagctcaaggacggtggtggcgcgagggattggcgagggggcccatggcggtgcacagtcgggcgcggcggcggcgaagcagagcaacggcggggcggcacgtttagggggacgagcgagcaaccgaacggctcggggcttatccaagacgatgcaaatggcaagaatttgggcgaggagctcaccggcgagagaggagcaacgttggcgatgcggagggagtcgtggcgaggtggtcgcgacggcggggcgggggcgagcaactggcggccggcaacaaaggcgcgggtgtttcgagcgaggcggagacgaaacgagaggggagggcgcgggctttataggcgaggaggagaggtcggtttggaggagggaaaccgacattggcggtcaagggagctcggctggtgttcacgggcggcagcggcggtttcgtgggcagtgagaaagcggcgacggcgtggatgcgttgggcggcgaaggtgatggatcgagcggcggaaatcgaaccgcgggagcgtgggctggcgtggtcaaggagagcgagttggcgcggtcggtcaagcggcgcggaggcagtgacaccggcagtggtcgggaaagggaaaaagaaggggaaaaaggggcttggtcccttgccataatgaggagagggagagtgaggaggaggaggagagggagagcagctgcttctcccactcttggacgggtgcggcgtggagtggcgggggccatggatgacgtcgacgatgacggcggcggtcggtttggcatggagcgggggcaaggcggcagcgcatggcgtcggcggcgaccggccggtcggccacctcgcgaggcgagcgcgggaatgggcgaaggcggtggaggttttgggcggcgacagcgggaagcggtgtcggcgcgagagggaaacagagagggagcgagaaaacgagagagagaaagaaagagggagagagagagagatccttctctcggcgatggctcgtgcagcgcacgtgagggagatggcaaaggagagagatgggctggggaggggagatgggccgggggaggaaaatcggtccatccaaaaatacagggaggtaaagtagacttttacagagaaaactgatttggatagaattggagagatttagggtttggattcgaattcaatttgatattcgaactcgagggtttagggatgtattaagggaaactcaaggaggagtcatggaaaagattcaaaaggaatacttgggtatttgttctcgggaacatagggtggagtcaaggaaaggattcgaggcgggatttgaataattctggattcgtagaagtatttggcgaggattcaaaggaaggatttgaatttcagaatttgatttcagatactcgaatcggaagaggaatttggatgagggggaggattttgatttcgatgagagggaacaacgggattaaattgggatccttggcacaacttagactctcacacaaagaacgaaaattttcgcaattaggattttgccgagttagtttttaacgactcacgaaaagcggagcgttacagatcacttaagtcctccctgtctgggtacgtagtaaagcgacatctgggaacagcgggttgccagtgcctgaagtattgcattaggattaaagttaagctttccctagacactgtttctcactagtaaatcctctctatcctggcctatcttttgcttggtatccttggatgaaccagaggaagatttgaccacacacgttttcttggattcgatacccttataatactccgtagggaaagtgctacatcggtatatccgtacgcttgcggattttatcagtgtccgtattaaataccaatagaggttaagcgtgcttggcctggagttgtgttgggagggcagtctatgacctataaaagatatcagatgtaagtgggccggctgggagagacaggatgttacacctgagttatggctaacaaaaataagccactttagctagcaaaagaaaaggacactttttttagttgataacacgtgacagcataaaaaatgaaagggcatcttgtcataagtgcgaccatgaattaaataatgagctaacttgatcaaatttgtctaatatgagatgcgacaatcttcggaagtaaaccaaacaaccccttagattaactattatagttctaatttctgaagatgataaaagatttatacttgacctccatttgttgggtgtaaagttaaaattagtgtagtacttgggtgcaaagttaaaattagtgcatatatagttacatatactcgtaggatcgtaaatagtctttttaattaccctaaaatctagcttctgaggtaagaggtttcccactcatatattagatcttttgccctttttacaaccaatatattactattcaccaacactaatatgtccatgtgctctcatcttctgcataattaaaaaactttaaatgcaaaaattcaataaaaagttatttaagagaacttaattagagtcaaaatgtcatgtcgaacaaattcaaatcatcgtaatttcaaaacaaaaattcaagtatcacccaagtagctgagtagcctatatagactactccctccgtttcaggttaccgtttcaggttataagacgttttgactttggccacagttgaactgtttcaagtttgactaagcttgtagataaaataataacattttcaaaccaagacaaatttattatgaaaatatattcaattattgatttaatgaaactaatttgatattataaatattattatatttgtctataaacttagtcaaatttaaagtagtttgactttgaccaaagttaaagcgttttataacctgaaactgaaactgagggagtagtgaataggttaaaattagtgcacttgacttttagagatgtactagcatagttgtgtatttgcgaacgtcttctgtgttaaaaaaaaatcgaacagagtaaagccgtaaaatatatccgaacatataaagtcgacaaatcacgctggagaaattcaaatcttgtcatttttaaagaagaacaatccaagtctcactcgtatagagcagactagcaatatagtcagccgctcctatgacgtaacgacataacagaagtaacaaccaattattgcaccaagaaaataatcaaatattcaaatcaaatcaaacgcgatcgaactgtccctacccggatggcccggtcagcgacgccgccgcttttccgagagaagcagcaccacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgacaatgatgacgatggtcggtatcagcagcggcacccaccgcacggtgtacaggtcggcgaacttgtcgccggagctggccgtcgtctgcttcgacgtgagccggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatcacgtggatcatggcgatgacggcgacgaggtagaggaggtactcgccgaacggccgctggatgtaatactgctcggagatgagccacatcaccgggaagaggttgtagaagaagatgaacacggtcacgatcgggtaggtggacatattgaggtaggcgacgcgctgcagcgggtggaggcggcggccggcgaggagcgcgttgctgtgggagaagaacatctccagcgagccgcccgaccaccggaggatctggtagaggcgctcggtgaggttgatcggcgccgtgccgcggaacgcggcgggctccactgaggcgtatacggagcgccacccctgccggtgcatgcggaacccggtcaccacgtcctccgtcgcgatgttgtacacccacccgacgtctctcccccatgacgtcccgtcctcatacgcgcacgccgtcagggcggcgaggtcgccggcgaccgactcgtcgagcaccgccagcggcgtgatcgaccgttcttggttggcgccgtccagcatcgtgccgacgaacgacgtcgagctgccgaacttgttggcgatgtccatagccttgatctggctcgccgccgctccccagcgcggcggctccacgccgtagagcgcgacgcggcggaacatggtgccggtgccgaggtaggagggcccctggaggccgttgagggagagcatggtgccgtcgaagaagacgcggttatggttcgcgtaccggtccgtcgggtcaacgtcgtcgaaccgctgcgggaactggacgaacgccgtgttctcgccgccgcggccgcggccgtcgagcatgaagcacatcggcgccctgaacgcctgcgagttgttgacgtagtggtcgccgtcgaagttgatgacgaacggcgcgttcgacagcagcgcggacacgcggagcatcacgttcatggcgccggccttcttctggtggttgtatccgggcctcttctcgcgcgagatgtacaccagcatggggagccgcacgtcgacaccgctgaaatcaaccggattctcagcactcgccgccaatccaagcctcggtttacagcttggatggttcagtaaaacctatcaaaaacacacaaaaaccattcactctgatacaatttgcccggacaagattggaaacagaaattaaacatgtatagtgcgcaaatacctgaacaattccagcatgtttccctctctggtggttgtcagccggctcaaaccatgtgccgggccaatgtgtgccatcagccatccatgtcgcattttcgccggcatgtttggcgttgtacacatctgatcgctggcgaatggtgctcgagagggagtcgatcctgaccttgaactcctcgtactctcgccgcacacgccggtgatcgctcatcagctcgccggggacgccgcctttgtacgcctgcgtcttcatcgcgaagtagttctccggcgacctcggctcgacgcagtgcttccggcagaagggcacccacagctcggcgaacttggcgacctccaccatggcctcgtagtggaccagcgtcccgccgtcgtcggacaggtagcaggcgtacctgtccaccgggtagtcggcggcgaggatggagaggatggtgttcacggtgtagagtatcggctcgtcgacggggtcgacggtggtgacgaagacgtcgacgccgggtaggtcgccggagtgccggtcggcgagggcggcgaggtccgggacgcgcttgatggggctcagcttcgggagctggttgagcacccacgagaagccgaaccagacgtcgccgaccatggacattgtccacagccacacgccgtcgcggttcttgtgacgtacgcgccacgcgaagaaggcgacgatggcgatcagtcgaagaaggatcaggaacctgtaaggatgaaggatgctgcccttgaccttgtacgtccggaacagcggcggccgggcggcgccatcgccgccgcgggccccgcacacgtccttttcgtcgacggccacccacacgtcatccttgccgccaccgccgtcgttcacccgcttggccacgggcgaccggcgcccgttctgcccgtcggcgccggccgcgacgtcaccgctggtggcgtccacgcggagggcagcgttgatccggcgagtcactgccgccgctgcggacatcgtggaagccgcggtggccgccatgcacggaacacacctatttcactagctagctcctccttgtccgtggctcctccttgtccgcggcgaactggtgcacgccgagctggcttcatatagcgcggcaaacgacatatgagtttcataatgtcgtctctgcctggtcaaagtactactgctgctagcctgctagtagtacacaacaagaaggcaagaagccgccacccctgcagtgcagtgcagatgagcattttcctttctgcatcgttctactcgtccttctaaacaaactactgctatgttcgtcccataaaaaaccaacataatattaaatgtgatacatcctattctgatttattgtattagaatatatcacatccagtcctaaattaattttcttttggacggagggagtaagcaacaattatagtgtttggtgggaagtctgttcctcatttttacatgtcatataaaaatgcttttaagaaaataatagtataaattaatttaatatatattactccataaacatgtatgtttaaatgtaacacatataagtaggggaaaaacaaatttgactataaacaatatgtagttaaatttatttttcttctatttgtattagttatttcataacccttcccataatgttattttaactattaatactgatttatgcaaacagtaattctagcttgtgtggacactaagtaattataaatctaatagaatgtcttgacttatataaatctaatgtacttgtaactgcatttagagttcagttgaatgataacgtgaaatcgatactgatcgaaggtaaactgacgtcataaagaaagagccttgcggtttgttttgtcttgtgctgcgatatgttttttcttgtgtgtttctactatttgtatgttccgatatgtaatgtttgtcttgcatgcgcccatatttgtatattttgccttgcaagtgatatctgtaaaatcccgtgaaaaagagcggagtaggagacgacgtagacagatctgcactccaggacgtaggttgggcttgtggacggagctggactcatggcctactccggacggacctagacttctagacgtacatgagcgcgatgacaaaatctatacctctatatatatatacctaatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccaaatctggcggaggcgaggtccggcccgccgcccctcccacccccgccgggctgcaactgcctccacaccgtcggatctggcggaggcgaggcccgaccggcgttccatgacgtccgccaccaccaccactgccgcacctccccaccatgcagagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagagtttcggcagctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctgggatgggaagtgcacttgcgcgtgcacaaaaggccgtggaccgaccggcaagggccggaaataagtctattttaggtccctcaggccaaaaaaagagaataagtttctttttagtgctcattttttcagaagcattacaattataagttattgaatgtgttcatttcgaagcaaacctaaaaggaagtattttctttcttttttccaagtaaataattgttaaatgacgtttgtattaataaaattaacaattaagctctgaaaaattcaaatataatttcaaagagcgtaactaatcatggagaatttaaaaaaaaattaaatttaaccatgtcattttatttctcacacttgctttacttgtaaatttatttaattatgcacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtctctactacttaaaaaataagagatgcttccatcgtccgtcaaaaaaaccggcgaaaaaaaaccgggcgagcgaggaaaaaaaccaaaacagggcgagcgaggaaaaaaaccgggccaaaaaaaaccataactgtccggcgaaaaaaataattcgattctgtgaaaaaaatggcgacaaaaaaccgtcgaaaaaaaccggatgaaaaaaaccggaactgttaaaaatacaaagtgtttccttcgtccgtgtaaaaaaagtccgactgtaaaaaaaaaaaaggccagcgcgaaaaaaaataggaagggtgaaaaaaagggcggcgagaaaaaaaaagcggcaaaaaaagaccgattccgacgcggcaaaaaaaacgtaaaaaaggcaaaaaaaaaaaaagaagcgccccaaaaaatcatctgattcctattcctatcgtaccataaaatttaaaaaaagggcagaaaaatgcaaaaaaaaaagtcctatttctattcaacacggaaaaaaattaaccgcctttgaaaaccgattcgataccccaccatgacaaaaaaaacaagtttccatctaaaaaaggttcagcataacataaaaaaaatctgactatagaaaaaaaaatcaacactccaaattggctgtaaatcaaccgaacaggagttggtttaaatcgtaccaagtcctattcagcacacatcaggagatcaaaaccatatatctctatctcttctctactacttaaaaagatatgcttccatcgtccgtcaaaaaaaccgggcgagcgaggaaaaaaaccgggcaaaaaaaaccataactgtccggcgaaaaaaataattcgattccgtgaaaaaaagggcgacaaaaaaccggcgaaaaaaaccgtaactgtccaataaaaaagggcaaaaaaaaaagtccgattctgtgaaaaagggcgacaaaaaaaccgccccaaaaaaacggacgagcgagaaaaaaaaccgtaaatgtccgatcccaaaaaaagggcgaaaaaataatccgattccatgtcaaaaaagcgaaaaaaaatctctatatctgtctctgtctctactacttaaaaaataataaaagatgtttccttcgtctgtaaaaaaaaaagctaaaaaaaaaggtccgactcctatccgattccctctcagaaacagaaaaaaagtccgactatagatccgattcttaatctataccgtgatatctcacatatcttggtgaaacaaaatgatgtgccggattagagatctgtttaataaaacagaacctacaggtcgagagcattccatttttatatgattttaatttttgggtttgtacttttgcttttgagtccctataatttttatatttatatttgagttcctataatcttgcaataaggtacttgaggccgtttttgttaaaaataataataaaagagagaacaaaaacagaaaggtgcataaaaagaaaaaggaaagctgaaaaaaaaaagaaaaacaacaacaacaaaagttccgtttcccctatgtggcaaaaaaaaaagcgtagatccgaacgaaaaaaaatctgattcctataaaaggcaaaaaaaagtgaaaaaaaaatactagattcgattccgttaaaaacaggaaaaaaagtcggattcctataaaggcgaaaaaaaacagaaaaaaaatctaaaaaagtttgttcgattccataagaaagtggcgaaaaaaatggttcgtaaaaaataaaacgcttgttcgtataaaataaaaaatgcacacaggaaaaaaatggaaagggcgaaatttctaatcaatatatatctcttctctatctctaatataatctaactattttttaaaaaaaatgcacgagagaatagaaacggttcaaacaaacgcgtgagaaaaaagtcagaaaaagcgaaaaaaactcgctaaaaaggttttccatcttccataaataaataaaaaaacgcgcgaggaaaattatttccatcatcggtaacttttttaaaaaaataaaacatgcaaggaaaaaactgttagaaaaaacgcgccattttaacaaatggttttaaaaaaccgcgcaagaaaaaaacaccgtctattaaaaaaatcgctctgagtcggataggatccatcgattttttgccacctactacacggcttttatttcgtctatattctcttgtttttaaaaaaagcaacaaaaataacatttgaaaaaaaaacaagcaaaaaaacacgcgagaaaataattggcaaaaaaaggcaaaaaacacacgagaaaagaaaagcaaaaaatggagaaaaatatggttttcattgtaaataaaaaagcaaaaagatcatgttagaaaaatcttttagaaagaaatgcgtcatttctgaatggtttgagaaaatcgcgcaagaaaaaaacaccgtttgtaaaaaacaagccgctcattaaaatacaaacattgtcattgacatgattatttatgaaaaacgtatattatcattagaattttttcacccgttgcaacgcacgggcatttttgctagtaattaaaaaatatgtaaagtttccgggtgtttttttcgtccgtcattaccacgcgcttcgctaaatccggatttaatccggttaacagcccgatcgggcatttttttatcatactccaaaaccacgtttgatacggtatatgtactttccatgtaatcacttctcacatgtagtagtctgcccacttggtgagggatgaaagttttcatttcggccacacgggttcgactcccatttttctctcatttgtacatctattattacttgcacagtttgcttccctcatgtcaaattatatttgccttcgattttttttctcttttttcaacagatttttatttattatgaaatcttatcttataatgaattagtttttaattcgaaaattaaaaataattaaattatgtacacaaaaatcaatataaatatatgtttacctaggccctagaataagtctactttccttccctctctcaaatcatacagatttttatttattatgaaatcttatcttctaatgaattagtttttaattcgaaaattaaaaataattagattatgtacacaaaaatcaatataaatatatgtttacctaggccctagaataagtctactttccttccctctctcaaatcatatttgcgtgtatttttttttctctcaaccactagcacggaccatgcacatccgatggatgaaaaatcaaaagttcagcacctctttcttcaacagacttttagtgattctgaaatcttataattatattatataaaaaaatcagtataaacacgtgaaccaaccgatatttttttaaaacatgaaaattgaatatgtgcatggtgtgaaacttcacaccatgcatcctttccttctatctcggtctttgttagcgcgttttttaaactttctatatacaagttgatataaaatactagatattttttcttaatttttgtaataataaaactcaattaatcatacgctaagaggttttctacaaaagaaaaaggaacggcatggtacggctggcactgttcaggttttgtaggttagagcatagctgtatactgttgcattgtgattataaatcaatgcaatgttattgcaattatcaattatgaaaaaagattataaaagtgccataaaaatgtagtttaaaataattaatgaactcccaaaatattcattatttacttatacgtaaaggtgcattgctcggacgtccgtttctccaatgctacaatcattgggaccatgtgttagggacattattcacatcctacacgcgtagagcggattaattgtccaagcacaaatatgcacttgtgataactatgaaggtgcttcgataaatcattgaggttaaatttcattcacctaaccattaccagtgcaatgatatcacagtttgtcacacaagggttgagagagagtgtgtgtttttatccatcgtgattatcattagcctaatgaataatttatctatcttgaaacattactatatacatgttaactctagactttatagcatttaactgttcctttacccataacgaagcacgtgcatttttctagcataacaataacatgattaaaatagccttcacccgttgcaacgcacgggtatttttttccagtacactaagaaaatcggatcgcgcgtactaagcggacgaacaaacgaaaaacaatgtgatgtttggaaatttatcatttttttaaagtagttaagataagataacatatagatggaatatgaagttacatgtttgtaaagatgtataatatactaaatatcttgtcattcttttaagaaaaaaatataacattttgtaatatgtaaaaaccgagtagcggtcctctcaaggacaaaactccacctagctccctgttggtgacagaaaaccatcgccaaagaaatcacc

SEQ ID NO: 64699 - DNA, 4516 bp, Oryza sativa
ttacttctagccgctgtattatgttttcagtttggccataacataatcgaggtttcagttaatatgtaatttgtggtgtattacttgctacctacagtcccattaaattgatgttttcttaccgcctatgctcagactacaatcactggcagtccaagcagcctgcttcttgcctcttttaataagattacacatatatacatggattaattgtgtgattcttctcaaaatgcacttgaaatctgaaggtgtattctacatagtttgtgtatatggatttattcactaattcttctgcaagcagacaatcttggtttgcagccccaagtaaagggcaagtgtacgaatttagccacaaaagcgacgccaacgaggatcgccatcgacggtgaccgctgctccatcgatccttcttcccccgtttgctactctcacttcacaggttcaaataccatccccgcgagatctcatctccaaaccacatgcctttactattaccacactatttcgctctctttctattcttttcattccccattttctctataccgaatatatgtttttagatcatcgagcgtcacacccttcctcgagtcaatcaaactatcatagatctaccattaaccctaagtactgttgacagccctaatcagtgattatgcttaagtgatctaacctacaaaccctctttgatattagctgacccaaaaaatcctttctataaccattttattataggggtagactatttgattgtatcatttaactatgtagatttggcatcctaaatatacacctattctattacatattctctcactcatccttatttcagttcagatataaatgttatactttttggcttgcccattattgaaacatgtatactcgtactttagcccctttcaattccttatattttatatttgtgtcatgacttgctaatatcggattcagttcctaatatttctaatataaaaatttccctttttccatacattagaacaataccattacacgaaagtacaataaataattaatactctttcacataaatcctttaactactatactgaaaaaaaaatacttacatcaactgtaaattattaagctttttcacggctatttagtcctattcctgcatcataattatcttatatcttatcgtagtatagccacttaacccagcacattatcttcttaccatatatatctttccagctacaactaagatttacaccacataaatacttacatacatcaagttatagatcatatacttcattgcatttctacatatcccaaaatactcaccctgtttaaaaataaaaaaattataataaaaactctaataactagctgagcctctcataactttttttatttatcaaatacatctaactacatgtgtatatatattgtagccacaatcatgtcttccgcagtgttcgcatcaatgaggctgaatgcaacaaatcaaagctacttggtaagctcaaagtcaaacaaaactttctatggacaatatgctgttagcaccagtgcggatatgatattttctttctacagcctgtgccaatcacacttgcgacagcatataagatgcagcatggagataatctgaagttaaaaacttcccatggcttgaagataaagatcaaaatcaaggaagtagctagcacactgtacatgacgacaggatggagataatctgaagttagaaactggagaaacgattcttttcaggatgccatcaaggtctaaagcgtgtgttatgatactgaacagacaaggccttattagatgtccagtgaagaccccatccaacagctcatcagctaacaaaaggtcccctgatccatcaggtcaattaaccagagcaagcacatttgaccatgcatcttctagcaaaagcgttccatttctgaggaatggaacaggtacaaagcttgcctcatcacattttttcaacttacactacccattaacatgtctattctgttttcgccgggtaatagaagatatacaattaaatcagccagatactcctccaacttacattggctaaaaacactgctatattgcctcctgcaaaattgcacatgctggacaagtgatttaaatctttctatctatgtttctattcatatgtaatcattttctgtgtcattttttactagcaggcagtaacaaaagaaaacctagcagacacctccttctgccaccagattaagctcacagctgaattgaagagttacatcaaagagattgcagattgtctagaagaatcaaacaagttctatgtcgtgcgtatgaacagaacattcatggaacaggacagagtggtaatttttgacacaacatttccatcttcttatacccatactgagcatataaatgtcacttttctttttcagtactttgcgactgagttttcaaagaaatacattgtgaacttggttcgaggcaagacagcaaacattagagtgcagattgcaggtcgaccctcaacaacttaacatcagggtggttagctttgcagcagccaacagcatcaacttacacaatctgcatcttccacttttataggacacaagtcacctcatgctcaccatagatgctctgtgaaagttacctgcatcttcagtagtcgctgctattatctaccctggaacagctactataattctctctattatcctttgcttgcggtctatctaacttcacttgctcagtaagcacgtgacctataactgcttatcattgtcctcagctccttttgttattcataagctgagtgaacaattaaccactttatgtacaaacagctggcttgttatactacaggttactatggtactatttgttgtttctttttaccatatgctttttagcttttcttagttaagagaacgtgtgcatcgcatctttccatcgacctgtctacaggcggcgcgccattggcgcgccccagcctctagttcacatagttgtacgcgcgcagcatgcattttatttaggcacggtccacaattcatacatgtatagtggatacgtctcgtcggcagacactcacggtatagtagggtagtcgtgtgtacagtgatatagtcatatctgcgcgtcttttcatgccgttcgttgacttcgttcacagggtcagggtcgggtaggcgatatcgagtgtgacgccacacaggccggggccaccgacgtcgcggagaatccggatgtagccgcgctcgccccatgactggccccatgagttcttgatggtccagtacttggcgccggaagacgcgtcggtgccgtacccgacgacggtgacggcgtgcgctaggcgcgtgccgcacgggcccgtgtaaacgccacccttgtagaactgcatcccgctaccgacctcgatggccacagccacgggctgccgagcgacggcggcctgcaacgccgcctcgttccgcggcggcaccttcccgaagccggtgatcttggcggcatggtgcgcggacttggcgcggttgcaggggccccgccgcgccgtgtacgggtagtccgcctccgtggtgaggccaccgttctcgacaacccatttgtacgcccgcccgtacgaccctaagttgcagccgccgtcatagctgtcgcagtccaccagctgctgctccgacagagagaccagcttccccgtcttgatcatgttcaggctctcgatggtcgccgctgtcacgaacgcccagcagctacctgcaggcgtacgtaacgtaggtccaatgcaattaataattaataattaaggtatattttacgtttgaaatggaaccatgtgtgaaatttacacgtactgcatgttgacgtttgggacttgggaggcacaacggcgccttgggccctccagtcgacactggccggaacgtccacgcggtaggagaagctggcgtcgacgtctccggcacccgtcgtgataacggagtcgtccacggggccatcgccggcgtagtacccggtgtacgtggccaggaactcctcctcggtgaggtctgcgaactcgttctcggcgagctggtaagtgaggtcgccgcgcaggttgacggcgtcgatgaactccgcgttgcggcggtacacatcgaaccgctgcagcgcctcttctgcgctcgggtacgaccggttgtgagctccctgccaagcgcggaacctgtccatcatcaccatgtcgccgacgtccaagcaactgcccgccgtcgcacgcgccgggagcatggaggtggcgagaagggcaccgcacgacgcgagcagggccagcgtgagtaccggtggcgaggcgcacgccatgaatggtgccatggcatgcacctaacttgtgggtaagtacgcgttccaccgttcaatattccacttctggtcgactatgcatgcttagctctacttacttatatggtgtgtcggggtgctgggctggaggtgtcaacgtcgaaaagatgcgctgatggatgtaatttggctagcgacaagtgcacacaaa

SEQ ID NO: 64700 - DNA, 592 bp, Oryza sativa
actatagggcgaattcgagctcggtacccattacaatttacacacaccgcaagtaagcaagctacaacaaaaactgaactccctcttatctaaaacatattttgatatcggtgagaattatatatatatatatatataattacttaaatctgggaatttgatcgtatttgtgttcacatttaaagtggacatcttagatgttaattaatggagaacttgacgatcaagctaaggatggattacatagagattacgtacccctgttcagattcgttgtactaggatgtgtcccatccactacaaagtttgctatatatattttgggacggagagagtaattcggtttgtcaccaagctccgaaggcccctgcaccacactgggagaaaccaaaaaggagatcgagatgaagctaaatatcgatggctcttttgatccagtggaagagcggggggaatcggtatgatcctgagagatgacaatggggccatggtcttttctgcctgcagatttatggagcgctgtaatggggcgcttgaggcagagatccttgcctgcgtggaaggaattgcattagcgcttcactggactatg

SEQ ID NO: 64701 - DNA, 577 bp, Oryza sativa
catggaaaattattattttttatttcttcaactgtgaaaggctcatccagctcggataggtcagaccgccagttcctgcagggattgaaagttaatcgtcgaagagcgttcccactgttccccgagatgctgcaggaaaaaactaaactgttcactgctggaaaatgttagcagtgaaaaaagttaaccctgaaaataaggaagtgcaccaaatgttttattatcttataattttgagtaaaaccttgggtattgtagttagggttagaagaaaagctcatgactcgttagctcgctcatctcgtagccagctcgcctcaactcaactcagcttgttgtatttcctcaacgagttgggctaccatttcagcttgttagtgataacgagcttaacaagctgggggcatatgatatgtcatatgacaaccattgacccaccaacacttcaggaggcccaaataaagaagtcatatggactgtcactagatagaccaaacctagattttctattttggaacatgccctcgtatcactcagccctagggcagcacgggcggcaaccaggcgagaaccacca

SEQ ID NO: 64702 - DNA, 31853 bp, Oryza sativa
ttcatagaagaaaatgttgccctgcaccagcaacagtccagatcgggatattaaaaacagcttgatcgaaaggtacggggcaacatatatagtgttgtccactcttgcacacgaacaagcaactgaagcacattcctaaactgtgcacgcgtgcgtcctttctgaattaattctgaatttctggtgatgttatcaagcgcgtacgtacgtacgtgagctctgatcggatcatgacaaaatttgccgtatttttgtatacaaaagaatgagttgaaagttgaaaccagtgtagctagacgctgtgctggtcagaggggagcaaaaaacaatttaaattaataacagaggtcaaagacagaatcggctacgcgatgctgagtggtggtggtctggtggacagcccaacttgatgatagcaacgcagcggtgaaaagaaatcagcagccaacgctgttgcctccggctcgtacgaccagctcgcccactgatagtaactgagatattccagctcttacctaaccagctaaccttgccagtggaattgtttaattaagtttttttctgaagaaggtaagtctgtactttagtgtttcagcaaatccatattgagtgcaaattgctccgaattagctgtatgcttctttcctaaactcttttttttttcataacaaagaaaatataatttttagtctctgcaccaacttataattaccctccattatatttatgaagacaagaatttgaacctttaatggatggagctatgcacctacaaccacaactatcagagtactgtcattctttttattccacactttataattggtgtggggttagagatctaaagtttttatcaattgccatcagcaaaattggacacatgaaagctatattactataattgacattatggcatctctttttaataacttgtgttgtttaattatagatataattctttttaaaaatgatctaagttgtgctttggggataagcaccgttggtgtgctcgtagtagagtcataggcgcacacttctaaccattaggatttaaaaatttaaatgcaaactaatattaaaaagaattgacagtgcaataggattttagtgaggtatgggagttggtgcgtgagtgagaatgggctcagaattatatgcttctaaaattttgacaatttaatccttttgaaaaacttatttcatgaattgacagtgaccaatctattataaaaataaaccgcgaccatagtgtcaagcttgaaagcgttgagctgtaactgcaagatctacctaaacacaaatcttgatgcaagaacctacgaacgaaaaatcgatactgaagctcaaaaatcaatcgtaagtggaatagcgaaaccgttaatttatttagtaccttacccatctattaatcaatagtctccacctcccaacatctctacgtagcttgcaaacatcgtaaaaattctcgattgatatatattaatctctaacagttgagaaactattagagatttggactcgaagcactaacccatcgcctgtaacactggttacaaaccattagaaatttgggactacacccgttacaaataagtttttttttcttaaaccttaattggaaaaggtccactttagatatctcaactgtgagacgagttctattcatatctcttaaccacagaattagaaatagagagtccctaactggtgcagattgaatcgctcagtagtatagacaacaacttcggttgacgtggcacctattggacgcattgatccagtcttcactcgacgtggcgtctacaaggtgcttatgtcgcactccaattagaaaaaagaattaaaaaaaatggttccttcccgacccctctcctctcctctcctccatttctcccaagtcctgacgaggagtcagcagtggtggctctggcgagctcaagcttgctagcccttccgtgggaggtggcagcagtggtgagtggccgacggggaggggaatccattggtgtagcggaggaggagagaatggaggcgagggaatttgggagctcgagctcgtcaactcatgtctaggaaggcggcaatggtggtggttggccgaagaggaggggtgactatatgtggtagtagagaaggattggatggacgaggaagagggatgggttggaccgcctcgttgtcgagctcatgctgtgctacctcatcgctgaggtcgagctgcagcgccaaattcaggagatcgagcgtcgtccttacaaaggttgacactccaacgccttccctcaaatccctttcccctttacttcaaattgagatggctcagcatcacctctccttctttgacagtcatggccatggtcacgtaggaggtgttgcggaagctaccgtgggcgattctcaccaacgaccgccgtggtgggcaactaccactacccagttgtaacgctccgcttttcgtgaggcgttaaaaactaattcggcaaaatcctaattgcgaaaatttcgttctttgagtgctgagtctaagtcgtgccgtggatctcagtttaaatccgtccttgatccctctcgtcgccatcaaaatcatcctcatcgaaattcctcttccaattcaagtctccgaaatcaaattccgaaattcaatcgcctcctttgaatcctcgccaaacacttgtcccgattccaaaaataccgagtccaccttgaatccattccttgactcctccctgtttccccgagtccaagtaatcatattcgaaatttcattccaaatccaaatcccttccaaatcatctctctgcagaagtctattttgcctccttctaattttggatgggcctgatccccctcccctcggcccatctcctctctcagccgttcctcccctcccctctctccgcacgtgtgttgcgcgtgcgccgcgctcgagagagagatcgcccactctcttctcatcctcgctccctctctctctctctctccgtttctctctctctcccgtagaagctcccccaccggcgctgacttcccgccgccgccattcgaaattcggccacgcccagccgctccgtgcgcgcgcgccatgccgctcggtcgccgcccgtgccctgttgccgcgtcgtccccacccccccctgtgcgctcgcgtccaaaacacggagccagagctcgccctcctccttctctccctccccaaagcagcatggtcgaacccctcctttccaccctccccttttccttttttccctcgggctcgacccctctctctccacccttgtcactctgcgcgctgaggcagagcaccgctgacgccgcacgccagctcgccgcccccaccttgaccgcgccagcctgcgctcccgtggttcgatttcagccgcccgatccaccgccttcgccgctccttgcatcctcggcgtccgccgctcttgcatcgcccgtgaccgccggccgagcgctcgaccgctctatgtcggttccccctcccaaaccgacattcctccactataaaacccaagccgccccaaatcccttcctctctcgttttcactcgcctcgtacccaccgcgccattgccgccgaaccaccgtcaccgccttgtcgccgctcgacctgatctcatcgtcgccgtccgccgccgagcaccggaggaaccggtgcgtgggtgggcacataacgaggagctccgggcgccaccactcccctcttgttccccggccgcgccctctcggtgtcgtgccgccccgccgtcgcgactgtctcgccgcgacgccatccgtttgccgacgccgttcccgctcgtcggtgagctcctggtccaaatcctctcgtctgcatcctctagcgactcctaaacagcactgagacatggtagtttgtgcgttcgtcctccaaatcgcgcccctgccgatgctctgcttccgccgccgccgcagacagtcgtgcgtcgctgtcggctccccgctcgtcgaatcccatcgccatcaccctccccgtgtccctagaagcctccctgggacatcgccttggccactccactcctctctcccccttccgccgccgcggagctccgccgcgagcccaagtccggcaaccatcggtctccgtgccgtcgcgtgtgcgtcgcaatgccgaatcgtttcggctaagctcgaccccgcgcgttcttggcccttccctcgcgcatccacgtcggacatccggcgagcttcgccgccaccgccggccgccgtcgtgtctcctctctctaatccgtgccggtgagccgattccccatctcctcctctcgccaccggtgtccgcgcctcactccgattcgccgccgttcgccggtgcccctcggccgccgtgagccgtccgatctgggcgagccaggcctccctctctctcgcgcttgcatggcagtccacatgggcttgaccaagtccacgcctgccctgtcagccacctagtcagcctcctcctctctctcccgtgcttatgagcttggcccatcggcccatcccctcctcggcctcttaaaagcaggcaaagtttatatgtactccctcccctaaaccctgagaccacagtcataagctaaagtccatgtttgctccccccccaacttgctcctctccctcaccctttgattggccccacatgtctatgagagattaaagaatattcttgggagtattcttttccacaaattcaataaatcatttctttaatccagaaaactcaataaatcatttttcccttgttccataaatcaattctttattccaaattccataaatccttcctcttaatccagggattccaataattcattcccttggtcccaaatgccattgaaatgtcaataatattcttgggaatattattctataaattccataaaccatttctcgtattccagaaaaattccgataaatcatttccttgtccagaaaaccaattgacctgccaaaattcatatctcttgatccgtaactccgaatgatctcgttccacttccagtaattccataaaattgagatctatctaatggcactattatttagtctaaataggatctttattttgggtcttgtgtaggtttttaattgtttgcgtatagttgcggttaccggattttcgttgatcgtggttttctcgaagattcgtgaagcttcgtgaagaccttgagcaaggcaagtcacctttgatcatattgcacctataatttaaatctaagtatttctttttcacaaatattgcatgaataggatttacacaagtaattcggccgcggcttgcgagatagcctgccggcccccaatcctaattgctgcaattaccctccttgaattattgaacacttaaacctcctttgtcgactgttgtgcttcgatgcacgggccttcgggcacacgcatcggaacacctcccctcaaatttaaaatatccaacgatgggtaaaacttggggttttacaaaagacttggaaaaaaggacacttgggtcggtgcttgcgaactaaaatgaatttccaaaatcgcggaccgggggatgtaccgggaatacggtttcccgttcttgcacttaaggaccgtttcccttggaatttcatccgaacataagacaagtgcgaccacatgggtgaaatgggacacccctggctgagtaattagctaatcgggggaaccatgatgccaagagacatgtggattcaatggggtggtgccggggagaaccctcgggcttcctggcacagtatggtctgggacctaacctgatgtcggtctggggcccctctcgttggcatatggtgaacctgtgtcagctttcgaaatgccttataagccccaagtcaccagacgtgtctgatccacacgggctaagtgaccaaggttagtaacgtcgtgtgggtaaagtgtaccccctctgcagaggttaacaaactgttcgaacagccgtgcccacggtcatgggcggatgtgaggtgattccttagcgtagttttcgttttaccctgctttaagaaaaggaattaaggtttgggaaacctgatatttggaaaggcaagtggctatcagggagacagcgggacagggagtccctgaaagtgattggttgtttggagacaacctaactctgaaagtttggaaaattggttgggtttgggaaaccagctttgaggccaactctgggagttgtgcgaatcttgataaataaatttggtcacttctcacccctgaccgagctgagacttgtctcgctctggttgtggaaagcacacacttagattgtcaaaatgcttgcaaataaaaccgatcgtaaaataacagccttatctttgaagcctgcatcaaccacctaaattcccgtgacttgctgagtacgaaagtactcacccttgctctatataaatatatatatagttcctccgccttgaagtgaagatgaagtgaagtgaagaatatggtttcgtcctggttctcagccgttgcctgtggtattgggtgttagttcgttggttccgctgctgctgctgttgttggtgtttcctcgtccgtgtcgtcagttgcattcttgggctgttctgagctgcaacctaagttaagataaataagtcctctatttattttaaggatttgcaatgatacatatttgtcaccgtgggtaccagcactatgtcctgggactggtactgagatcgcgtgtcaggtgccgttgtacggcggtgccagatcggggtgggacaccaatgctctaggtcaccgccaactccctctagccctctaacggatttctcctctagctccccgacaacatctactccatctatgtactatgtttatgccctcatctccgcgtgctcgcagcttgtccaacaccccttccacctcgaattcctccagttcgctctccccggtgccccatgtcgtcctcccatagtgtctgcgtcagttgttgttaagcgatgcatcagcttaacaatcttattgtaggtcggagttttcccggagctacggaaactacacttcgaaaccatccgtcctatgtagattaacccatcttcctaacttctccccgccgccgttgtagagctctatagagaggtgctcgtgggcgacgggggtgtggaaagggaggtggaggatagaggggatcagctcgctgtgttggttgagctcgagctcagcccgggcagaagggcagatggagattgtatcagtgagatgtggggcttactgcgggtttttttccttgaagaagcttatgtgtgggtccaaccaatttccaatttttttgtctgattggcattgccatgaaatctcaatgtagaccgatgaagataagtccgcgagccacgtaggtgtcacatcttattataaaactgttcttaatattatcaagggatttgatttgtacttattttaaaatatagtaaggagtaagttcataaacctgggcctgaaattgaaagctgtttcatcaacaagccaaggaataagtctacattacctccctcaacttttactcctgattgaatcacctccctcagctgcaatactgggtataacacctcctccatcttcgaaaaccggagcaaatcgagtccctcgctgtttagatagtggttttgtcgtacgtggcacacatgggacccatatatgtcagtgaggaaaaaactaaagaaataacaaccgaggatggattctaatttctcgggtggacgtccacccgtttcttgcgtgccacctaaatgaaaaaaattgaaaaaaaataacatgataggttaatatgtaatatatcacttcacaaacatgcaagttcaaattcgacttctacaagttgtaacaaaaataacaaattaaactctaattaggaaaaggaaaattaaaagttaaattttttatttttgttacaatttttagaaattaaatttgaacttgcatgtttgtgaagtgatatattacatattaacctatcatgtcaatttttttgaaaatttttcttaactatttagataatatgcaataaacgggtggacgtccacccgagtatttaaaacagtttcccaataacaaccccacacatgtatcagtcatcttaatctctttgatggccagccgcaccgctgaagaactaaccaccatcgctgccggtcatcgtctccgcatgtgatgctcccaaacctccacgtagttttctcatttaaactggtagacccaatatttttaaccatcaaattattaatttttaccattagatttatctccaacaaaacaaatttgtacaaatatatatgtatgttccctcatcttggcatgtttataggaaatgtactgcgcacctatgtacgtgtttcctccccatccgactctcctttctatccctctcctattttctatagctagttatcaaattataaattttcaccattagattaatattgacaaaaaaaaatgtatgttcctctcattctgacatgtttactacttaaaaaaaaattacgtacgcacctatttacactctccctccccatctgacttaaaaagaattatatatgtacgcacctatgtacacaacactctccctccccatctgactctcccttctgtctagaccattatatgccaagccaactattaataaacaacactaataaaatccaatactttggagaaaaaggaacaattgcatccacgctaaaaaaacaaaattaactaataaaaatatccgaccaatttttctatgtaccaaaaaaaccaccaagatatatcaaaattagcaaacaatgatataaatatatttatgtgtattatttcacacaggttctttcaataatctatgtacaatgataattctaggtcatttatctatcttttttaattgtttgaacaattatgtattgcactactatatatataaatgattttctcaagatccaaacattcctttctacatacaaccaaaatgtgcagccatttgtggtgaagccgaggctacctcaacctcatttgctgctttttcagaaatagcttttgctaggcttttacgcctagaactatttaatggagcattaacccacaagctaacattgaatcaatttactctcttagttataaagatgatttgatgtcctaattatatatttcttattttcttaatttttatgtttctcttcatacaaatcatttttttctttgataaatgtcgaggcgaaaggcaatgataaatccatgaagccactaagctcatgtcctttatagtaactttatgggtttctccacatctgagatgtacacgtcactcaaaatagtttaaaaagctatatttgttcctatcaaatttacattttaagaccaacgttgactatatttttctcttaaaattactataagagccccatgtatcatagataaactcataaacagtgtccaagatatgtatatttcttccatatttacatgcaagaatataagaaattgcatgcatataaaccaattaaagcaaggactcgatgcaacaaataaagtttcacgaggtttgttaagaaaaaaatagacaatgtccattcaattaaaaataggtgaacatcttgcttttaatctgaactttgttaaacttgtcttttaaacaaactaattcaaacccgctcgaatgcatgggctacctttctagttatatattaatctatcttgtgaaaaaatttgaatttttttcataactatttggttgaaatgaaagaaatggatggaggtccacccgagaggttagaacccatctccgtcagaaacacacaaaaaccattcactctaatacaatttttccgaacaagattgtaaacagaaattaaacatgtgtagtgcgcaaatacctgatgttgccctctccggtggttctcagccggttcaaaccatgcgccggcccaatgtgtgccatcagccatccatgtcgcattttcaccggcatgcttggcgttgtacgcgtcagatcgcttgcgaatggtgctaaacagcgagtcgatcctgaccttgaactcctcgtactctcgtcgcacacggcggcgatcgctcatcagctcgccggccacgccgcctctttacgcctgcgtcttcatcgcgaagtagctctccggcgccctcggctcgacgcagtgcttccggtagaagggcacccacagctcggcgaacttggcgacctccaaaccatggcctcgtagtggaccagcgtcccgccgtcgtcggagaggtagcaggcgtacctgtccaccgggtagtcggcggcgaggatggagaggatggtgttcacggtgtagaggatcggctcgtcaacggggtcgacggtggtgacgaagacgtcgacgccggggagctcgtcggagtgccggtcagcgagggcggcgaggtccgggaagcgcttgatggggctcagtttggggagctggttgagcacccaggagaagccgaaccagacgtcgccggccatggacattgtccacagccacgcgccgtcgcggttcttgtgacgtatgcgccacgcgaattagaaggctacgatggcgatcagtcgcgccaggatcaagatcctgtaaggatgaaggacgatgcccttgaccttgtacgtccggaacagcggcggccggccgccgctggcccctgacacgtccgcttcgtcgacggccacccaaacgtcgccgccgacgtcgtcgttcacccgtttggccgcgggcgaccggcgctcgttctgcccgtcggctctggccgcggtatcgccgttggtggcgtccacgcggagagcagcgttattccggcgagtcacggccgccgccgaggaaatcgtggatgccgcggtggccgccatgcacgcaacacaccttcgttagctcctccttgtccgtggcgaactgttgcacgccgagccggcttttatatagcgcggctaacgacatgagtcatgtcgtctcggtcaaagtactactactctgctactccctttgtctcataaataaaatttttaaccatattttaggacaataaatctctatccagatttactatcgtagaatatatcacatcacttaaaaatctattatattatgagatggatagagtccactcttattataaaattataacccactaattactaaaacttaacatgcaaagatgccatatcatcatccactgaccattattacatttaagcatcatgcaaccatgctatgttatctataatttaataatttattaaattttagaaatttgaaattaagcatgttaaatcatcctacattattcacataatatttcaatatatatctccatcattttttttataatatcctactccctccgtcccaaaaacatcaaactctaaggatgaatgtgggcacatatgtgtccagattcatccctagagtttgattcttttggggacagaggagtatatagctatatagttcatcctcacttaattcttgttatttttcttttctcccattaagtcatatcacattaattgtgattttagtccttagatgattaatctatggttcaaattctctctcatcttttcttctcttattaacccatgtcatctcaatttttttagctcttacatgtatagtttaaattatcttccttcttttgttctctcataaagacatatcatcttattttttatatttgaataatcattttacatactatttgaatttaaatcacatgtaaatttatgttcgtgtaagcttacgttatttaaactatcataaacattatttttatctattgttatcatagtaaattcgtgcaacaacacgcggggtttcacctagtacaaggagacgtcaccactgccgtgcaagctgagcattttcctttctgcatcgtactactccttccctccctcccattttaagcgtcagcaatgaattttcgtgtatgcccgtcttatttaaaatttattttgttttgttatataacaacaacaaaaaaactaatcataaaatatttcaaataagacaaataattaaaattaaacaaagaaactcatacgtgcgtttaaaataaaacggagggagtactagatacttctcgtcctctttttctgaaaatactattaccactgtaagaaactgatagtgtttggtggggattatgttcctcatcttacgtatcattttttttaaaaaaaatctataccatagtagtggttgtggcaatgtaaatctaccaccaccacctctgtcaagttctttactccctaattcaaaagctcacaattcttaatcccgatctgtctttttattctgtggcaacgcacgggcaaaacagttagtcacaatataaatcaatttgatatatattgttccataaatatgtatgtttaaatttaacctatacaagtaaggggaaaacaaatttgactataaacaatacataagtcaaatttattttttctatttattccataacccttcccataaagtattttaactactcatattgatatgtgcaaatattaagtactcctagctttgtggatactaagcaattataaatctaatagattatcttgagttatataaatctaaagaaattataactgcatttagggttgagtttgtcggtgacatggggccgggggtatcgtgactagaggcttggatagccgcgatcactcacatggcccgaccccctcgggggggtcgggcccgacagtgacatggccacccctccctctgtctccccgaggggtcgggccgctcccgtttcggccccgagggctggggcaccccgaccccctgtggtgttggcgccacgtgtgtgggttaggtgagcacagcggcgcttacctaaccgcatttatggcgggttagacgagcgcgccacgccgcattcaatgcggcgcagcgcatgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtctctagccggagctggcgtgctgactcctggagttggtatgtcagtcccggtcagatccattccaggcttcagcgcaagcgtggcaagaaaatcgctggccattgaatgaaggatgaaacgggcgtccaccgggagagctgacgagcggagcaggaggcgtgtgtactgcttgtcagatgtcatttccggctgtagattagccctcattgtaaaaagcatgtttcttttcttaggcagggagaggcccatgtggtgacccctaaccagataaaaaaaggggaggcccaggcctaagaaggggggactggagggggagagcctgaactctctctggcgctcgagctctcttgctctggagctctctgtattccttcacacacagatccaccagaacacaggagtagggtattatgcttctcagcggcccgaacctgtctacgtcacccgtgtcttgtgcgcttcttctcgttgacattcctcagatcgagggcgaagaacctcacttagcgcccccggccgaaccggcaaaggggggcctgcacggtctctcggtgaggagccccacgctccgtcatctggcgcgccaggtagggggcgcgcgtgtctttctaagccctcgtcctctttcgtgtgcgccaagcttctcccgctcaacccaatggccgaacgggcagtggcgcacagcctctctccgaacgctagcggtgaagacggggagcagaacccgcgccgtcgggctcgcaccccaccgtccccctctcgccgaaatcttgggcggggggaggcgctcagggaggtcggaggatccgcgacttcgccactcgcgggcgatgggggaggacggcgagacgggacgcgtcgccgcctcgtctacggcgatggcggcacgccctagggcgcgctccaggctgcgggcgcgctcctgcgtcacccacccgtcgtccccgatccagagactccagcccgacgttggctggatgacgtggccgacttggtcatgacggcgcagcagcgactaggcgccggcgggcggtcctccgccaccgaggcctctagcgctgccgccgccagctccaagtcgtcgaggcggagggcgcggcgaacggcggctgttacccgccgttcgtccgccattccctcgtcaacgcctccaacccaagaagatgtgcgtggggggccggatgcccgcctcgatatcgagcgccggcgcgacgatcgtcgcgccgcccacgcaacggagggcgcttcctcgtccggagtgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctatacgaccgggatcgaggccgccgggggtgacgacagggtcatggcgaatttctttcccatggccctgaagggtcaggcgcggggatggctaatgaacttgccacccgcgtcggtccactcttgggaggatttgtgccagcagttcaccacgaacttccagggcacatatccgcgcccaggcgaagaagcggacttgcatgcggtacagcgaagggacgatgagtcccttcgctcgtacattcagcggttctgtcaagtccgcaacaccataccgtgcattcccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgctcagtcagggcggcgggacaggaggaggaagaaggggtcggcccgttccgacgtcgagggtcatgtcctcgccgtcgagggcgcttcgcgggccccccgaaaggggaggcctgcgagcgacaaaaagaaggaggccggcgctcccagcagggagcgcccaaccggcaagtggtgtaccgtgcacaacacctccctccacgacctcgcggactgccgcgcggtcaaaagtttggctgagcggacgaggaagtgggaggaggagaagaggcaggagcgccgtgagggcaaaaccccggcggctcccgccggcaaccggcggggtgaggccaagcagaaggccaccgccgagaacatcgacgatggcgacgatgacctggggttccaggagcctgaggccaccgtcgccaccgtcgatgggggagcgtgtgctcacgcttctcgccggagcctcaaggccatgaagcgagagcttctggccgcggcccctacccatgaggcgacgcggcggacgcggtggtcggaggttgccctcaccttcgaccagaccgaccacccgccgtgcgttgcccggggaggacagatcgcgatggtggtttcccccactgtttgcaatgtgaagttggggcgtgtcctcatagacgggggtgcagccctcaacatcctttcccccgcagcctttgacgctatcaaggccccggggatggtgctccagccgtcccagccgatcatcggtgtgacgccggggcacacctgaccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcttatctccagatgaagatgctgggccccggtggccccatcaccgtccatggcgacctcaaagtcgcgcttgcttgtatggagcagcgcgcggaccaccttgccgcggcgtccaagcccgcgggcggcgacgagaggctcagcacctccgtcccggccgccccaaggcggcggatggtcacgtgcgacgaggtcccgatcaaggaggttgccctgggcgacggcccgtccaagatcacacgaatcggtggtcttctggacgacaaataggaagacgcgctcgtctccttcctgcgggcaaatgccgacgtcttcgcctggagaccggcggacatgcccggggtcctcagggaggtgattgagcaccgtctcaccgtgcggccgggcgcaaggccggtccggcagaaagtgcagcggcaggccccggaacgtcaagccttcatccgcgaggaggtggcgcgacttctggaggccggattcatccgcgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttatttttatacgacaatgcctttcgggttaaagaatgcaggtcctacttttcaacgcactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaagcgtacctcagttctcccccagtcctggtcgccccggagccagatgagccgttgctactctacctggcggcaaccccgcaggtggtcagcgcggcgttggttgtggagcgcgacgaggacaaccctcaccccgcgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatagccccggggccactgcgggaaggccgcgcctgtcgccctccgaccccgaggtcgtcggcacagaagccgagtgcgccccgcgtggcctctcggacgaagagcgccctggagatgcggcccctggcgaagaggatcggccccgccgaaaggtgcagcggcccgtttacttcgttagcgaggccctctgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagctcgtctccgcccccgaggccagctcgggcccctcgcagctgcctcacaccgcctactgggtgatgcagttcgacggctccctgtctcttcagggcgccggtgcgggggtcacgttgacctcgccgagcggagacttcctcagatacttggtccgcctcgactttcgggcgaccaacaatatggcggagtacgagggaatccttgcgggactcagagtggcagctggactggggatccgccgcctcctggtgttaggcgactcccagttagtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcctagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgtgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcggtttcgagtatctgtatgtcgctgtcgacaagttcactaagtggcccgaggcttatccggtcatcaagatcgataagcactccgcgcttaaattcatcaggggcaccactgctcgatttgggatgcctaaccgtatcattacggataatggcacccaattcactagtgagctcttcggtgactactgcgaagacatgggcattaagctctacttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttccacgtctacggcgcggaggcggtcctcccatctgagctcaccctgaggtctcctcgggtcaccatgtattgcgaggctgatcaagatcagcttcgccgagacgacctcgactacttggaagaacgaaggcggcatgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgagcacattcgtcgcttctacccctagtgggggtcgggtgtcatgtctcgggctcgggccaaccccgcaccccccccccccgggcgtgcagggttggccgggggctaccacatgcatatacttaccttttttctcttccatatttcaataaaagcattttcgatttcctgaggattgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcctacaatcgggtcatccataaccctcggtcaccacgctcccggcctggccagtctcgacacacggatctccccaggcactagccccgacccgcgccgcttgaggttgggacctgggcacgagccctcgttcaagccaagacacagaaggaccgcggcacagaccatcctcatctcatacacacaacaaacagaactgacgcagaaattgcctctttacttgattacagactaaatcagtctatacaagaaaggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcgtcggagtcaagcgcgaacgcgagccgaggggccgtaccctcgaagctgtggacgatgtggtcggcggcgtcccggacccgcgcacgcgcgccgtcctcggttccgggagggaactcttccagcgctgcccacggagagaagtcagggtccctggcctggtagcttgccagtacgagctccaccgctccccgagcgaggtccctcgaggatgacttgatcgtctcctcgagctcctcggggagccgctcgagggccccggtcatttctgagaggtgctgggcgaggcccccctggttggcggcgtacttcgcgtgccgcccgccccagaggcccgcctgccgcccggcgcggtctagacgggagacggcgtcccgaagcatgccgggccctacctcgctcgccaagcggagggcctcgacctccctggcggacgagtccagcgcgccctgcagctcggcgatggtgtgttcggcggctgcgaggcgggcggctaggtcgccgtggcccgcggccgccccgccgctgtgcgccctcgcgtccagctccttcgcccgcgcctcgagctcagcggcccgctgatccagtgcggccctctcggcgcgggcgccttccagattgcggcgcgcctgctcctcccgcgctgcctcacgaagagacaggctgtccgccagccgctgcgccgcggcctcggcctcctcgagagctcgcccccgctcggtgagcgcgtcctcgcggaggcggagtgtggactcttcttcggcgcaggcggcctcgtgcgccgccagtgttgcctcccgggtggcgacagcggcctcgcggtccgccaggtctcgctccttcgcgtccaggacgcgggcgcgctcctccagcgccgtggcgcgagcctcaagggcctcttcgcgctgccgggacgccgcctcgttctccgccgcccgccgttcccgggcagcggcggcgtcaagaactccccggtcggcgtcgagcttctcctccagctccgccgcccggctcccgtattggaggcggaggtcgttccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctctaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgcgctcagtggggcagcggaagacagaggagagagccgcctcggtgtgggcgccgcgcggctcggcccgccgatcgacgtgccggactcgggggcgtccctcgaggctggctcgtcccaagtgtcatcgtgggtggcctcggaagttgtcgtcccctcgggcggagtcgggtcggaggtttggcaggccgcctggcgtgcgcgcgccgcctctgcctcccggacggactccccggcccggcggagtctggcctcctcccgagcggcctcctcagcctagcgaacccggacggcctcctgggcagcctcctcggcttcccggaggcggtccgcggcttctcgccggtcggcttcccgcctccaggcctccgcggtcgccgtctcctcggcctcagaccggccggacttggaatggcggggggggcgcgacgggatctcgctgaggcagaagaaaaaccagaagacaaaaagaaacgggtgagtgaaaactcgccttaggagatgggagaatgaatacggccgcggtgggcgcggggacgaacctgcggggaggtcggctaaacgaccacctcgggggcgagatgaggctcccccggcatggctcggtcccccccccatcttgcggggccgtttcttctttcgctccccctcgggctgcggcgtcggcgcagcaccctccgggagcctgccgctggcacgcaccgccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggcctcggggggcccgctcccccgacgccccgacctcctgcatgatggtcaggatgttggcacgctccggatcgcagcagagggggaggaccccttgggggatgagggatgcctccacgaagcttagattcagcacccgttggaccaccatcctgaagtcctcagggtcccagtcccatttgcgcccctggtgggtcttcatgatgtcctcgggcccagtgtactcccaggcgcctcgggcgcgccgctggagcggcgcgatccggcgacgaaggtagtcgccgaacaccatggcccccgtgagcccctgggatcgcaggcccgccaggcggtcaagaacggcgtcgtggccgtctcccagatctaccgtcgcccgccagctggaggcctgcgccgggggctggctcggaagtcggaggcgcgcttcgtcggcgaggggggtgtagaaccagtcgctcttccagtcgtcccactttttgcggaggacgcagggaatgtagcagttcagcacctgcccccgcggctggaagtagcagccaccgactaccgtcggcggcgacaccggctgaacggtgaagaaccaccggaacagccggagagatgggcgcaccccaataaacatctcgcacaggtgtgcgaagatggccaacgtcattatcgcgttgggggtgaggtgcgccatctggagatcataaaactccaggatatccatgaaaaaaacagagaatggcgggaccagccccgccattgcgaaagagaggaagaagacggaccgccccgggtagtgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcagaggaagggcttgagagcgagcgagtatggcaagggtagggcgcaggaaacggagagtcagagaacaagtggcgaaggcaaggggaagagtggcgagaggaaggaaacaaatcccttccttggcgtctttgtacccttgccaacgctatgcccagctcctcgcttcccgcgcccactacctcgccccctcgtttctcgcgcccacgcctccaccaaccccactcgcccgtttgcggcgcacgcggcagatgtgcggccgtggcgtttgagatggggcagatcgtgcgcgcattaaccgcgctcgccaaccgcgaaaaacgccatcatcgtgtccccaggcgaaacaaaccggctcgtcccgattcgcgcgctactcgagtaatgtagcggtcttgaagaggccgctcattattgtcgatcggtttttcccttaccgatgcgcgcgatttgcgaccgttgggtttctgcctgcctgtggggaccggccccacctgtcaccgggcctaaggagtggcatcacgcccgagcgcctccctcgaggggggcggtcgccctggcataacgccgggggctactgtcggtgacatggggccgggggtatcgtgactagaggcttggatagccgcgatcactcacgtggcccgaccccctcgggggggtcgggcccgacggtgacatggccacccctccctctgtctccccgaggggtcgggccgcttccgttttggccccgagggctggggcaccccgaccccctgtggtgttggcgccacgtgtgtgggttaggtgagcacagcggcgctcacctaaccgcatttatggcgggttagacgagcgcgccacgccgcattcaatgcggcgcagcgcatgcttatccggtctgtgaccaatcgcggtgtgtgaccggtcacagaccggtcagatcgcgggttaggtggcaacaggcggcctgtcacacgcctcgccccgtcccgtcggaatgatgagagcttcctggctctcgtctctagccggagctggcgtgctgactcctggagttggtaagtcagtcccggtcagatccattccaggcttcagcgcaagcgtggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaagcatgtttcttttcttaggcagggagaggcccatgtggtgacccctaaccagataaaaaaaggggaggcccaggcctaagaaggggggactggagggggagagcctgaactctctctggcgctcgagctctctggctctggagctctctgtattccttcacacacagatccaccagaacacaggagtagggtattacgcttctcagcggcccgaacctgtctacgtcgcccgtgtcttgtgcgcttcttctcgttgacattcctcatatcgagggcgaagaacctcacttagcgtccccggccgaaccggcaaaggggggcctgcacggtctcccggtgaggagccccacgctccgtcagagttgtactgacaacctgggattagagatgcttgacgccttaaagaaagggctctgcgatctgtcttgtcttgtgttgctatttatatattgccatctgtaatgtctctcttgctttcgctcgtgttgcttattttgccttgcgagagaaatatgaaaatcacgtgggtgggaacgcctaaaaattgcgaaagtaaaaaaaaacagagtggaatacgtcgtggaaaagactcctagatgtaggttatgtttgtaggtggacctgaactacaattgaccgacaaacaaaaaatgatgtgacgattggaaagttatcaatttttatatacagatatagattaaatttgaagttgcattattgatctatcttatcaaatattttaaaattttttgtaacttttattacacgatatgtaaaaaatgaggagcctcctctcaaggacaaaactccgcggctctgtgttggtcatagaaaaccatcgccactagtcgttagtcgaggacagaaactacaaattctcggttctccggcccttagcagccaagtcacatcttcatagcagaaaatgttgcgctgcaccagcgacagtccagatcgggatataggatattcaaaacagctggatcgaaaggtacgtggcaacatatatagtgttgtccccgcttgcacacgaacaagcgacggaagtgttataataacggccccgatagcacaatagataacagaatacggaacaaacgacatagaagattcaatactgaagacgacaccaagacacaatatttgttaacgagattcaaccgaaacttatatctcttgagacgtgctattatgggtgctcctctacaatccagcatattataatatactataatatattatggtacggccgaaacttatattctgttacgagtgctccacgaccctcaaccggttaggccgttgaccagttgtacccaaacctatgctattgtcatcttgcggttataaccggtgtgtctctctatttaagagagagcctagaatcgagtctgactctaagtctatcctacatttatcccaactcctagtaggattagtatatccgacacttattctaacaaactccaccttgacaaatacacctcacctagaagtaatagaatcaccatgtcgatccaccggtccttcagacttggcttgtcttcttctgcagattcattgtgaaccgcccgacgagcctacaccagactcaccgccttcaagtgtaactcctttctctggacttcacctgcaacagtgctccaccttctcacatatcatcaaagtcgtcttgccaagcgaaattggactcctccttcaccgccacataccagactcctcaaagaccatgttcacttttatcttttgtcttaaattttgattttatctacttcatggccagaaaacacatgccatcgccaaatagacaaatcaaactcatcagaccattgaagagaaccctttcttccttatcgtcttatgaaccaagctaaaaaaccaacatccatgcttttcacatatatagactgaatgcatgatactttgagaaaattcactgctgccttgaatcacttgaagaaactaccaccatagagattgctcatcctcttcaacgacgtagttttcatatatctccatcatgccgactccacatcctagaatatcatgtattgctagacaatcccgttgacaccttcaacgatttcgacccactattgcctgtgattttccatgcactgttggacatctctgcttgagccacggccttctctggtcaatccttggtgaacgcctaaacctggtgcccaattattgttgttgttaattcacggtccgcttttcggtttaactagacatcctgagtccaaattgactctgtttctccgtcatctaccacacggcctccatatgagctcgtctactccgagttggaaaaaattcctcgatcacaccgtaaagcgacaaagaaaagataacactgttaggttttactctctggccatcgagccagatggaggtgtacggcacgactcacctaagtccggcactctacctagcagaaaaggcgcgtctacggactcgtgcacacgtcacgcgcgttgatcggatcgctcgcaatgatttccaacgaaaacgcccctgactcccatagttctatctatatacctaattaaaaaataaataaggtttccgactgttttgtcgtccgtttcggatcggggctttttattccaaaaccccagttgatatagtatatgtacgttacaagtaatcacctaacacatgtataaatctgcctacttagttaaggaagaacttcttcactccagccaccagggttcgattccaacttactctaagatgtttcgtacgtcgtcactgaatgtatccgattccgcatattagaaaaaaaaatctatcgcgcttgggtcatgtccggcaccacgcgcgcgcgttcttgcggcccgcgtaaaccacgagtcctattccacgtgaaacatccaagccgcaagattgattcaattctcgtgcacgtaacatccaaatccaaacctataggatttataaaacgctatgatcaattcaaataaaactcccaagaaatcctcattagaaaagtcgggcaagaaaaccaaaatctctctcccattcctctgccccacgctggttcttggctagaaaagttaaaggaagcatacacagagcaagaaaaagaaaaattatactagcaaagcatacatcacccgacactctgtgctgaccacgactgggatagtcccaaagtagaggggagatcgaccagggcgggacagcgctgtcgtcgtcgttgtcatccccggccaccggtgttgtcccaggctgtcggcgttgctagatccaccaagcggcaacggcaggcgggcaggggaagagggaagagtggaggcggcagccgaaggaaagggcccggtcgtcagcggggagcgctggctgccggagcttgagatgatctggagcgccggcggtggagcggagcggcgctggatcgcgattgtgatagggatgaacggttaaccggatgggtggataaatatcatctgtcatcttctattttagcccctgaacttcgtaaatattacgacaatttctttatttagttgatttctttcatataagccctaaatttcatatttattttcatactagccctcaatgatctctttcccctactaattaagggcatgttcactttgatgccaaaaaaacccaaaatttttatcaaaatttagcagcaaactaaatatagccatattttgacaactttagcaaaatttggtaagattaaagatgtcatcaaagtgaataggacccaaatcagtttttctattttctaattaataaattacatatattagacgagtccctgaatttctttttttaatatagtttcagacacccgagtcagactccgactcccgagtccaagtcccgtaacactgcatgcataccagccctgctcaagttgagagactagaaagaggttggccgccggcaagtcgggaggaagaggcagagccaaagaggtgagcacggaggcgttgccatgtgaagtcgcgagagaatacatgcgacattgcgacgtgccggggttgactggatgggcatgggcattttttctataagaaatctatttaaaaaactcgcatcaatcggacttttaactgtagctcaagattttctaatatatatatatatatatatatatatatatatatatatatatatatatatatatatatatatatccaagtaaactcacacagtaaatttcatattaactaaaccatataacaataatacgattaaaatagactttacccgttataatgcacgggcattttttctagtaacttataagaggactaagcctcatgcgagaaatcacacacatcatggttcccgttcctcaaaaccctaaacctatcgatcctaattaagcgctaaagggagattgaaggacaacatccaccccggtgactcaattttctcgcactggcgttcatctaccgcatcaccgacacctacatctacaacgacaaactttataattggtgtggggtgagagatataaattttttaacaatagccatcagaaaaattggacacatgaaagctacatcactagatttgtcattatggcatttctttttaataacttgtgttgtttaattatagagatacttcctgcgttttatattataagacatgtgtatgcttagattcattaacatataaataaatgtgagcaatgctagaaagacttataacaacggaggtatagtagttctttttaaaataatgttagttgtgcttttgaagggtaagcaccgatgggaggctggtagtagagctataggtgcatagggatggcaacggagtgggtcggggccaggttaagctggaacggtcttggcccctgccccggccccggccctgctcttggatctcctcacccggcccggccccggccccacaaaagaaaacaggaaaaccaagccccgcccccgtcaccgctgggccccgcaacctgagcttggccagcaaagtgtgtgtatgcattagaattagtgcatcacaaacaacatattcaaaaatacaaattttcatattacaaatgcgaaacgacacaagcaaaaatccacaatcaggttcttacaggagctagatgaagacaaatcctcatcaggataaagctgcttcgctgctggcctgctccttttccttcctttctgtccgttactatgcgaaaaacacacactggcctaggagatctgcttaactccagtacaggtccacaacttgatgagatgtaggcgtgccagtcagtttgatcatgcaactgacaagatatgcaaatagtagatcaaacagccgatcggttgataagccgatggagtagttccagccgatagccgataattgccgatgtcgattccagccgatagcgataaggttttgagcaatcggctatacacccgatgtatataatgatataaaagcgatcggctgatgataatcaatataattaaacaatataatccagtagaaaccaatcagataataatgatatgatagaataagtactgatccgaaggttaaagcatacatcggctgtaggtccaatgtcataaaatccaagagattagattaaacgatgaaatctttgttgcgatcagctaaatccaatatgtatacaatccttttaagccgatgcaacgtccagataactcatcggctgaaaccccgatgaaaccctttattagcaatcaagatgcagactatagattatggttctaagcacgacttagtagatcaaacttaattgatgcagcattaaatatgaaaagaaacataatatctagacaatcaagccgttgactgagtttttagggtggtagatgtctaagctaatctaatctagcaacacgatttagccgataccggcataaaccctaaaacgagaaaaagccgatagagctaaattgatatgctaagactagattaacataggcatatgataaataggtaagcaaaatatatcatctaaaccagagcaatccaagaggtcgaatgtactgatgcagtcttgaacgacgccgacgtaaacgatataattgcatgggccgacgaaacattggacttaccccttcgccggagatcgaataccgatgcagccctacgtcaagcgccaagtcccgccggacgataaaataaagtagaaaaggtaaaaggtggcgatgcgccgaattgtattaatcgtggattgatagattacaataacccccggtgtacatatttatacccatagggagatactagtccttgtcggacaagaaagaaactaaagataaaaggaaaagataaagtacttataggacactaaacacactttcctaaagataaaaggaaactaacaaactattcctaattaatagataacttgccatgccgcattctctttgaactcggcctcttctggataagcttcctttagtagatcaatttccttaaccgaatatagcaagaattcgacaactgacgacttgataactctcatcggctaatctcaagacttcgaagccgatgattactctgggcttaccaaatttcacagttaacactcgtccctcctgttcgttggcttggggcaaagggacagcacggcgagaccaagtgatcgactggtcggcacggctcccgaaggattgagattaggtgcagtcggtatagcgactgcaattttggcagtcgtgtgatccagaacgtgcgaaatgaatcaaacggcccacgttaaggcagccttgcacttgaccgtctcagcgagccaagggccatggcgatagctcagcttgaaaaaaaatgatgaaccacatatactctcatcaaacgcgcgagagcatgcccgcgttagtttaggtctgcctgagcatgctgctcaacaccctctgaccctcatgtgcgctgcttgcttccgttgtcggcgccggcagcgtcgtcttccgctccgaccaacatcatcgtcaacacctgctgcagggactagcgctaagttcatctaaggcgagaaggtgaacaacgttgacaacgacgagttgacggcattaccggcgctcctagctcgccgtcactgccgatggcctccgccctcgtctcgtccacggccgtccgagaatctacccgccgattgccatgttttctatttcttcgctgagatcgccaacttaatg

SEQ ID NO: 64703 - DNA, 15019 bp, Oryza sativa
  unsure (1)..(15019): unsure at all n locations
caccaaccgggactaaagatcactactttagtcccgaactaaagatctttagtaccaaccgggactaaaattcaacgcatagtatataatccctatcacttatcctctcctccataatcacagctcacacagctcaccggggctggtggccgccggctgtggtgggcggcggcgggccgggggcatgaggtcggcggtcggcggggccgcgcccgacggcggcaggccggagaccggcggggccgcaggtggtgggagtggcgttttctgtcttttttttgataatttttgattcactgagatgtataattttgtgattcattgtatcatatggatatgagatgtctaatttgtgatgtatttgatttgtgtgtatttttttaggatttatgatgtatttgatttgtgtgtataagtaactttaagatttatgatgtggatttgggatgttactttgatttggggatttggggtttgatttggggatatgcatgccacttgattcgagagaaaataaaaagaaaaaagaaagaaaaagggaccatttgggactgccgttattctctctttactcccggttggtaataccagccgggacgaaagatccctctcttagtcccggttgttgttaccaaccaggactaaagatgtcctggttatttcaactggaactagatttatactccggttaaaaacccgggactaaaggggttatcaaccgggagtaaaaatggtttctccaccaatgagggtgcattagtgtgttggggaagtagcggtgaagtaggcaggatcgaggtgtcgagctacgacgaagggaagaaaaagaggagtaagttaggttttaggtatttgcacgaatcttgaagtgatctaacagttcaaaattcgtaggatattagagaggtgcattgcgcattaccttaaataaaaatcggttgttcccagttaggagccctaataaacgggacctttgatcatgcaccataaaggctcctatacggcggaaatgctgttgggcgatcgatcgccctggggatggggtagcgataacctcccccctctctcactccacctagtttccttttttggtatcgtattactttcctattttagtaaatttatacacctcaagtttacacatctaaagtttagagaccaaaagtttacaagtcaaaagtttatatatccgattcaaatttgaatttgaattcaaatattttttctatatagtatttctatacatctaaagtttatacacctaaagtttatagacttaaagtttataagtccaaagtttatgtacccgtttcaaatttgaatttgaattatatccgattcaaatttgaatttgaattcaaatacttttttatatatagtatttctatacatctaaagtttatacacctaaagtttataagtcaaaagtttatatatctgattcaaatttgaatttgaattatataccattcaaatttaaatttgaattcaaatattttctatatatagtatttctatacatctaaagtttatacacctaaagtttatagacccaaagtttgtaagtcaaaagtttacatacccgattcaaatttgaatttgaattcaaattttttatatatagtatttttttacataaatttttctaacttttttttttaaaaaaaaatttgtggtttattgtagtggggaagagaagaagggagagtagagggacgtacgtatagagggagcgggcccagcgatcaccagcacattagcagtcccccttatacggtcctaccacttaatcatgtacgagccacacaacacaggaacacagcagagattagaggccaaggaagcatcggagcgaggtgatcattgacgcgcaattaaacaagcgtagaaaaccgggacgtttgggcggccgccacgcgggtttcgtccacaaatcgaagccgcacgcacgcacgtccgtccgtccaccccggatggatggatcgatggccctcgtgacctgcgttctctattcgttgcgtgcgacgccgggcacgaacgatccacgcacgggaggaactttgactccagatcggccgccctgccggcgaactggtttcgatcggagggagagagtgagcaaatccgagcacgcgactgtaagacccgctatatactgatattaacgaagttatcctaaacggcccgctgtcgataggatcatcatatataccatatcgagagtgcaacataaatcataaatacggggacttgtgctaaattttgaaacttgaaaccggatgagttggttaaaaaaaaaactaatcaattaggctacaccttacttcgcacgtacactacgttgtacttgctttcatatatatatacgtgaccaagcacccgtccaaggtattttcataatttatttgtatttgtacgatcgtcagaggaaatggaggtattggttgatggtttctattttgtctcgactttttatgggatgttgcaatgtacgtgttagatgagtcgcacgatataagtgtaaagtcatatgcacatatgaccttacaccgcagcgaccattgagccgcacaaccactgtagccatagccatcactacatctgagcatattcatagtcatattgaaatttaaatcttcagtgataataattattcacgcatgcatggataccttctaatggaattcatgggttcattccctgaatttatttctgaactcgttagtgtgcaataatttaagcatatagggtgttttcttcacaatagaaaaagtacagactgggctgatggtcctaaggttgagtactgtgctggaacatggaccatatcgccctatccccttcaggtaggatcatataatcttatcatctaaatgatttttttttgtctttagcaaatgtatggtcattttagctatagtacttatatcagtagtgtgtcactgttatatatcaatcatctagaaccatgggataacaattaaaattttccccagctggctaagctataatacgtgttccatcttccaaaactatgaataatttttaccatgatctctgatagcaatcatgcataatattatgcttgccgacttaccctagatcttgtgaaacctgatttattgagtatactatatcgagtagattaataggttaattaataatcgcattcactgtttggcttgtttagttgacttggttgctcataagtcctaaccctgcatacacacgattgctaaataccaaaatcatgtgacacgagtcattttcttggcttatcgtgtactctctttgtttaatttcctttcagtcctttctctcttctctctgaattttgtgagaaaaacctgtgtgcatgatggcaatggaaaaggtacgaaagaaacagactttattccacaagacttcacgagttgtaatacgtaggttgatgtcaattcattccagttgaattttttgccacttgtttcgagagaaaatcagctgatttggctcatgggattaggccaactaattaagcacgaatataagcatattggctttcgcaaagcctccactacttcattacaatatttttgtgcacgccaattaatttgtagtcaactgtatatgtagaaaaaaaatgctaatggaaacccatttatcagagaaatataataataaagctaataaaattttatgaaaaaaaattagtctatgtcatgtcgtcgtatgccgtttggtagcaagtccttgtagtatacgtacatacgtgtcgatggaaatgctaatttgacaataataacaactaaatgaatgccagtattatacatgacgaatatggaccattattcctcgctaatgcagccaatctcgggccggacaaaacatatatgcatattgtcaaataaaaaacatagcacaagtacatggaaattaaataaacacattaataaattttaataccacaaaaataacaactaggcaaatagatggttttaccagcacgactctatgttagaccgtggttcgatccccactagcagctactacatgttagattagatttattttgtgacttttttcgtgtactagtttgagcccgtgaaccttttggtatagccacttgtgttaacaaagtgtgcaaccctgcatatatataatgcgatagaaaaatgctgcaggtgtgagagctaaaattgcaaatggcctgaaacaaagaaagctgttgacctcccagctttggttggaaccctaaaatgtaaacattttttttgggccatggcatgatctgctcgatctttgtgttagcttataaaatggggcaaagtagggaaagcaagagaggcactaggagttgattacttttgatgtatccatcttgtcagatagattatggttaaccagggctttggtattaaagatttgcagattcgcatcgtagtttaatcaaaccaaggcgcctgtagatcatcaagtggtgcactaagcaacaaatgctcctttgggtcatgtgtatacatgagggctattattactttcgaaatgctccatgttagtgacattatgaaatatggcgcgcatgagacattgagccccattgttccaattaattacaagtaaaaaaaactgatattactttgcttggcttgctgagattttcttttggaaggatctaggatagagctgcaataattcaaagttaaagctcatgtgtttgaaacaaatgtatcatgaaaagacaatttatcaaaccttgggaaacatatatcaagaggaacccgatacttttcaattcacatgcttgttatggaatctatgtgacttctatttgatatttcacctaaacatcgttgcgagaaatgtatattcatctcataacctcgagtatttttatttgtcttttagaactcattggtcgtgtgaactgatttttttttcaaaggcagctgggggtgtgaacaatttcattataaaaaatcacaaataaattgtgaatcgaattcttttagacttccactgctcttctactcactctgataatactttgacaaaaatgaaggcctggtttagaaaacaaaaaaaaataaattaaaacactcattcgtacgctacatgaatcatactattaaattcttatacagtcaattcctaccctccgaaaaaaaataagtatagttgcaatgttatctacaaatgacaaacaactatattaagcagggatcttgcaatgctaccaaacacatgttttgctacaacttcaatttgtttttacttaggctgtgtttaaatctaaagtttgggtccaaacttcagtcattttccatcacatcaacctgtcatacacacacaacttttcagtcacatcatttccaattttaaccaaaatctaaactttacactaaactaaacacagccttacatttctaaaaaaaaccccaccaaatttatttgaacaaagcgtgtggagatggacatggctgtgcactgtaacttgagtgccaaccgctgcatttgcagcaagtcgtttcttatacgcatcaacagaagagtatacctggtgtgtcctctggttcctagactcgcaagtggtgtcctgcacaacgtcgcactcatgatttggctactccctccatcccaaaatatttgacaccgttgatttttttaaaaatatttgaccattcgtcttattcaaaaaatttaagtaattattaattcttttcctatcatttgatttattgttaaatatacttttatgtatacatatagttttacacatttcacaaaagttttttaataagacaaacggtcaaacatgtttaaaaaagtcaacggcgtcaaacatttagggaaggagggagtacaaaccaaaccaatatactactagtacaagccctattcttcttcttgcatagtgagtgacattggcaggtggggtccctgttgctgttcaagtgtaccaccattcacagtgcaggtacgtggctttagcttcgttgggacacgtaggagaaaatctggcgtgtttgtgcgagccggaacgcccttcaggaggatgcgcacggcccacctgcgtttgaggtcagacgacacgagacacgcatcccgcattggcgggtcatcccctctccacttcgtcatctcgcctcgcacgcgctccctcgtcccaaaattgctttggctcagcctgcactatgtgagttgtggcttggcacctagagaaactcaatagtgttgcttgcactgctattgcctttatgtgtgttgtggtagtattctggaggggggcatatgcttttcatgcaatgctgaaaagtttttggaggttaattgctgataagtcctattggagaagatactaacacattggacatctccaaagaatattcaggaagcagccggtgaaatgtggtcaatgtaccttcaatactctttaacaacttccaccacactttgtaggctcctccagttagcatacaccctggactcaaaatttttagccctattttagttgcaaaactatccttttaccattatgaagttgtggatgtatatatataccttcgtaaatagggttcaaattataatatccataattaaataacatatatatacacacacacattacggttgatatagaggtcggaagaaacttctgttacgtagaaaacaatatggcttgtgaggatcggcggagggtaggatgtcgccgcccgctgccgcagccgtggcccgcgagacgggaagaggaggagagggcaggggggctgctgctgccgccacccaccgccgccgccgcggcccgcaagaggggaaggggaggaggccaggagagccgctgccactgccgacgccagccgctcgccaccgcggcccgcgagaggggaaggggaggagggcaggggggccgctgccactgccgacgcccgccgccgccactgcgggacaccggctgctaccgccgcggcccgcgatagggaaaggggaggaggggatcagaggagagggaggaggagtggaggaggagggtgtgaggagatagagataagggagatagagtgtgggaggcgtgcggcagcggtttccgaggagataacggtgagtgggaggtgagcggcagcgttttttttttaaattttggtcctgatttgttacacttacacttagatctttagtctcggttggtattacaaaccaggaatcccctcccccgccccccgcgacaatctttagtcccattggagttttaaaccaaactaaaaaaatatttttaatgtggttttcggccgacccagtaaagatcagttctatcataatggtactcggaccaaatgccctccaaagaagggaaaacaaaaccgaaatgaactgatgccgtgttagttccaaagttattcttttaaactttcaactttttcatcacatcaaaactttcttatacacaaacttctaatttttctatcacattgttccaatttcaatcaaacttctaattttaatacgaactaaacatagcctgaattgaaagaaagcgagaaaggaactgacggcatggcaatgatgcgacgatgcaaatgtttgatcacgatgcaccaaagatcttcctccggccggattcacggcctacgcatgccgtacgcatgaggtggtcagcagcgcagaagtgcagagttcatggcaaaaccaaaggcaacttctgctagctctcccataacgtgggggccacatgcattcggtccctggcaggtgggccctatgatgccacgtacatcaccacgtctaagttccaaagtagtacgtgtagtgtagttcaccctgagatgcaggatatacagggccataaatgccatggccataccatagttttcggaatatggtgtggcgaactgacgatcacacgcgagagacacatgtttttttttctttaagccgacgcattttgtacgttttgtcgagagatttgggatccaacgtcaaacgacatatttacattacaaataaaaaataatttatgaataaaacttttatgtacgtattcttagcaacctagaagcaaaggctgaaaaataaacttcgatgaaaaaaatcttaaaattagcttcaaatttaaagttgaaaatttaaattttgactgagcataagcatgaagcatcttcatggatcgtaggttcaatgtgaaatataaatgaattttcttgagttatagaattttctgagactatatgaacctatattaaaaaagcaaatattaggaaatgacctaatatcaaataattagaaggtatgagacttcggcgtgaatattaggaaataatctaatatcaaaaaattagaagggatgaaattttaaaccaaggttgtctaacccaccacttatgtagctagccggaagacccctggatgtttcttgaacctatatttatccaatgaaacaatgtctacaccctcttacagaaggtattgcaaagaaaactagagtttcatttgttacatgatatcttgcgatccgccgccaatgaatttttttttgtgtgtgtgtgtgtcccctatgaaacaaagtatttttgttgtctgattcacctaagattttgcactccagcttacatagagatcatttctgcgatttcgaagaacaaaacaaagtgggaatgaaaagaggaggaaagccggctagcatgtcggaaaaaggtaacccaaaaaaaataagggagaaaataagaagcagataagcaccaagtttctcagtgcatagatgatgttcagataaaaataaatataataataaaatggagaatagaagtgcgtcatgcccatgacatctccagccgttgcaatctggggtttcaacgctacaagtgcactgtcacattggcacaatgtttgcttatcttatcctccttttctatatttttgttgaagacctgatatacggcttattatgacatgctaacaaaatgaatgagtcaggataactctgtttacatactggtccaaaattattaaaaatcaactagataatctataaaacctaaaagagcttcttaatgaagaagtgaccatatataggaatagtcaacgacccttcattcttccctgtccctggtctctatgactctacctatccatttaggcctccttttaaataattcatatgaaaatattgtaaacctaattcatatgaaaattttatgaaaattgaactaattcatatgaaaatattgtcaaattcatgcattccaacgggtcctttagcaataaaataagctataaatatcgacatattatacatatgaacctacaagaggatacaaccttattatacctatattataaacctattacttgcctacttggtaaggtaataaaaccatcacactagtcgtatgatatgactttaccctgcagtaacttatataacttgtgtcactctctgttacgctaagcaagtgctcgagtgtgattgtctcctgttaaacacctaaattgtaattgataaatataaatttactttaggcatgtttgataggactatagcttcggcttcacttctcctatagcttaaatctaaccaaatagcttcaacttcagctaaataagagtggagtggactaaagtgatatgcaaaaaataaactaaagaaatgaagcagggttcgagccactccataactcaactccagacttcactcttagagttatatttagaagttagagcccggtaacagaggcggatctacagtactagggccggtgtcaggcaacaccggcggctttcgacaaaacctatagcaaaactgtttatccatatgttataatatcatgatttaaacataattagcgtactatgacaccgatatacatgttatgacaccaacgaatcgattttctggatccaccactgcccgctaaacacacattttaccgataacggatcttaattgataataaacacactttttaccggtaacggatcttaattggatgattaacccggatccaaaacaaagcccaatccaaaactaaaatctccactaaaatatgagagcccccccccccccttcccccacattacccccgctccttcaccgcatttaacaccaccacctcaaaacggcaactgcatgacctccaccacctccacctcctcctcttcactcccaagaactcgcaatcgccaccgccgccgcggcggcgcagcttgataccggcggcgcgagaggaaggcggaggagggagagagaaatgggcaactgccaggcggcggaggcggcggcggtcgtcatccagcaccccggcgggaaggtggagcggctctactggcccaccaccgccgccgacgtcatgcgggccaaccccggccactacgtcgccctcgtcatcctccgcatctccgccgacaaggccgcctccgccgccgccgcgggggacaacaagaccaacgccggtggagccaccggcggcggcggaggcggcgccaagatcaccagggtcaagctcctcaagcccaaggacacgctcctcctcggccaggtctaccgcctcatcacctcccaaggtcagcacccatccgttcttgcgcttcgattcgccattctcgttgacgcggcaacctgaaatccgcgcgtggtggatgcgcagaggtgacgaaggcgctgcgggcgaggaagaacgagaagatgcggcggtgcgaggccatcaggcagcagcacgagcagctccggcgaggcgacccgctcgctggcgtagccgaggaggaggaggaggaggagagcgcctccgacgatcaggtcactgtccctgcattttttttcctcatgtcaagactgaattctccgccttgcaagaaagctaacgcctcgagatgttctcgccgccgcgcaggacgggaagagggaccggcaccggagctccggcgccggcgcgccgccggccgccggcggcagaggccggcactggcggccgtcgctgcagagcatctccgaggccgcgagccagagcggcggcggcggcggcggcagcagcatctctgaatccgccgcaagatgattcccctgtttggtgctgtattgtctggttttcttttctttttttttctttcttcttcttttcttttttttcttttctctcttagtataaagtgcttggaagttggaactacctccaaaagaaagcagaaaaaattgtaaatcagagtaatcagagcaggatcaataggaaggaaagcttgtttcatctctcatgtaatttgcatggtgaaaaactgaaacttcagtgtgcaattggggttcagtgatttgcaactctgaagctttacctgaacagaaggagattcagaaagcatcccaacccttttccatcaacatatactactatttacccagtccagttacttcgcaaaatttaccagatttttcagtttgaaatctgcagagcaaaatatccaaggtaccaataatgcatttcttcgtctcgaattcgcgccgtccgaggcgtctcggttttgaattccaggagtgaaactgctagatcaggtgctgggcacatgctatccagtgtttcggtgtaaaatactcggcagacgaggacacaacactgctggttctgattcttctgaagtgttttggagttgctaagctccatcagtccacttggaggctctggcaatgccagcccggatcagggccgccgtccacggctgccagtggagctccagcgagcctcgccatcgacaccccacacgtgtggtggctctctgcgcatcgtcgtcgctgctccggtggctggccgtccactgctgtgttctcctgggattcagtgatgctgtcctgcaggctgcacaagggtcagtctgaaatttggaagaacagaactgaatttactaatagagtattcctcacagtacagaagatgcagatccataggcaatggccagtgatcaagtatggtttagcatagtttacaaggtgacttctgaagacagtattgtattgagatgtcatgtatcaatatctcaaacatattattgtcagttgcacgatgccatttatgcaacaagattatctccagttagatgtccagctcgtaaattctgttgccttggtccctcagatgcttcagatccagatctttacagtgcaaatggtgggggattaatttgatagtttggtatgtgatccatgcatctcggctcatgattatggaagaggcaaaagcctgattagcagcgtgcgtgcgtgctgaaaaggcaggcagtgtatcattgttcagacttcagacagtctgaacttttttgaccagcaaatcaaactgatgcatgaattagcagaagaagggactatattttagcctaactaaaccataagaggactgaacattaaatgaatgaactcaacaccagaacaggatatgagtgaaaacataatgataaagcatcatcagatgaaatgctaagttcaaagtagctgacattagaagtaggaaccactgacaagctatcctcaactcgtcggtaaaaaagcctatttacaactccatcagtaacaaacactactagtgttaatcatatttggcaaatgaacttggcattgtgcccaaaattgtctgatcaaagtcgttttctgtgcatttttgtcatagatgaatcctgcattcctgcatctcaaaataaaactaatgagccattgctaacaacatattttgaagcgtggataagttaagaaagcagcttacatggaaccgttctccttttgagatgtgaagattaacttcactcagtactaccattcgtcgacttctggctagcagaacctgttaattcatgataactacagtaagtacaacaatgtaatgggagaacaataagagaacgcaaaggtataatcataccgtcagttgtgagccaatcctgcaaacaaacgagcttttcaatatggtgtttacgtgattcaaatatagcaaactttgcagttcttattgctacattgcaatcagtacgacatggctgtgaattgtgctaaaatcagtactgtgtattccaggagagcactagcatatacaatggtatatgggcctcatgggccaacagtaaaataagtctaagactacatcgctatacacatatctaacagcccccttcaaactcaaggtggatttggagaatgatttggaggatctatcacattgagtttgagaatgtaaagacggtgttgctctctagtttgagccttggtaaagaagtcagcaacttgaagttcagatggcacatatcgaagagaaattgttgactgctgacaatgagagcgtgtgaatgatgcatccactccaatatgcttagttaactcatgctttacaggatcattggcaatttgtatagctcctgtgttatcacaaagaagaggtgttggatccttgcattctacaccaagatcagataataaccaacgaagccaaacaatctcagaagtggtagtagcaagtgcgcgaagttcagattcagtactggatcttgacacagcagtttgcttcttggacttccaagcaatgagagaagtaccaaggaaaatacaatatccagtaattgatcgacgatccattggatcactcgcccaggttgagtcagaatatgcatggaggtgaagctgactcgagcgtgcatagaatagttgtcgagatgcagtccctctcaagtaacggagcacacgaagcaaatggctataatgaacagaggtaggtgcactgacaaactgactaagcacatgaacaatgtgagcaatatctggtctggttatagtgagataaacaaggcttccaacaatttgacgatatcgagagggatcctcaagcaaaacaccttcagtagaacgaagttgaacatgtagctccattggagtagtggcagtcttggtatcagtaagaccagagcgtgttataagatcatcaatatatcgatgctgagaaaggtagtagccatcctctgtattagtgacctctatccccaaaaagtagctaagagggcctaaatcagacatcatgaattgctcacttagacattgcttcacaaaagcaatatactctaagtcatcccctgtgattagcatgtcatcaacataaagcaacaatagagtccgtccatggtcagaaacatgaatgaataaagccggatcatgatcacttggagagaatccagcagcacaaacaacggagctaaaacgctcaaaccaagcacgaggtgcttgctttaaaccataaagagcacgattgagacgaaaaacataatttgcaggggcatcaacaccaggaggcggtttcatgtaaacctcctcctttaggtcaccatgaagaaaagcattcttcacatccatctgagatatggtccaggaacgagcagctgccacggctacaagagtacgaacagtggtcatgtgagcaaccggagcgaaagtctcatcataatcgcgaccatgttcttgctgaaaaccgcgagcaactaagcgagctttgtagcgctcaatagagccatcagagcgagtcttcaccttaaacacccacttgcaagtaattggaatggcatgacaaggaagaggaacaatatcncaggttcttgttcgctctaaggcagcaagctcctctgtcatagccaattgccactcaggaatggcagcagcctcttgatatgtactaggctcctgaacaccatcaattgctgcacacatatagcgaggatgaggcattatcttgctgcgatctcgaagaccatatcgtggtgtagcagactgtggtgatgacacaagtggatcatcaatgagcggagcaacgggtggatcatcagattagcattaatggtactagttggaacatctgaaggaagacaagagggaggctgagactcatgtggagttcgaggtcgacgactatagtggaaaggaaaaggtgacatctctgaccttggtgttagagtggatgatggtatatccaaagagggtgaaggaatggaagatggagaaggtgtctcactgatggtagttaggtcttgagaaggaata

SEQ ID NO: 64704 - DNA, 3186 bp, Oryza sativa
ccctgtcttggctccctctctacccggcggcacgacgacaaataggggggcagcggctcaccgacggcggcgacgacggcgcacggcgcggcacactgaggcggcagcgcggcggtcacgaatgcggcggcacgacagcacgagggcggtggcgcggcggcgcgtggagagggggaagagggagaggagggggaagatggagtgaggagaggggagaacggtggctcttataggggagagagggaataaggggaagagggaagagaagggagggggtgacgcgacggcggcgcggcggcgcggggctcgggacggcgcggggctcggcgcgcggtgagggcgacgggcgacacgacgacgacggcggagcgtcgacgggacggcgacacggcgacgggacggcgacgcggcgacgggacggcgcggcacggcacggggctcggcgcgcggcgatggcgacagggcggcgcggggctcgagatgacggcgacacgacggacgcgacgcgcgggcgcaggacggcgtgacagcggcggcgcgcggcgcgaggcagtgacggcgacggcagcgcggggcagggacggcgatggcgacgtcggcgcggtggcaggcgacagagagagggggaaagaggaggggctgggttaggggaccacgtcgaacacctggcggccgatgaatagtgtcttttcctatttaatccccattttagcctattttttgtgtaaatttgattttataaatcctagattttgtataaagaagtttacccaatatttgtgtcattccaaccaatggatttattctagattaatattactcatattttatttatataatttatttgaatttttaattagggttaattcttattattattatatatttttcaaagttttcctatttttcttcttttagggttttggttgatttataaattgagaaaagttgcaaattaaatttgtatttactcccaagcatttaggtgaccgtattaagtgttcaaatgtgaatttttcccaaaatttaatattgtccaatatttaaggtttattaaagattctataattttctaatgagaccgttattaacacaatagcacattagctcaatttatctatatgttagtttattttatatggaggggtttaatatatcaaatttcaatccctaaatgcaattaggaacttggtgcaaaatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagtaatagcaatcataacaaccagcatgatgcaaaagttttaaaaagttcgaaattttcgtgattttcattgtcttgaattttcaggatgttacacgtcacgtcagcgaaaccgctctctaaaactgttgatggagtcaaattgcaactgttttaatagttgggagtcgagatatccggtattatgattcaaggatgcgaatcagatttggcaattagttagagtcaaagtggacttatttctttttttttttgcccccgggccggggttcagagtggattgggccgaaacccctgtcaaacccggcctaactaaaatcaggcagaattccgtggagccccgaacacagccgggtgcgggtgcagagcctctcgccgccgccatcgccgctcatcgaaaccctagagcccttggcgatgccggcggccagagattcaggcctcaggctaccacccacccagggtgggtgatgctcgaggtcgtcgacggcgatggcgccaatcaccgaggcgacctcccgctcctcctccggccatctcgtccgcgtctccttccgccccgagctgacactactacagatccgggcttcagtgacgggtcatctgtgacgggccaacgtaactcgtcaaagatgagtcatctctgacgggccgaaaaaatatcctcttcaatatatggctaccagggaggacccgtcacagatgtaaagtcatctgtgacggcttgcacttgtaacccgtcacagatcgtctgtgacgggtcacaaccatggctcgtcacaaatgacatgtcatttgtgacgggtgtagtattatgaaccatcacaaaagagaccactcatctctgacgggtctttaactaacacacgtcacagataacgttatctctgacgggtggtggttatgacccgtcagtgatgagtgaaaattcaaatttgtaaattttgcaaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatatttttaaaaatgaaattttgaattcttcaaacaacatcggatgaagatattttctatgtaaaagttataaaacacgatgagataactatttagttgataatattttcatttgaagtcatttagggtgttaaatatatgttaaatgattcagacaagcatagacaaaataataacattgggttagtagtcaatatgtgttgagtaggtgagttggtaagagagctctatatggaggttgaggtctgagttcgaatctcacttgtagcatacaagttatattgcgtgaaaaattgtgaatttgtaggtagtgatgtgtaaccatgtataggattgctagtaaaattcaaaatatttttttgaggttttttgttgcgtttaaaattcaaaaattatatttcttactttgtcatcagtgacgggtcgtaagttacaacccgtcagagatgagtcatcagtgacggtcaggtagt

SEQ ID NO: 64705 - DNA, 518 bp, Oryza sativa
ctctgatagatctaggaggaagaggagtaaggtcggtggtgtggacgcctctagattcagcctacgcaaggtcggggacggctagatccatcaaccatgaaactagggattcgtcaaccatgaaaccggtggcaacataagtcccatgatttttctcacctttttcttatctctctccactctataccttctcctttcatagatccaagcagaagatagaggagatctgcacgacaacggtctcgagtaggcggtagcagtctagggcggattcttgctaagtagtgtcaaagagacattgggtgcataactgggtcgcgattcggttggacttggctttgtgacatataccacgttacttgtcctggtaacatcgttcctatcctaggaccacgcgaacaatctcatccctcctgtgtaaaaacctaaaaaaaattattgtctcacatgcattgctcgactttgtgacatagagtaacaccatttgccatatgcagtactccctccgtttcatattg

SEQ ID NO: 64706 - DNA, 658 bp, Oryza sativa
gaagatactcccacatcttcttagcagaagaaagatcaataaaattcattctaatggggacctcagcgctcatgcacaagaaggccatcacacgctcatcattacgtcgccaagctgcaattttcttctcatcttccttctcatgaggtggatcatcattcaagtgagaggccacaccatacgacctgagttgcatacgagcagaggaagcccactcacggtaattttgtccattgagttttatatccaaaggcaaaagaatgacattcccaagtggatctgatgccatggttgcaatctgaaaggctgagctgctgctgcacttgaaacgctgctactgcactgctgcactgggctgccgctgctgcaattagtggctgcaattaggtattgtaatcagcagcaggagatccaacacatggcagatttgttggaaagagtcctggcggcaagtgcgacagcaaaggatggaggctgcgggtcctgcagactgcagctagccgacaccactgcagctagcacaattggataatgcaacctcgagcaggagaaaaagaagcaggagaaaaagcagtcaagcagatccagcaggagaaaaagatgctccagccagaagagaagagggtcgatccccaaaatcaagtgaccacgaaaaaca

SEQ ID NO: 64707 - DNA, 1383 bp, Oryza sativa
acagaaactccagccgaacattgtacttgtccccttttttggtgggtagcgagtagcagctccgttcaccggtaacggatgttgggaagctcctgagcgtgtagagtgtctggtagcgagggcccttccagtcgtccttgtacacggtggtcacccttctattttcgccggcgtcgacgtacgcaccgtcggagacgtaggtgattccgccaaccaggctgtctgttctggaatcttgatccaggccacagtcgatgcttaggaaacctaatacacacagaaaagaaaaatgacgttacacacaagtgatcgaacggaagaatcaaaatagccaaatctcgtcttcattttgaagcaaaccaagacaatacccactggtgtacagggcggaaaaatctcaggaaattggtatggaacaagaggggttttttcatctcaagattttttttcaaacaccgtgttttttgtttataagagcaccgtgttttttgtttatgcgcttgaaaaagcatcgagaggtcttatcgtctaaatttgttgtgcagaccataagagatcaccaaaggaaatagccatatttttaccaaagaaaataaccgtattttcacacgcagttcttttaccaaagacggctatacaattcaggagacactaaaaaaacggccagcccaaccagctatggttaaatccagtcccttggactctcctcgtccgctccctcccactcccaggcgtcatggcaccatcattgtcaaccacagctagaaagctgcatactttccctccactacccagccagagtgccacactgattcagcagcatcggcgggcctagacagcaacagtgagcaacagcttccactactagaaaaatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttag

SEQ ID NO: 64708 - DNA, 749 bp, Oryza sativa
ccgccacgtggcaatctaaaaacgctcctaagccacctcgtggcaaaaagtccattaaacttcctacaaacgctcttaggccgccacgtggcaatctaaaaacgctcctaagccacctcgtggcagaaatacatccaacccttaattttcattaaaattggtggacccattattgtggaccattagattagattaaaaaaatcccaccccttctcttccgcctatgtatgacaggtgcgagggtattgtgccggtcaaaaatgtcatcagcagatatacgtcaaagaaaatacgtatatatgcactgttcaccggacgaaagtagaaaataaacatacatattacctctgtacgcgtgtacgattaggaaaaaaatgttaatccttccgtcctaatatggaatacgaggttacttattattatgcacatgtttcgatgctaagtattaattagctttttcttaaaaaaaaataaggccatgtttcgatgctgtaaaagtttggcaattttttttagatatacagacacacatttgaagtattaaacgtagattaataacaaaagaaattacagattccgactgtaaactgcgagacaaatcttctgagcctaattacgtcatgattagctataagtgctacagtaacccacatgtgctaatgacggattaattatttctttaaatgtaatctcgtgatttacagtcggactgtgcaattagtttttctttttgtcacatttgatgctcc

SEQ ID NO: 64709 - DNA, 6195 bp, Oryza sativa
ggacgagggcggcgacgaccctaactcctgcttcaccgccgacgccgctagcaaggtcaccgacaccgagaccgaggcggcctcccgctcctccgccggaaatcacgtcggcgtctccttcctcctcaaggcgccgccggcggtgtcacgcctacgcttccgttgcgtcccaagcggcagccgcggaggcgatagacggttcccctcgatgcgtgtcgtcgccgtccaccgcgactccctgctcctccggatgcaatatcggaaagggcgcgcctacgacaacgacatcggggtcgactacttcctctacaacgccggcgccgccgccaccgccgttgacccgccacggccgccgtcgttgtcgctgctcccgacttactggtagacattgcaaaaggaagaggatgatgatgaagaagataaggaagatgatggtggagaagaaacttatcgtggtcgtgggtatcggcgtgggcggcccccaagcggtgggtccgcgatctgggtgtcaagaccaccggcatcttgcaccgccgcggcgacggcgacgacggcgatctcgtggtggtggcggagctcatcgcgaaggaggaggacggcgggacgccggaggagctcctggtgctccgctcggacggcgagtggaccctcacgcggccgcccgtcgtccacgacgacggcaaggccgaggaggtgtcccgctggaaatccgacctcgtcgtccccatcggcgacacgatgctctgctgggtcgacctgtatcgcggcatcatcgtatgtgacctgttcgacgaaattccccagctgcgatacgtctccctccccgtcgatgcccccgccgccaaattcgacaacggccgcggcgactactccatcaacccgcggatgtgcccgcggcagaagcgaagcttctgggtctccgacaacggcggcgagctgagattcctcgacgtctcgccccgctgctgctgcggcgatctaggcgccaccacatgcaataacgcccgcaacgccttcgtcatcagctcatggacgctaaagatgaacgatatgagatgggtgatggacgccatggtcgacgccaccgagctctggtccctcgacgcctacactggccatggcctcccgcgcgtcagaccggaataccctctcatgatcatggatgatccgcgcctcgtcttcttcgtggtgcaagaggagtaccaaccggaaatatcattttctgataggggaaagtggagggtcatgttcgatatgaggagcaagaaaatattatcagtgagccagtacgatgagtcagacacgtcgtggcagccatattcttggctcacttatttccccagcaagatctcaaattacttcacttccattggagcttgtagcaatgttgcaaagaggccgctgattgtcactgacaagccggcagtaagttgtatcgtcagtagtaattcattgcgatcttcctcgtcgcgggagtcatctaccaaacattctcagatgtcaaagggagtagtagcttctcctgaggagatcttggcggcgttagaagaggttcctgaattggactgcgatgatatgctaagagcgtatagtattctttgcgatgacattggccgacaccgatttagatcgcttttgggcctcccggtaagtctaaggaagaaatggctattgatcgaaatcaagagtagtgaagattgttctatctgctctctttgcacagcaaacatgcaacgtggttgaacttatttcattgtgatgaattgtacttttgatcaataattaatctatgtttttttcctgggcgtgcttatacttaattaaacacaagacgacggttccttcttaaaggcgttgttttcaactttgtgtttttgtccggtggcttgagttttttttcctcctttttgattgtgtgcatcctgatgtaagcagatctgccagaaaggcagaaacacaaataattttcgtgagtgtggaaaactgtcatgaaaactataaaaaacgctagggatatactttgtgtcggcaagccgccacgctaaaacactcacgagtagagcgacaaggaaaataaattttcttggtggtcagccacccgtgattattttcttggtggaaaccaccgccaaggaaatgatgctattgttaggttcgtgcaacgccacggatataaatgaaaccaccatgttaattctttttcgtgacggtgttaattaagccccctggtttaatccttttcggtatggtgcagatccgccaaagtttattcaatttttcgtcggttcttttttatccctcataaaaatcctacgcactaatgaaaattcaggtttctggtagtggaggctaggttttgtttcatttactaatggcaatcttcccattatccaaaatataatatatgtgatcgaattgtataatatatgtgatcgaattggtagacggatgatgaaataaatatttagagatgttttaattaggattccgagctctgcggctgtgtcactaggttttatacattttaggagaaagtctaaataacccccccccaaaactttggatggaagactgtctagcaccctgaactttgaaatcggatattgagccctctaaactttataataccatttatatatataaccccctaaggttgttttgcatagtgatttttatctaatttgtatataagttggatgagtttgatcacatgacatacacattagacatatatattaaagttctgagttaaatatttctttttactacttgttaactcttattacaaacaagtaccagtataataatagtatgacatcactatataagaataaattgatgactaagcaatagacgcttatttccgtgtgatcagttgataattcctaaaccaacttgtacaggttttgaattccaaaagtacggaacacgtctagattaatttattttggaacatactccctccgtcataaaaaaaacgaatctagaactgaatgtgatacattctagtataataaatttagacaaaggtatctccacattcgtagtaatagaatgtgtcacatcagtactagattagttttttatgggacggagggagtacttggttagtttaattttggaatacggtagtaagtacgagggagagtagtagtattgtatgatcgatccgtatccgattcaccgtcgtctttcctgtgtgttttataaacggaccaacaggtcctctaattaactctctccggcttaacgatagaaccgatccatccatccatcctcctcagcccctccttgtccatggaaacccaaccgacggatggccgtggcgccggcgccggctacccacggtgggtgatcctcgaccgtgaagccgaatacctacacgtcaaccatccctgctccgccgccgcggatgccaagaccgaggcggccacgctctcctccggcggccacaccgtgcgtgtctccctagacctcagggcgccgccggcggcgtcgcgcgtgtgctacacctgctccgttcccgtcgacccggcactagggccaccctacatgagcgtcgccgccgcccatggcgactccctgctcgtgcttgtgtccttcagttaccaagaagggtacgagcaccacacggacacgatagataagtacctctacaacgcaggcgccgccgccgccgccgacccgcctcggccgccgtcgctggtgcatctcccggcttactacaatggagaagagacgacccttccgtcgccgttgccgcacgatcttgatgagaagaccaccggcctcctgcgccgcggcgaggccgaggccgatctggtggtggcagatctcatcgtgaaggatgggggtgaagctgacgcgccgaaggaggccgagctcctcgtgctccgctccggcgagtggagcgtcgtgcgggcgccgatcgtccacgacgacggcaaggccgaggagctgtccttctgggaaaccgacatggtcgtcccagtcggcgaccggcggctgtgctgggtcgacctatgtcgcggcatcatcctctgcgacatgttcgacgacggcgacgagactctccggccgcgatacttctcgctccccattgagccccccgccgacgaccgagaccgacggagatgccagatgtcaaagagaagggtctgcgtcaccaatggcggaaccgtgctgaagctcgtcgacgtctccccgcgctgctgctgcggccgccgcggcgcaacgcagtgcgaccattccagcggtgtcttcgtcatcaacacatggacactacatatggacggcgacgatgatgacatggcagcttattggaccatggacgccatggtcgacgccaccgagctctggtccctcgacgcctacgccggcgtcccacgcatcaatccacaattccccatcgtgagcatggatgaccctgatatcatatgcttccaagtgcccgaagaacacaagattggaagaaaaatgcaatcgtggtacatcatgctcgacacaagcagcaaaacattgatgtcagtctgccgtctcgatgagtcaagctcgcttcaattgtcttatggatatgcttactttgttagcacggtctctcactgctttaattcttctgatgatggggggttcaacaatgatgtaacaaagccggcactgatgatcatcgatgataaggtggcaacaaaaaataatatcatcgctaatgattcattgcaatcttcatgcgagtcatctgccaaaaattccaaggtcaattctcctaaggagattttggctcttctccaagagataccggagttgtctcgtgatgatttgctgagagcgtatagcttgctttgttatgacaataatggccgccggctcagttcacttttggggctcccaatgagtctgaggaagccatggctgttgatggagattaaggctagtgaagcctgttcggtttgttgtgcatgtagagcagacatgcaaaatgtgtgaaatactttttgtagtacattaagtgtgtgactgtgtgcattgctgtttggttgattaattgcgctaaatcgagcagcttaattctcgtataatatagtttttattttaggatattttatgattaattaacgagaaaaaaataacaattgtttgcaatttccatactgtagctattcttttagctaattgtgctaactcatcttcttccacctctgtgagctgaaaacacaaaaaaactaacacatttactataggcgtcggttaaaaaataaaccggcacattccacatataatatagatgaaaaactgacacttataatatattataggtatcggcttttttaaaaataacgccacccttaaatcgagccaagccgaaccgcaccacaccttctcatccaccgcatcctctcctcctcatctcttcctcatccacccttctctcttggctctctctctctctctctaggttcccccctctctctctctttcggcactcttagtcgcaacaacaacggcaatgggaggagaggcggcagtggctggcggcgccaccccctccgccaaatccaatgggaggagatgcgacggcagctacgtgtggcgacaggaggtaggcggcggcaatggcgtgttgcggcgggaggagaggcgacagcgttttgggtggtgccctcccctccgccagatccggcgggaggggagatgacgacagcaacgtgcggcggtaggaggcaggcagcgatagtggtggcggcggcagacgacgccttccaacgtgctgcgggatccgcttctttgtcattgctgatgagctgtgttgctcatctgcagctccatcctctccacggaggctgttgtccatcctctccatcttctttgtgctttgcatttgtgttgatgttcttggatcgatgtttttgaattcttgaagccaattaattctatgaattaaatgttgggtaaaattgggtgaggggggcaccacgattcaagccgatgaattgatccacttttcttttagatttttgggatcttaaaggtgtccgttttagaactgacacctttgatttctatcatctgtgccacttttcaggttatccggcacctagttgggtttccaaccgacacctatctaggtttgtgtagtagtggagttggataccaattgtaggtttgtgtacaccatgtatgacaaaaccgctctggatt

SEQ ID NO: 64710 - DNA, 13475 bp, Oryza sativa
ggagagttcttgttagtgtggagacgcaatctgtgtagatgaaaataaaacaactgtgtatttgtacttatgtaccgctctaatcctttttcccgccactaattttatttgcttggcgtcatatttttgttagcgcttaaattgcgttgtttccaatttaattgtgatagtataacatgggacgatgacgccgtttaagtgaaagaggagcgcatgcgtactgacccaccagaaaaaacccagcgaataagaaggtgacacgtcgccaggaacagggaagggaacaggtatcgggacaggaagccgcatccccagcgagcagtgcgccgcgttgactcttgctttgcattgcagggccctctactttgggcagaggaaacacccggctcacgaaacacaccgtcctgaacttccatgcatggcagaaatgcaataatgtttacctacccggtgaatcaaaaacgtagtccgtccgtattttaatttatgacgtcgttgactttttaaccaacgtctaaccatttattttatttaattttttatgcaaatacaaaaatacttatgtcatgtttaaagaacatttgatgataaatcaagtcacaaataaataaatgataatttcataaattttttaaataagcagaaatgtcaaacgtttattaaaaatgtcaacagcgtcatacattaaaatatacggagcgagtattaagttcggaggtggagttagttgatggcggtgtgctggtgcgtttctaataactaggagatccaggctggtgatcattgtttggggtcattgatgtgatggctccttctctaccggctaattttataactcgtttacacccttttaatttacaggagcaatattttgcatgcgtggtcattacatcgattaattatagctagagcatgcagctgttgacatgtcattaatctgttggtataggttactgaagacacaatatatgatgttgtatacatatagtggcatactccctccatattaaatatatgattatgttaacttatttggttaaacttctgaaattcccctcatcaatagctctctttagtttgaaaacataaaaataatatgagtaggttttatagatttttcgttttaagtacgtttgcaatattataattttgttggatactatcactatattctaatagaaaaatagtgcttaaacttgcgcatcaaagacaaagtaaagtctccccttcaaacaataaaagatagactaaagtcaacaattttatatatttaaatacaaaaatagtacttatatatttagatgttgaggcctatatgggtgccaatgctaataaccttttattttgatacatgggttgtatttcataaacctataacttatttattatgttattgaaccgcactgtatcagcagaccactcatccaaggacaggtaagttaaccaatcagtcgacccatcatatttatcgaaaaaaattccttacgcggtaatcccttctatgtacttaaattttactttttttatcccctttattttgatcattttttgtagataatttcttgtatgcccctaacaatttagccaatcccttccatggcgttgagttttatttactcccttagtgtcatgtcccttaaatattaatttaattccttccatgctcatttcatcagttgaccatttaatgtataagaaaagttagttttaccattgggcatgtaaggccattcccaacccaatgactaggatgatgtctacagcattaaataaggcaacatatcctatgcacacaggccctcatgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattatcctagaattttttgtgataatttttagttggtgtacatggtgtgtacacgcgaaggtctgtgtacataggatacgctcccattaaataatatgccaactagaatgaaaaatgatgtggcaagtgaatacatgaggaaagagaaggaaatcatgtcttgcataagacatgtcttgcatgagacatggtttctacacaacatccaagacatcatatgagataagtagcattaaatttaagtatgaaatagtggtgtttgcattggaagaatagtgtctagtactagtttcttgataattcttgataatgtggagtttatagaaactatgtctagtgtcttgggttgggaatagcctaagttatttatgaaatctaccgttggaagtaagtaatttattgcataactataatattcataagtttattgtgtgagaaagtattaaatgcagaaaatctaacatatatttaaagaaatatatttagcattttttaaaggataaacatgacaattcgtcttgtatagtagcatttttagataatatatacaaaatgtgtcaaatcttttgtgctactgtcacaaaaatatgatacatatgctttttaataaatagaaatatactttattatcgtctaaaaaattttttgtcgtgataatacctcacataatgacactcgtaaatataactgtctcatacaacaaactgcaacacatccaacaatatactccacaaatttagaagggatcaaaccaaaatagaggtacacaagagagtgagacatcatggtaagaaaaacagaatgctcaacataaaaagttcatttccaaaaattgatgggatataattataggcaaatgttgctacatgatagtcaatgtttatttaatttacatgtggacatccaaaaacgtgcgatgactagaggacacctacagaatggtaatttactgaacgacaccacactcattgttttaatattttagatccaatcgaagggatttttttttcaaaaagacaagaattcccctcaggccacaaaattataagctacgctggagaaaagaaaagaatatgatgtatggtagcagtgtactttgggggaggatagattgagagttgcatgatgtgtagtttgaaaatctaccagaaaatgtatatgaaaatttagatttttctgaaaatctagaaattatttttaaaaaattcagattttttattttttattttggaaaagttgcaaaatgtaccagttgctgctgctctagggttttggagggggttaagagcatgcccagcagatactctaaccaatcctccatcccggtattggcgtatatgggtgaaaaaaatgccctccagcagatgcgctacccccacactccaaaattggcggatgcgccatagtaggagagagaagaggcaaaaatagcgtatctctctcctcacgccatttcgcacccgcccccatccagactttcgcaaccaccacccctccggtgtgccttcccctcgccgtcgtccccaaccggcgtagatgagttccccgtgcccctttttttgcttttttttcagcgatttgtggagcgagccttaccagatctgggggcgtgcgcggggccttttgtccgccgccgtctccccacgcgtggccgccgctctgcgcccgccgccttcctcctccggcgtgcgcggggccttttgtccgccgccgtctccccacgcgtggccgccgctctgcgcccgccgccttcctcctccggcgtgcgcggggccttttgtccgccgccgtctccccgcgcgtggccgccgcccctcgcttgccgccgtcgccctgcgcccgccaaccgccgtcaccctgcgcttgccagccgccggcgcccctcaccagctcgcccagcgccgtctctgagcagcccgccgctcgcggcgccccttccctcgtcgccctgctgccctcaccgcccacgctgccaagccgcctctccctccgccgcccgtcgcctgcatggctcggggatagaaaagagcaggagaggacaaagaagcagagaaggatagagaagaatagagaaaaagagagataaagacgaaatataagctttaaaatataatataaatgtagggtggttggaaaatattattaaaacatagggagggtgtaatatggatgatctgttggagtgagtagggatatagaggaggaatctttttggatggccatctatataggcatatgaaggattaaatttggatgagctgttggggatgttctaagggagatatggcctggtttggtccaaatcaagccgagtaatatgtgctgcttcgaggacaaatttgtcatttcaacgcactgtctcccattaggtatgaaataatatggtaacggttgtggtgtccttcacctgtagtaagttttttgtgatgttcaccaacaaattacgtaatttgagtgtcggaagcaaaattttccattattatatgaccacaaattaaccaaaaatacattttaaataaattttagaataaatttgatgaaactcatacaacattttcaccaaaatttaaacccaaaacaaaaaaaaggggttttcattcacagtgaaactcgtttatggctgtaaccatcttttgaaatatttgtttcaaaatttaaattttgtttttcaaatttggtgtaaaataattatgccctattgatttattatatttttttaaaaaataacattgatattttttaagtagcacattagtatatatgagagaggggtaatataattattttagagaaacataacggatatctaatgaaacgtggccatgtgggtatatagggataaatgtgaaaacctatgaaacaaaattcaaaggtataaaagagcttgagtaaaactttttttttaagaattacacaatacaacacagacactcacaacgcatgcacactcacccctatgaacacacacacgcaaactctacccctatgagtatcttcgaatactactcaagcacgtgtaagtagttttctgcttttcatactgtgatacaaacctaataaatctcgctatatccacaattcccctacattacaatgagtcatgtccatgcagtacagagcaacctgaacttcatctctttttgcagctaagatcaaaacaactacctgggtggcccgcgcaattgtgcggctagcacctaaacaaaatcaaatattttttagtatgattttacttaagatttattaaatagctatcctcgtatttctagttatataattttaaaagtcacaccagctgctaccctatatttctgtcatattcttctttatttgtttgctcggtctaccactatttctattcattctccttaaaatctttaaaaaatgtttcttatagctttttaagtttattatctcgttgggttttatttttataatttctagaagtcccctcaaatgctgccattatattcctctatgacccatccactgtcttttctctttattgtcattgggattttacaaatcgaacataattatttttttacaaatgaagtcccgccaaaccgtcagcggctttgccattatacttctttatggcctgaccgctgccttccttcttcattgtcattgagattttaaaatcaaacatgattatcattaatttttttttactttttagaagttctgaacctttaaaaattggatcttgtagtttttagagtttattgtctcgttgggtttcttttttttatattttttagaagtcccgtcaaacgatgctactatactcctctacggcctatccgctgcctattctttattatcattgggattctaaaaatcgaacataactatcgttggaattcatttttttattttctagaagtcctgccaaccgtcggcggctctgcaactgtactcctatacaccccgcacgctgcttctcctttttattgtcattgagattttaaaaatcgaatatgattatcaatggggtttgtttttcttactttctagaagtcccggcaaccgccttactcgtttgcttcactgcctgcttgtcatccctccttttaatcatcattagaattctatttgatgttttactaacagcttttatatgtcgtatcaaccgccagcactctacttttttataggccttttacttaatttatctcgtcatgtgttttagatggtctttttttaatagtatttatttttatcatcattttttattatttataaattgtattcctaattgaatttttttatttttataatttatgaatttattttttttcattgtaattaataccgtatagtgttcttttaatatttttaatttttattttttgaatttcagttgtttcaaaattgtattactacttaactcttttaatttttttcattttggatattattttattattttattttgaattttaattaatctcgtattgggttcttatatggatttttctttcaatattgcttatttttaattccgaatttcagttgtttttaaattgtattcctacttgaactcttcttttctttttgctaatttcggattttatttatatttttattctgtatattaactaatctcgtattgggttcttatatggacccttatctcaatattccttatttttaattacgagtttcagttatttttaaattatattcctacttggactctccttttattttctaatttcggattttattttatttttatttcgaattttgattaatctcgtattgatttcttatatggagacttctttcaatatttcttatttttaattctgaatttcagcaatttttgagttgtatttctacttggactcttattttctttttctctaattaatgttggaatttctagcccccacaatgaacgtggagcctcctttcaaggctgttttaataatataatagatagatagatttacccttttatgattgacgtattttgactcttccgagtatgatgggttttcaatttgaacaccaaaactaaggtaacccgcaaatgtggccatgaacaagcaaacgggtttcacatgtttattttgtcgtatcagtgtatcaccatgaagaaattaccatgtcaatgaaggaaatgtaaccactctggatcagggattataaacagagcaccctgaacgcgtgcacataatattgtacagacgcttacctaacccgctctgatatattttttttccttatctgaatatgattgtacacatgccagcctaaccagctaacacagaattgctgcctaattgccaactggagtaacaacagaagtacagaacccaagtaagaaatgtttttgatcgagtgattgattctgtgttgtgattactgaaacaataggtgatcaaatggatttaaacacgcaactcctaatacgtatcctttatccagagagaacttcttcaatacttgaaattaattaggaccattgatctgcaatgatctaacggacagaaagagaaggtacctgaaaaaaggtattaaaagggtgggccaggtatggaaggtgggagggtaaaatggtaattgtttttcattaattttttttcagtaaagggcaaaagcgtattcttacaaattcagaacttttgagagaagcaacaaacattttcagcaggaggaagaaaaaaacgagaggaagaattagaacgctcgcgtgcgagaggaacctacatgatctgctggttgtcgctgccgtaaaaggccgccgcttgccgaggcctcacacgcccgccgctcgctgccgccatacgcgcctacgaaagcagcagctggacaccgtcgccgccgccgacgcacgcgcccgtagcgcccgccggtcgcagctgacgtacgcagcagaaggtcgccgtcaccgccgacgagcccgtcgcgccagccggtcgccgccatcgcacgcgctggctcggttgattagggttaatcttgaatcaacggtgcgacggcttggttgattgggtgacgggtgggatttgagcaattactaagctacccttgttaataaaaatttgtgttcctaaattaccctttgaagattaacgggggataacaattcgttaaggaggtacctggggtacctttcaagcaccgtaaaagatctcttatccagatcatcagcaactgagttttatctgtagaacttgcatacgaagattggagaattagatgagttcgatcggcctacgtatgtaaacacgcaggctgataaaaatctgcaccaaaaatctgaacctgtatatatgctcgcattgtgtccaacctttcgcatcagaagcatcaaatggtaagccgtccggtacaaactgaaaaatcttcagacgcagtacttcagagaccatgaaaaatctgccacgcacgaggattaacctggtatttactgaaaaaaaatatccttggtatgatgtgccctgcatttactgaagattttgccgccgcctcttgctggtctcttcaagacatgaggcctgttttgacaatgtgacatgacaagctacgttgcgaccttgcagcctaacacgttccttgatcagatttccgacggccaacacgtagtaaaatcgtagttttacgatctcagctaggccggcgtctgaacctcgtggcttgcagagccgcttctctctgacggatctgaatttctcggccatgaactgcacgagcgtctacaggttagcagcacacgctgcacgttactgtaccagaaacctggcatctctcttcgatccagtttctgacgaaagatacagcacccagcagctgcttccgattgacaacggctgaattgcagtttcgagcccctcctgagattaattgcagagatgttcaagaaagtttgcatctcctcttcgctgccaaccctgaccgaccactgctgttaggtcaggtgcctgtcacgtacactcctttggtcagaacaccatagcggagctcgcactatataagctgctcgccatgagccataatggccaacaagaaaccacacataatagagcgtattgctcggaggcagccacagccatcgccgtcgccgtcgccgtcgtcccctgcatttatcgccgggccaccgagatctcgcataagtacagcggcgccggtgagagggaggcagaggctgtaggtagctagagaggaaaaatccacgctagctatgccttctccttcctcagctcattggctgagcttggtcggaagcgtctggctccagaccatcaacggcccgaacgccgacttcccggtgtactcgtcgcagctcaaggaggtgaagggcatctcccaggtgcagctcaacttcctcgccttcgcctccgacgccgggaagctcttcggctggttcgccggcgtcgccgccctgtacctgcccctgtggctcgtcgccgtcgtcggcgcgtcgttcgggcttgtcgggtatggcgtccagttcctcttcttggagaggcccgggctcgcgtactggcacctgttcctgctcacctccctcgccggcaacggcatctgctggatcaacacggtgtgctacctcctctgcatcaagaacttcccgtcggacagccgcgtcgcggtgagcctcgcgacgagctacctcggcctgagcgccaagctctacaccaccatggccgagaagatgccccggggcgccacggcgaggtactccaaggagaaggtgtacctcctcctcaatgccgtcgtgccgatgctcgtcaccctcgtggcggcgccgtcgctccgggtggtggagctcaccagccaccgccggaccgacccggcgttcctcgccatgttcgcgattaccctcgccaccggagcctgcgccgtcgtcggcagcatcggctccaagtccatcgggctctcgaccagcgagcacatgatcagcctctacatcctgctcgccctcccggtgctcatcccggcggcgctcaaggtgcgggagagcatggacaagctacgggaggcgaagcgggagaacagagtgcacgacgtcgccgccgccaccgacgtgccggagacggccgtgtcggtgctcgaggtggccgaggcggcggagaacaaggaggaggacgacgccgccgccggcgagagcggcggccaagacgaggtcggcggcatccggctgctgcggcggctcgacttctggctctacttcctgagctacatgttcagtggcacgctggggttggtcttcctcaacaacctggggcagatcgccgagtcccgcgggctcagcgacccgtccactctcgtctccctgtcgtcctccttcggattcttcggccgcctccttcccgccttcttggattactacaccgcaaagtaagcaaccaagctgcatgcatgcatgcatgtgccgatcaaatcaaatcactcgtgttttttacaacttgtttaaatgttggagtctttgtttatgcatgtcctgacaggggatgaatttttggtttgggttttgactatgcgcaggagtggctactcgctgtcaaggacggcgtccatggcggcgctgatggcgccgatggcgggggcgttcttcctgctgctggacccgagggacatgttcctgtacaccagcacggcggtggtcgggacctgcaccggcgccatcacgtcggtggcggtgtcggcgacgggggagctgttcgggaggaagaacttcggggtgaaccacaacgtgctcgtcgccaacatccccgtcggctcgctctgcttcggctacctcgccgcgttcctctaccagcgggaggcccgcggcgccagccgctgcgccggcgccgcctgctaccggggcaccttcctcgtctggggcgccacgtgcgccgtcgggacggcgctctgcaccgtgctgtacgcgaggtcgcgcggcttcgccgggaggctaccgccgccggcgaggtcgacgacgatgccatgcgccggccagcggccagcgactaacttaggagatgataacaagggaccagaaccagaagtttctagtacagcagtttaacaaattaattaggtgccacgtaattaattaagtggagaaaaaaatctacagctagtgatgtggagtaggatttgatgatttgcctttttttttcctctgggaaaaatattttgtttcattagtttctttttctaatctttttgagtaatcccatggtggattgagaagctcaacttgtgtgtacgtatatacgtatatggccaaaaaggaaaggataatacacagctcactttattactagatgcgctgcaaatcactgtgactggacaaagctttttttttttttacatggacggttttaatatatccagcaaacttttagtggatgtaccaccaagaaaggcaacttacaggctgaccattttagggaaagttggtagggaaaacttttctactcagtataggataatattgtcccttttcgggtgtatttaagatcaaatgtatagaatgtatctatgaattgtttttcttgtggccaatggattttgagacagtttgtgggattgttttatggaagaaaaaaatccaacatactccatccgtctcactcaaattacaggacgcttctattttttaaaaaaaaataaatttggtagcttttgactaatgatcatactagctatatctatgctaagtattatatatgttatatcattatatttgtatttttaaatacttcatatgatactaattttatattcgttaggaatataataacgaataacttattgaacaaattatgctattaaaaatcatgtaaaaatataggcgttacaattttgaaggaagaagtattattttctatggggaaccttgaaggagctctaaaaagaaaataagaatgtcatggtattactgatgctatggaactatcgccgacatccatcacttattgatggttaggatatttttaactcctagccatccattcatctcacgtcatttcatcttacccattcgttcatttccattttctaattcaatccatcataactctttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgttgccatctctttgtgatcaaagattcgccggtttcgctccttccaaatttcccaaactactagcaggataagggaccgaaggcccttctttggaatgccgggtgtattagctaggctctcccaccactgatggactgaccgggcttcctcccattgggccggttccaactgctgatatcccgcccatgtagcaacgaggcgccagattctcttcgtgtatctacacatggcgacgaggtgcaaggctgtctcggtgtcacaacgacatagggggcaatgtccgttattccgccagccccttgtcgcgagtcggtccgacgtccagactctattttgaatgatgagccaggcatgaaatttacatttccctggcgcccaaactttccagattagggagttgaagtttgtgtttggcgcccccaaacattgggcatgataagccgaggaagctgtatagtggccgctgcttgtgaatttccaaacaatctgatccggctcctcgctgtctaagtgcacattccgtaccgcctcccataggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccgttaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttgtccaagcttaggacaccaaggcccccttggctggtcggcaagcatgtctttgcccagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaactctccctgatattttgtcgaagaccggttgcaagtccgtttttcgca

SEQ ID NO: 64711 - DNA, 9298 bp, Oryza sativa
attagaagttgagggtgaacaatgtctgattttcggatttagggggtaattcggtcgaccacgatagttcgggggggggggggtaattcgtactttttccttttgaattcttgaagccaattaattctatgaactaaatgttgggtgaaggggggcgttgcgattcgaaccgatgtattgagccagttttttttttgggatttttaggatctcaaagatgccggttccaaaccggcacctttgatttctatcatctgtgccacttttttagtgtcggttgaaaaatccggcacctagtcgggtttccaaccgatacctatctaggtttgtgtagtagtggaggtggataccaattgtagtccgacccaaccgcgttttttgttttaaaaattaaaaaacggacgaagcaaatctccgtgtacgtgaagatcaaatcgagatcgatatcctctcgatcgccacggtcatggagacccaaccgacggcggaccggcgtcaccgccggcgccggctacccacggtgtgtgatactcagccgcaacggcgacgactcctctccacccttgtccaccccggacgacaagaccgagacgacctccgtctcctccggcggccacctcgtccgtgtctcactcttcctcgatgcgccgccggcttcgtcgcgcgtatgtttcgactgcttcccgcgcatccaccggggcgccagcctgatcgtcgtggctacccacggcgactccgtgctcgtccggttgagctacggaggacgcgggtacggcgatgtcggcgtgctcgattacttcgtctacaacgccggcgccgtcgccgccgacccggccgccacagccgccatcgctgtcgctgctccctgcctacgtcaccaaagcagcggacgatgaagaatgtgaagaatggcaagcatatgaagaagagagtgaaacctggccgcgccaccatcatcagattcatcaccatctggatgagaagaccaccggcctcctacgccgcggcgacgacgacatggtggtggtggatctcgccgtgctagagggccacgggctggaggaggagggggacgccgagctcctcgttctccgctccggcgagtggaccgtcacgcgggcgccggtcgcccacttcgtcggtagagccgacaagccgccgtcgtggatcactgacatggccatccccgtcagcgagcggcggatgtgctgggccgacctgtaccgcggcatcatcctctgcgacgacgtgttcgaccagaatccacagctgcggttcgtgccacttccccccgaggccctcaccgatgaaaccgacgacggctacaagcgggattacgccattacggaccgaagagtttgtgccaccgacggcggcgccgcgctcaagttcatctacatcatctcccgctgttgctgcggcctccccggcacaaccttctgcgacaattccaaggaggccttcatcatcaagacctggatactcaggatggacgacgacgacgacatggtttggacgatggacgccatggtcgacgccaccgagctctggtctctccatgcctgcgctggcctcccacaagccaaaccaatattccccgtcgcaagcatggacgatccccatctcatctgcttcatggtgcaggagcgagaattcgagggaagaagaagaagatactgccacatcaagagaacatggatggtcatgttcgacacaaggagcaagaaactcttgtcagtctgcagctgccgcgatagttggctcatataacgctccgcttttcacgtggcgttaaaaagctaatgtacaaaaatcctaattgcgaaaatttagttctttgagtgttgagtctaagttgtgccatagatctcaatttaaaatccctctcttgtctcaataccctgatatcaaagatcacctcctcaaaatttccgttccaaaataatctcgaagtttgaatccttctattcggatttcactgtagaaaccctaaccacagatatcgcctaattccggaatccaaaaccagactccaaccctaaaacctctccaatcaaattccctccttgagctagctctaacatccaagcgtccccctctcctcgtctccctcgctttatctatcgtattctaccgccacctcctttgtttcaccccgaacattgatttctccttttgattccctctcaaataatccttgagctgccaaatacaaatatatccctaaaatatcaattctcgctttgaacttcaaccacccatcgacatcgaaaatcacgcctcatcgaaattccttcccatttccgaaagtatcgaattcgctctttgaatcccctccttggcttctccatattttgttgagttcaaatatccaatttgaattcaaatccaatgtcaaatgctcctcaaattccttgaagaaattcccttgaaaaagtctatttcacctccctcttggtcgttgggccgtttttcccttttccggcccatcgtctcctctcggccgctcctcctcctccccgcacgcacgtgctctgcacgcgccgagcgagagaagcagcgcctctctcctctccttcctctctctctctctctcgtcgaactcctctccctagcgccgatttccgccgccgccgtttgatttcgcccgtcggtttcccccgcgcgcgcgctcgacgctcggtcgccgccgcgttagcctcgacgccgcccgtgcccgcgctgccgctcggccccgctgctctgcgcgcatgcgtccaagggcgagagccagcgctcggtctcgccctctcttcctccttcacctttttcccaaagcggcatggagcaagctccccttttctccctccttttcccttttttctctcccgaaccgacgtcctgcctccaccgcttggcatctagcgccatggtagcgagtgcccctgacgccgcgcgccaggtcgccatgccccaccttgaccacgccgagccgtgccagcccgtgctcgcggttcgattcccaccgcacgatccaccgcctccactgcccaacgcatccgcgccatccgctgtttcgtgccgcccacgaaaacgccgacgtcgccagtgaacgccggccgagcgccagctcgcatgctcccccgaaccgaccttgacgctcccacaccccctctataaaaaccaccccgtgcttcctcctccccttgcttcgtttcccccaagcggcgaagctctgccgccatgggaactcctggccgccgcgtcgagctccatgtccggaggcatctcgccgtcgagtcgttccatcctcgccgcgtccttctccttccttggccgaacgacggtcgttgccacctcaccgcaaaacccgtctgtgccgccctgccctgtccccatatttccggataccgcgttggtcccgattcgccgccgccttcggaaatcccggccgcactcccccgtcggccttccctctcccaccacaaaatcgccgccgacgtcatttcctcttgccggtgagccccgagcctaaatccttcccctacatcttctagctgctcacctcgccgtggctctattttccgccgctgtcggcctctctctcctctcgccgtaccttgcgccgccaccctccttgagtccccttgagccaccccaaaaccgtcgctccgcccgctggcctcctcttttgctcctgcgccgtgccgtcctttccaccgccgtcgtgcgcacggtcgcgcaccgccgttggcctccctcctctctttgattcccgacgccgccgccatccccgtgacccctgggacctcccagaagtgtcgccgcagtcgctagcctcggcctctgcgcccgcgccgtgccgctcccgccgccggcgccggacgccgtcgccggccccctccgaccccggcgccctaatccgagccgtggaatgagttcaccttctcctccttttgcctccggcgccgtcccctccctctggctcgctgccgctcgctggcgccgttgcgccgccgtgagccgtccgatctccggaagcccttcttcttttccccttttttctggcaggggaccaacactggcacccccgaactagtaccgaacggaacttagcccgggacccttcaaattaacctgttaatcgataccagtcccaagaaacagtgctggtttcacaggaagacggaatatcacagcaccagaggtctctttattatagagtaggaatacagtcatgttgggctggggacagatcctgagctcacaactgcattacaaaagggaaacggaagccaagacttgggccaaacaacacaggcgcgacttgggaactaggccgaaaccctaaaactcatcgtagccggcttgctcctggaagaactccttatcagcaggatccgcttcatcttcttcaccaactgggggggtgattatttatatagagcaagggtgagtacgggagtactcagcaagccatgggaaataagtgtttaatgcaggcttcaaggaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgattcaaggttggcacccggctaacagcttccaaacggccacccgggccaacaactttcaaacggccacccgggcctagctgatcccatcagctgcaggtttttcaaacatcgaacccattccacaacagcaatttcgcaaagcagtagtcaaacaaaactacgctaggaatcacctcacatccgcccatgaccgtgggcacggctgttcgaatagtttgttaacctctgcagagggggtacaatttacccacacgacattactaacccggatcacccagcccgtggggatcagccacgtcgggagacctccaagctttcatgacaaggcatttccaaagcggacacaggtttaccatatgccgacgagaggggtcccagaccaacaacaggttaggtcccagaccatactgtgccaggaagcccaggggtcctccccgacaccaccccggcgaatccacatgtctcccggcatcaaggctcccctgataagctagttactcagccaggggtgtcccattccacccatgtggtcgtacttgtcttatattcggatgaaattccaaggaaacggtccttaggtgcgagagcagaaaaccgtacacccggtacattccccggtccgcggttttggaaattcatttagttcgcaagcaccgacccaggtgtcgggttttccaagtctttagtaaagcaagttttacccaaggagttactcgcacagagtgcacgaatatcgaggcgcaactagatggttacaagggaacatggtatagcaattaacaaaggaagggtcaaatgcaacaaactaggtaggtccaccaatctgccttgcagacgggacaaacagattaagtgcgatcctatcaatgcataatatttttcaagcaacataattaagttcaaatataggctaaagatgttcaaaggtggcttgccttgctcgagatcttgagcttgatcctcgaaatcctcgcactgcgggtcttcgggctccgaaactacacgcgaaacgggacaacttaacaaacagcgaaaataaagccctattaatgacctctaagcgtgacattagatagatctcgagatttgaggaattttggaagttgaacggagtcaaacggatttatggttgggaagatattgaatttctaagattattggatttttggtctaaaggaaaaggatttaattaaatcctttttgaaaaaaaaagaaaagaaaataaaagagggagggaaattagactttcctcgggcggctagggcgcggcccgagagaaatggagcggttcggccgagctaaatgggccggccggcccaaggcggcccaagcacgcgcgcgcgggaggggaggagagagagagccggtggaccaggctcaccacgcgtggtcccgggtgggacccgcttgtcagtgacacggttcaccgtgcggagcgagcacgcggcgcacgcgcgcgggcgggggagggacgcggcgcacgcgcgcggttcgcggtggacacggatgcggcgggcctacgcgcagcctcacggctcgcggtggaacgcgcgcacggggaggggctgaccggggtcggctcgacccggtcttggccgagctggcgccgacgtggcgcctacgtggcgcctacgtggctgccacgcgggccggcgggaggttgacgactacgccggccggaacggacggcggacgacagcggcgagcggcggagcgaaccacggcgatacaggcgaaagcgagcacaccgggtggttgctcaggacgaggggagacgagccaacggctcggattcgccggagggagtgcgtcggcggcggattgcggcggcggcaaccggcggggagggaagagggaaaaggcgacgaggtcacgaggggccgattcccggtggcgagagcatctacgcggctacgggaatccgtcccttgttccggattaggaggaaacgcatcgagggaggccggcgacgagaggcgcttccgagctcgggcggcgacggcggcgagtacacggcgagcgacggcaacggtcggggcggcgccggctagctacggggaggctactcgtgctactactcgagtctaaggggaggagatggaacgaggaggaagaacggagggaggcactaccgtgcgggcgggcgcagtgacgagaagccaacggcgcgggagtaatctctctggcctcgggccggggaagaggaaggagagggcgcgcccggagtccccttccgcgtcctcgctcgtgccggctcctctgacacgcgcaacgacgaacggtgacggcgaaacagaggggcagcaacaatggagtggaggcgatgggacaacgagaggagaagggagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaaggggaaaaggagggagagaaagggggctcgcccctttcttctttgggaaaaggaggaggggagcgggggcgacgagccagagggaggagggctctgcctccgtcccttggaggctagcgcgtggagtggcggggccgaggcgatgacgacggcgatgacggcggggcggtttggagcggagcggcgacacgggcgacaggcgcgtgcagaggctgacggcggcggcgaccgggcggtcggccaccacggcacgcgcacacgggttgaaacgggaggcgcggcggtttgagcggcgcggctcgggcacgcgcgctggcttgcggggccgagcggctgcgtggctgcaggcgcggcagggcagcggggccgggcggcgcagacggcgcgacgtgggcgacgaccacgcgggcgcgcgcgcgcgaacaacgacgcgcggggccgatttcgcgggcggggagctcgccagggatggaggcggggagagggaaagcgagggggaggcgctcggcgcggcgcggctcacgcgcacgcgcgcgcggcgcgcgggcggagcggagggggagggagagagggagagagagagatagccggcgagggagggggagatgggccgagagagattcggcccatcgaactcgggggaggcaaaatagacttttgcggaggaattgatttgggaaggattgggattcgggattgaactcgacgatggatcggggatttgagatctgaaatggcacggacactagacaacaagcaaagaaacaaatttcgcaattagggtttttaagagataattttcccgctaggcgccacgacggaacgggcgctacaaccacgtggccaccacctcagccacccggccctgcttgactcggtcagccgcctcttccctctcccgctcgtgagctcggcctaccagccggcccatatcctctctcactctctcccgccaggccatgggccatttccttgcagccacccatgaaccgaagtctatgtttcctccctccaccaaatcacttctcttacacaaaagtccatctatcctccccaccgtttgctggccccacgtgtcaatgagtcaaagatattctagagaatgtcttaatccggagattccaataattcgtcccctcgagcccgcatgtcagtggatgtcaataatattcttgagaatattatttctataaattccataaaccatttcccgtattccagaaaattccgacaaatcatctccttgttcagaaaaattcatttaaacttccaaaattcatatcccttgatccgttcgtccgattgcctccgttccacttccaataattccattaaattgtgatatatctaatggcactattaattagcctaaataggatattttatttggtctttttttaggtttttgattgtttgcgcctagttgcggttactggatatttttcttcaagcggaattctcgaagatttgtgaagcttcgtgaagaccctgagcaaggcaagccacctttgaaaatattgagcctatatttgaacttctattgtaaattattatatcatgttcccttgtaaccatctagttgcgcctcgataattcgtgcactctgtgcgagtatcgacggtcgccttccaacttaaaatttgagtaacttcttgggtaaaacttggtttacaaaagctttggaaaacccgatgcctgagtcggtgccttgtgaaagaaaatgagttttaaaaatgaaactcgcgacacaaggccattcctgggtggaatacttgtgcggtcgcatttaaggaccgattccttcggaattacatccgaccatacaacattgcgaccacatgggtgtaatgggacgcccctggctgagttattagctaatcaggggaaccatgatgccaagagacatgtggattcaacggggtggtgtcggggagaaccctcgggcttcctggcacagtattgtagcgcccgttccgtcgtggcgcctagcgggaaaattatctcttaaaaaccctaattgcaaaatttgtttctttgcttgatgtctagtgtccgtgccatctcaagatctcaaatccccgatctatcgtcgagatcaattccgaatccaaatccttccaaatcaaattcctccgcaaaagtctattttgcctcccccgggttcgatgggccgaat

SEQ ID NO: 64712 - DNA, 22852 bp, Oryza sativa
tttatattgtaatatgctacctctgttttttaatagatgacgctgttaactttttctcacatgtttgaccattcgtcttattcaaaaattttatgcaaatgtataagatataaatcacacttaaaggactatgagtgataaaacaattcataacaaaataaattataattacgtaaattttttgaataagacgaatggtcaaacatgtgagaaaaagtcaacggcgtcatctattaaaaatagagggagtatattgaggcgtaccaccgctgcattgcatttgcaaattattttgtatgcacatgcatgcgtcgtttagaaacggtacaaatttctggcctgctgatgacgctagtgaccgacctgtcagaggcagtaatacatgtgtagtatgcatgcatgcaatgcactgaatatattttaacttgcattttttcttttttttccctccctttggtgtgccatgcatatgatgtcagtgtcaccatctttcaaaaccgaaacagtctacggttgtgttggatcgaacctaaaaggcaaatccgtatgatttttaggtgcatgcactgattggcgtgtcagttctagctggcctgggcttctttctttagaagcatgggacggagtagctgttagccccatgcatgtaacaatgttgaattaatttcaaagcttgaaccagacgttcatgatttgcatttcggaatttaattcactcgttacatgcatatggagcagtttcacctatataaaagcactagataacatgctgtaattagctctcctgcagatacctcagtacctcaccaaggttttaaccacaaattgcagcatctttcttgccaaattgatctcttactacctttaaacgttttagattcatcactctcgatcagttcaaaatcaaagccattttcatctaattttttgtcacttagaaattggggggaatacaaggtttcaaatagaacttgaggcaattttcaactgaacacttgacagtttcaaatcaaaaccgagcgaaaatccaggggtaactgaagtgactcgtgcggtttaattagcaaagttggttggtttgcattgtatatgcatatagtttttttttttctctttcagcaagaaagaccaatttgtaggcgcatcactaactagtacaagtgtgtacttgtgtgcgtgctctaccaaacatagggaccaaatcataactcataatgttctccacgccactgacctaccattcacacacgagatcacgagtcccttaattgtttttgctggagggaattaacacaagaaggtgtcttggctaggtggagttcacgagtaccttaatagcaattcatagtagtacaaatattttgagtttagaaccaatgccattcaaaaaattacatgcacatatacttcaattttcaaatttacttccagaaagaaaaaaaatgttgaggaaaaaaattcatgttgacaagtagttttgaccacgaaaggtaaaattattcaactcacatggatttaagaatttcagataaaataaagcctccaacaattttccactgggcaattatctcctttcaccttgccttgcttgcaccctttaattcaagcagacacacgcctgacctaacatgtgtaactactgcccccacaagtatttacagagattttgatgtcatgaatttgacaaccacgaacagctttgaccacagctgctcatgagctcactccattcatgctacctgacgtccaaatatttttgacagaaaccgtctgaaacgtactactactactagtctgcagaattccatgaactaacacattatgcagaatatactcacgctgtgttgacttgctctgcatttttcatcatcatcaccaccatcattcgttccaagttcttgtgtatcgcgtccttattctgcatcagagctatccggccagccagccactcgatcgatctacatctgaatgacagaacgggatacagaatcactcacctctctctgtttctctcttatgcaggctagctctctgtttcaaggttgagtatttttgccgtatggtctacagtgtccagcagccacgctttgctttgcttttgtgtggccacaatgatgaagccattgcactttgctttagtttcagcgagcaccagatgctcgatccccttgctcctttatttttctttcctcaaccaaattcatcttactcttctctttctttaatccttctcctcaccttaagctttggtgattttgttctgtcctgctctaccctgtctttactcccttcgtatattctctttgccgagcagtgtttgaaacaaaagaacaagaggcacatacatccatacatgtacatgagccatttgtatgcgtggacctgatacggttcacatgcagggatgaggcaggctagcttttttgcaatgcaacaatctccatatacatcgatctcacctcgccagaaataattgcagtagtggttgagtccaaaataaataaaaaaagaacatcttgtctctgtgtctctgtgtgagccatggctggaatgaagaggagaggaggcagggccacgctggtggtgcagacaaaaggaaagccagcagctttcagctttctggaattttaagcagccgtaacaccacctgtttgtctatggggataggagcacaagaacaggaggcaccagacagctttgtccgctggtgcttattccctccgtttcaggttagaaaacgttttgattttgataaaagtcaaactatttcaaatttaactaaatttatacataaatatagtaatatttataataccaaattagttttattaaatcaataattgaatatattttcataataaatttgtgttgagttgaaaatattattatttttctctacaaacttgaaaaaaattgaagcattttaactttgaccaaaatcaaaacgtctcttataacctaaaacggagggaatattagcttcgcggtagcgatccaatggaaatgcctttcccattggaggccctgaaccaaagatgagaattttatgcaaaaaaaaaaaaagattgagatttttatttctggctcgatatatataatcgggcacatgtaatttacacggcatgggaatcaattaattaagctcgatcggggagggggagtaggaagtagctagctagagagtgttctagccagtttgattgctacctaagctaggctaatctacatcgtcttcgtcttcgtcgtcagctaatcatcgtgttctagcctctggttcgtatgatggtgatggtgccgcgtcccggggtgtgcagcctggtgaagccggcgacggccttgccggagagccccggcttgtccgccgacacgcgcggcgcgcacgcgaactcgccgacggggtggcgcaccggccgcgacggccgcatcaggatccgcgcgttgatgtccgccagcgtcgcgccgccgtccagcccgtccggcttcagcaccgcgaacgggcgcagcaccctgcacgccggcgccgccgccgccgccgccgacttctccggcgtcggcgtctccgcctcccttcgccgcttgctgctgctctgtctgcagtactccgcctccgccgccgcgtcctccgccggcgcggcgcgcttcagcgacgaggaggaggagcagcgaggtggggcccgcgcgacacctggcgcggccggagtggcctgcggctgggccccactaacctcactgacctgtgggtccgcctggcagttggaggatgagctgctgagtagtggctctgccacgcctttctctggcaatgtgggacccgtcgagaaaatcgagcccaggagatcatcgtcgtctgcaagcaaaagatgacaagacaccacttattaataatctactcctactcaagtatagtaaactaatcacctactactaatcacgtaaaggctcaacgttaacaagagcagtaacgaagaagattagcagaatctgggtagtgtctaaccacgtaaaacccagatctgtctttacttgaaaagaagcgccactgacagttcctaacaaggtcagacgcatcatgccatcaaatgcatcctctgctataatactatatactcataactcatcactattctatacactactataatctaatgatgcatcgatcatgcacaaatcatgggggtcgtgacaacaactacgtgctgctaatcttccccgcgggtcccatcgccattgacagaatcacaatttgatgacacaaaaaatattactatacgacttcgtgttctgtcctttggtggtgcgaggtcatggaggacctaaaaaacgcagaggattgctgctgctctgcgcgtgtcgtggcaaaagctggtggttttgtaggcgaaaaaaggcgtaaaagattttaatttcaaactcttcttctcaccgtagaagaagttggagttggagttggtggtggttgcagtggcagtggtgctgctcgtcttctcctgcaggatgcagctggaattgaaggcgacctgttgttgttgttgctgctggtcgctgcttgcgtcccagaaattctgcaggagaagcagattagcgtaggccctcacgaaaatctgcaagaaactgttgcctttgctcttgtctcgtgcgagattactaccaggagaaggtcgtcgagctcctccggcaatgccaccgcgtcctgctgcggcggcgccggcggcgactccatgtctgcactccaagccggtgcacggattaattcaccaattcgaaggcttgaacataggtaaagaaagcgagcagggcacgtacagagtgggaagaggccgtggacgtcggcggcgaggacgccgaggcagccggcggcgaacggcggctcccaaccgagcaggaagcaatcgccgccgccgccgccgctggcgccgctgctgctgccgctgctggtggtggcgtcccagctgctgcttctcgctgcctccatcgcgtggaaaggccaggacactccctgcagctgcagcagctgcagctccctttcttgggctgctgcctccatggcgttgcagtgcagcagagcagagtgagttgccgagtaggatgagtgaggagtcgagtggagtgaggagagacgagacgagacgatagagtgggcgaggcctgctgcttaaataggagggcttttcgaagagtcctcaaaagcgaaagcgcccgagctgcaggcccgcgtgtcaagtccacccctacaccctagtttatacttgttcctatttggaaaccgacttttcttcttctaaattccaattgggataaaacctttttactatgattattgaacggaaaaaagtataaattaccccctaactattgtgatagtatgaatcccccctccccgcgaaccacaaaacagacatattaaacctcaatctattgaaaccggataaattacccccctcacttaatctggagcggttttgatcctacgtgacatacatgtggcactaacgtgaaaattcaatcagcaaaaaataaaaataaagaaaatatagggcccacaagtcatatttctatctgtgtgtgctgttggcgttggaacttgaacgcgagcggctacacgcgcggctttggtctgcggtgggcgtggcaaggattggaactggtcggtggcgagcggcgacgggcacagctgggcgaggggtggcgggagtggcagggagggggaatcgctcgtcggcgagcggagagcggcgacgggcgcggctgggcgagcggtggcgggagcggcagggagggggaatcgctcgtcggcgagcggagagctacgacgggcgcagctgggcgagcggtggcgggagcggcagggagggggaatcggttgtcgagcgagcgatggcgctcatcggctcgtgcggctcttggacggtgcgacgcgattgcgcgagattttggcaccggccgccgccttagccaccgcccgttgcgccgcctagccgctgcccgcccgcgcgcagataagtcgccgtcggcttgctacccgccgcccaccgcgcgcccggtcggccacgcctccgtcgccgattgcagcagtcctcggtctccctccaccacccccaactggctcccacccccggtcaccgccgccctcagctcgcctccggtggtggagatggaggtgaggggagggagaagagagagagttgggaaagagagagagagatagagatggtgaaaaaactaccatgtggggcccgtcttttaaaaaaaatgttgactggactgccacgtagaatcaaaaccaccggcgattgagccaagggggttatttatccggtttgtatatttggggtgaaaaatgtatgatttttagatttagaggtgtaattcgatctgaaaaactgtactctgtgcaataccacaactatggttgacctgtatttttgtgtgattgtagaggctcgatgagttcccattaaaataaaacaatgcaagtaaaccatttctattatcaaagagaatgtgataccagtggatccaagagtttctttagcattggtatttctaacaagggatgccgcgattattccactgctattctaaattttaacaaagcaattggtatctgttttgcacatcgatttcgttaaaaaaaaaagttgcacaccgaatagcctaggcagccacccgacatttggagaaaactgtgattatgccatcacataaaattggactacctaaaaactactccctccatctactttttgatagtaatatcttatcttgacacaatgaccaaagataagtaattttacttatcatccatttaagcatgctactagttatttctcgtaaacaagcgattcattaatatttacatttctcgatgctcatgtagccaatcttgtgtggaagaatagagagtcacgcattaaatccgagaaagtcattaagaggatagatggttggattgaaatatgtctatcaaaagtaattttttcagatttagaaatatgcctatcaaaagtagatggagggagtatcattcaaatgggcttcgttaaaataccacacaactaggatggcttcgtcgaaatatcatctgggacaatattgcccctagcacttctcctccaagtgttggaggagctcaccggcggaatgtgagcatgtggaagaccgagacgaggcatgtggcagagaaggtggcgttgccgatgaggcagcggatgtgcagggtcagggccttgtgctgatacgcgaagtagaacccgttaaggggtcggttttaactcggggacttgcgacttgtgagctcctcgacttgcaaaatcatctcggatggcattctgacgaagccatcctggttcagagcgacattttaacgaatcctatttaactgatggtatttcaacaaaattagtttttctttatcggatctgaagttaccatttttttttaaaaaagaagaaatctgccgttggttttatcatggctacttgtgcaattgtgtatgtgcgatatgtgcgtctttctgcgtttgatatggggcgacttgctggggtgtgaggtcagtgagcttaagataagagtggaaaccgaaaagagttacaggcgagcagatgccgagagtacaaagtccaaatgaagcaacgaaagcaaaagatagaggtggttggttggttacggccgctttctcgtgattcgttatgttcgtcttctcctgctttgctttctcttgctcctccttccttgatctcctttcttttatgcttcttctacttcaacctctgctttcttttctccctccctctctctctctctctctcttttgataggatcctcgtccccttttgtttttcgtgccgatacgatcgatttgttgcttgttcttcatgggaatcgctgtttgtagtacgtaagtactgcaggttgtagtgaacttatactactactagtagtgatcataattcgaaaattgtcggcagctaggtctatgggattaggggcttttgtttttttgtttagtcaactttaacacttttagttcactcctgtcacgtggtttggatcgttttcgtttggactttttggctcaaggtctggattgatttatgttactgctctgtatatgagatgtggcaaattgaggagaggttttggttctatccgagttggtgttttgtgatgcctgctgttgcaagtaggtcaaagctactagctgttgcttggtgaggtcactagctgaaactgctgtagtgtatggctagcttggtcctgggactggatgtgccagtatgcataataagtccagaatacctgcaacccccccaaaaaaaaaagatgataacggtttttcatttggctagctgcttgaggagttcagtgttttttttttagttcatcccttttatgattaactaggacctatactcgcctacctgtgtcatatgtccatcacaagtcacaaagattggtgctttagggatttacagtttgacaaggagtaaagatgttttaatgggatattacaatttctaaaaatttcctctcttttctttttccacatctacacatgctgcgaaactgtggcatgaacttgtcaaagaaaaaaacattgggagtacttatagaccactagccagcagcatattgacttaaacaacactctgcaaatattttactaagcaccatgaggaatgtgcttcatcagtgccaccccataacatactcacctcagttgagtactccacaattatcttttttttttttttttacttttaccaccagctgactctgttaaaaaaaaacatttttgcagtacatacttcaaaccaaaaacctgaggtcaatcattcacactaaactgctagtacataaatttggttccaacactattttacccactaccccacagaagctcctcctttttccaaagggccccaagtgttactattaggagctaggggtttggtgtgcaattgaacaatgttaattgtacacttgatcaccgttacttttttcagggtggtgggcagaattattgcaccccatcatgtgactaaggcgagacaaatccaagcagaaaagggctccacataatagaaccaaaggcaagtgtcactccaaattttgggagcccctgaaatagaagagaagaaacccaatcaaaagcagaagagttactaatgtcttaccggccccggagtcgtcgggtcaacgaagaagaggcaaagattctccgtcataatgcgtgctggctgatggcgcgcaaccgtgcatgcgtgtatgtgtgggcttgctctgtttctgaagattctgaatatttgtggtgttttgctttgctcactgtaacatttttatttttgttagcttctgggactcttactggaaaatggaatgagccaaacagttgcaatgtttatgatgtttacctttcacagttctgatgtttggatttgtaaggttttgtagtaggcaggattcatgtttacaacgaaagccagcctagaaccgtgaaatttcgaggtctcgacgcagaaggataatatggctgtgtttattcacactaaaattggaggtttggttgaaatttgaacgatgtgaaggaaaaattaaaagtttgtgtgtgcaggaaagttctgatgtgatggaaaagttggaagtttgaagaaaaacttctgaactaaacacggtgtatattctaaccggaatttcgaatggtcttcaagaatttaaatttgaaacagtaaatttgctcgaaatgaaatccgacaaactttgattgaaattgtcaaaaacagtcatgtacacaccttcaggggtcaatcggaaaggtgaaccttggtggtagctagtaaaatgtggtagaaaaactcttggaatcaagtgaattttgaatagggggaaaaagtgtcaacgtctagctcaggaactatctgtagcggttggtggtgtcaatgtccggattgcagttgtctcggcctcaaaatgttctggaacgagacactacgctaacgtcctcggttaggaagaggagaatggtccactgtactggttcttggatcagtctgctaccacctgcactgcatctaccatctcccagcagcaaatcaagggagcagctacagtatctttttttaatttttaatctcttccatcttctccttttgaaaaaggagctacagcgagagcaatgttgcaaacattgaaaaagatgcacgaattgcaggcagtatctcttctcctttctcgctttaccgtcacttttggagcctgattttccatcaatcacgccatctagggcttccttgctgctattgcatctgtcggtgtttttcctcgctagacatttcttaccatatggttgcttatttacagtttccagtaaaagacagagttagtcggtaaacaaattttaaatttcaaaacttaattttagaattaattttgatttttttactatagattgttttttagcacttgcttttatgtcactaacaatacatataaaagttttatgcataaagtattttttgactgctagtaacaaacgttatggtttataattagtacctatgaatattttaagtagaacatgagaactgtgatgggatgatggcgctgcagtgctgcacaagttaattatgcagattaatcaaccagtttttttaaacaagattaattaaccaggtctggctgtccatctacactcttgtttgattcttaactaacattgtcaatttgtcataactcataattcactttaaacgaatgtggcttgccacactttttgtcctataaattataagcaacacttatagcaaagttagacaaagaatttaattgatgacatgtgaggtaaagtgttaagaaagtgtgacttaccacaactatgacaataaatcaaatataaaactaagaaggacgtgttagtctaaaatgtgatgcgataaggtgaagcgttgaaccaaaccccctaaagctgttgcatgcctacaaaagcctagggtggtaaaaaaaattacctggtgcaacaacgattagacggcaaagggacaatctctaaggctagattagcagttactgtatcctagaacaactgatgggatgtaaattgtcctcatgacacaaaacagaagaccactttttgcacaccactattttagtttgaatcacccaaccaaaaagcactgctgctgctgaggaacggacaagcaaacaaggtgagtgagtaccactcaaggaaaggaaggcacatccacaaaatgtaccgtcgagtaaattctggaattgacgaggtaaaacctcagcatttccactgtacaaaatttcagcacttccacgttgagttcgtcttggaagctatatttgtacgcactgaactgaacttgaagatcaaatatgagagatacagacttcaaatttgtgaaagttgacgcgattccttcttcagtttttagaagatgcaacatgcgaaccatgtcagtacgacgtgctgaatttttctatacgtataatgtatacagtttacataacgcagtaacacaatttcctgatcttacacttctaaccgtctgattcctagttccaatcgatcaacatcgtaaggcaacagacaacactagtgattcaatcgatcaacagctcatcagaccttgtacagcatgccgatctcaactcgctgttgcagaggcatcccaagaaccggcagagccgaccggcagatcccatgcaagaactcatagaatccgagcatgatcttatcaaaccagccggcgtcctcgccgacgtagaacctcatcttgccccggacgtgcaccacgccggccaacctcgccgcctccagctgcgccatctcttcctccggtgaccggcggccatcagtgtccatctggatgtgccattgcaggcagctcgtgacctgcgcggcgaggtcgtcgccgccctcgaggctgaggttgtcggcgtagccgtactgaacggtgcagccgtacaccccgtttggtccaagcctgtttatcaggatccttttgctttgatcaactttggcgacgagcagggacctcagggtgacaaaaattgtgaccgtgtgcagtgagctcatgttcttgatgtaatggctgaggattggagttagcccgtcctgtatgttgctgtagaagaagcagaggccagggaccctctgaacctcaggccttgccaagagctcgccgaggtgctccaagctcactttgtttgtcatctcgtactcaaatttcctttgccgaccgtagtaccagccgaacatgatcattgcaagggttatggaaaccgcgaaaggaagccaacctccttcagggatcttggtgaaaactgcactgacataggccccttccatgatgaagaaggggacgaagtacagcccagcaagcacaagtggtgttctccatatgatgatcatcacaagggtgagtaggactgtagttatgagcatgaccatgatgaccacaacacctgcaaaaataatgtacattgaggtactgaatcttcttatacaaaataattttgtattgacaagtcgagaattttgtagaacttgcttaccgaaagcattccctatagccttgccaccaccaaatcctagtataacaccgacacacagtaccatgagaatgtaattgatttctggggagtaaacctcgccttctttgtgttgcgacgtgtgcaccactttaacacgagggaagtaatccaggacaactgattgcttgatgacagagaatgtcgcggatattaaggattggctcgcaacaattgctgctagtgttgcaacgacaaacattggccagtaaacgggacgaggaacaaatttatagaaaccatcaccaaagtcattgacattgtttataaggtatgctgtttgcccagcataagtgagcaccaaagaaggatatatgctagacagaaatgctatctgaaaaaaaaaagatcaactgtaagaaattatatcgtgtataaattgcagatggacgtctcaatgaaactaacctgaatagcctttttgctgaagtgcccaagatctgcgaacatagcttcagcacctgtgtatgtgcaggaggttgaactttacacctatcatcattggtaggagaaaagaaaatactcaaagttgataatgctggtatggaatgtacctgtgatgcataaaacagtcccaccaagcagttgccaaccttgccttttatttctcaggaagaaatgaacaatataatacggtgaaatggctttgaagatgccaggatagtaatgtacaatactgtataagccgataattggagtggtgaaagtccatgctgccatgattggagaaaacagaaagctcacttttgaagtcccatacttttgcaataagaataagccaatgagaattgctgcagaaagggcctccacaacagctggaagaaacaaaaaagaaaagaaaggatgaatgtcaaaaggttagtattagaaagatttttcattgttcattagctacaatgttcctgaggccttacgtttgctaacagtaggaaatggccctcttatcccatcaattgctgatagtactgtaaaggggtaaagaaatactgtcaggtctcactatgatcacaagaatggttagattggcatgtaatttataaatagcaaacctgaaatagcaggagtaagtatgccatctccaatgagcatgcacatcccaagtactgctacgaataacaaaactcttcttgcagttatgctctgttcaaagaactttcccagcctactaggccttctggctattgcagactgactgtgaagcagtggatcttcttctgcatacacccttttggaaggaaggatgcctatatcagcatgcctacacaacaaagaatacatggcaaatgtaccacctgcagaaagtatacttttaagcaacaatacatatcgatacattgcaaaaaagaatttcagacctatccataaaataaagattgccttccaaagaaaatacagtatgttccatctctatcagacttacaattcagcttatcaagtgctgtctgaagaaagaaaaatctagagatattttcccagtaaggcagtaataaaactaaatgaatgttaaaagattgatgcatgctgcctccatacgggaataatgagtactattgagaaacaccctatgtctgataaaaaaacacaccctatgcacactatagatcgaagaggcatgcatagccccaaacatacatatctttcatcaacatatcttctttttttttgtaatgaatcatccttttttttatgaatatttttcttgtccaaatgctattgcttaattcaacaattatctggaaaggtagccactcaaaaatgaagaatagagagaggaaaggtagcagtagaattggttagttaccttcaccatgatcatcagcattgagagctatgcatacatacttgaccacaccaattaaagtaagagtccaaaacattatgctgtatatccccaggtagtcagcttctgtgggagatgacaagttcatagagggataaacgtagaggggagaagtgacgaggccaccaaaaacaacaccaagagtcttgtaagcaaggaatagatccttccaaacattgctatcctgctcagagttgagagaaaacattaatataaactgtaaaacacaaagatgatacttcaagtttctatttggaacacaacgaagaagagcgatgaaccacatttatcatataaatgcaactgatcagacctactcatagcaagtcaatgcagtcaagcaaaacacaaattacataataaaatttaagatttattatgctgatgggtactgtgggactggtcccgttgaccacgtggtaatgcatacaggtcttcttggttcacatctgattacattggatacttgtagggatgtggaaacagagcctgatgatgcaagcattcgtgacatcatcatcaggggggggggggggggtgagcatcccttctgatacttatatggtcagatatcttaaaacattaaataatcagcagcagaatgatcagatacatccaaattcaaaggaaggggacaatctggttacttaatcacctgaagatctttttaaaaacttcacttaaaatgcaaaataatattctaatcaagcttgcatgcagctccttcatatccactgcagctaccgtgtttcattcacaataacacttttcagtttttggatagctatgcaaaaggatgcagctaactgaacaaacaatactattaatacattcaccatgttctgcattgaagatagggggagggggtgagtgaatgtgaaattatcatccacaaaaaaaaaggatacaagaaaaaggaaaatattcccctattccacaccaagacaaaatatattagtcatttttccaaagaaacaaacaacacatgcctcgcgttatatctatctgtttggactattctgaagtaccactaccacatatccagtattcgaaaataaacgaaacaaaatcagtattaatttctcagttgtcaccaaagccggccagaaaaggctgggaaaagaagagcacgagcttagagaaaaatgagacacgaagctatcatcagtcgtttgcagcagcagcagccaaagtcagaatttccaacaccctcggctctacagcatggggcgacaagtcgaacgcaacgatgtcatacaaaataaaatctacaccatctctagttctctacatgagcacatgtctgcatcacattgaccaactaaaccataaacatgcttgatcattcgtacagtaatattgtaataagatgcatgttcttccatgcaaatatcttattctcttgtcagaaactcgcaataaacagcacgagtgttctgttcaggccttaaacctgcagacaatggagcgagttccatggcaagaaagcgcacaggaatcacgagacgtattgggtgaaccgcaacaaattaccatatatgattagaagaacttaagaactcgataaaagaacattgctgcacatgaaagagaaaagggtgggggttttccccacggggacactcacatcggtctccctgccggccgccggaccgccgccttcgccgtcgctgcggggtcggattgaccccgcctcgagatccatgtgggccgcctccccccgcgcttgtcacggggcctggagcacgcaggaagccgcactgaggaggagcgaggaacaacaaggttggagaggggggaggctacgccacgcggcggcgcgcgacgcggccgagaagcgaggcgagtgggcgtggcgtggcgtgcgtgcggccgcccgagagaggccgagaccgtgtggcaggcagctagggcgttgcgttgcgggcggaggttggcctggccggccttcgtgtgaccccccgcggtagaagacgtcgtcgccgactcgccgccgccgccgccgccggtagcccaggcgctcgcgtcgcggtgctcgagtgtcagggcggtgcgcgtgcggcgcctctcgttcgttccgagcttatgtgagcgggccgtacagaccagccggaccggaacgaggctctggctcgtgcggatatgacaatcgggcccgctacaaaagtaagtcgttagtataccgatccgtttcatattattgtcccgatccgtatcctgtaactatcgagtcaaaacgataccaatcccgctaccctaatttttataggccctgtttagttctaaagttttttttaaacttttaactttccatcacattaaacatttcatacacacacaacttttctattacctcgtaccaattttaaccaaacttttactaaacacagccatagtatctcgatcccactgtgtcttcattaccgcatgattctacaaaccgtacagaccagccggaccggaacgagactctggttcacgtcagtatgtcacgttcggcttatgtttagttgggcctgaacgggcccgcggctcacatgcggcctgtatttaggaaggctggaacagggctgcgattcacgtgggccggaatgggggcccgcgttgttggacgagggcacgaggctttacgtgttttccaatggaataagttcatcctaggtcccttagcttctcaacaaatccgtcgtcctttaacaggaaaactagatacaaaactggtgcaatataggtctcatggcgatttggacggctgttttagctaacatggtgcctatatggctaatttaactctgtcttcatctgacgcggcgcttacatggctattcaatatggaaaaataataaaacccatagtacccatgtgtcagtttcgtacacataataataataaatgttgggactcacatggccccacctgtcattctcaatcccctcctcttgtttctcctctctctctctccactcccctctcttcatctctctcccctctgcatcctcatctcgcggagatgaggatggagtggcggcggcggcagccggggggaggggatgaggaggcggccgctcagcgcggcttccccttatttctcagcggcgtgcgggcggacggtgcttggggcagacggagctcggtgcgggggaggcggccactcggcgcggcttactccccttcctctcggcgcgtgcgggcggacggagctcggcacggtttcccccctccatctcggtggcgtgcgcgtagggaggactagggcagcagcttctcccacctgcaccgccggccagctcctccgcggctgctgcctcccgcccacccagatcccgcgccgacgatggacgcctgccgccggctacagggacctctcatccgtccttgaccgccgccggctacagggacctctcctccgtccttgaccgccgccgtgacctcgatcccaccaaatcctcctccatcgagagaagagagatgaagagtgagagagaaaagagagtatgagtatataacaggtgggtcctacatttttaataaatagaatgatgaatggactgccacgcgtatgccacgtagaccaaaaccaccgcggattgagtcgaggaggataattcatcctgtttgtatagttggagataaagaatgtccgattttatagttcaggggacaattcggttgaccgcgatagttcaggagataattcatactttttccaacttaaaaacaacgaggtagggacatcaagcgaactttttctatttcccaattcgactatattttgcaagaggtggtttctcctccggaaaaagtacacccaaggtccctcaacttgtcatcgagatacagtatcatcctcaaaccgcaaaaccagatatcccgcgtcccttaactaatcaaaaccggacacaaaaggtccctcggtggtttttatcccggttttatcccacgtgtctgttgaatcagcatgagacccacgtgggccccacatgtcagggtaatccacgtcatcaccctccctctttctcctcttctcttcttctgggtgaggcaaagcggcgggtgcagaggggccgaagccagcaggcgaggcaggagagaggagggcgcggctgcgcgacggtggccggtgcccggcggcggcggctgcagcggaaacacagcgacgcggcggccccgacggctatgtcatcaactgcgtgccgacgcacctgcagccggcgttcgaccacccgaagctgcgaggacagaagcccgaggtgaccgagcagtcggcggtgcggcggcggcggcggcggcggcggcggagcaggaggaggaggccgtgttcccacaggcatggacggacagcggcgagttgtgcactcgtgcccggagaggacggtcccggtgcggcggacgacgaggcgcgacgtgctgaggtcaagctccgccatccggttcgggatgaagcagccatgcgccgccggcatcgtccgccgcgactccaccagcgacggccacgaggtcagtcagtcaactcgccggtctgaataagttactacatgctgaaatgatcgagtaggagtatagtatacgttgtgctgcacagctggtgcagtagcaatgggcaatggcaacaatggcgatggcgagttggcaacgaactgaattaagagtgtaattaattagctgagattattcatgagctgatgaaaacgatgatgcagcatgcgatggggtacgtgatgggggatcagttctacggggtgaaggcgagcctgaacgtgtggtcggcgagggtggcgacagcggcgtagttcagtctctggctccttcggcaacgacctcaacacagacgtgggcgacgacgagtttcacggcgatgagctgactcgggaagctggggcagggcggctagggggaaacccgcgggcgtcggcggctttggcggcgctggcgaggtggcctccgaccgtgtctgtcgccgccctcctctcgccggccgaagcctgccggcctctgcacctgcagccgcccgccgaagactgcgtgccgacgcacctgcagccggccgccgtcgcgctgccgccctcctctcgcccgcctcacctgccggcctctgcaccgccgctttgcctcgcccataaagagacaagaggagaaagagggaaggtgatgatgtggatcacgctgacatgtggggctcacgtgggtcccatactgactcagccaccacgtaggacaaaaccggtgataaaacctattatgactggttttgtatagttaatggaccccgtatatctggttttgcggtttcgaggacgtgacaagttgagggaccttcggtgtaccttttcctttctcctcctcgagaatccccaaatctcgctcgctattcacgcgaccacgcaaaccgaccttcctccgtcgctcggccagcggccggcgccggcgcgcggggtccacctgaggcggccatccccttcccaggctctcaagccaggaatccgctcgccgtgcgacttaggcggagttacgagagggcgctccctgccgtcgcgaaccaccatcgccggcgcgggcggcgccgaagggggccgcggccaagacggcggccggtgagttctctaatagcagataaagtttatctgcaccgttctagttcataagtttttgttaatttcatgtttgcctcagcaagattcagtttttctcccttggtaacagttgctagctttttctgtattgtcctagttcctctgcagctttacttgaccgaaagagataaagataaaaggtttattttgtgaattgtgaagaaaccgccgctgcctggcaactccgaacaggatttagaatcgggttgaggaattactagtcccaatcggatcgaagttcggatgcctagctcgatttgcatggccaatacttcctttataagtggggaaaagctctcccctcggtgaccagactatatatatatatatttaataactcctttttaagtgcaaagtcataacctatctcctcgtcatcttctgcagatcagcttgagagattgttgtcatggcagcgaaacaatctggtgactactcggccgcgaaaggtgatgcgcattgttatcaactcttggtcgaggttcatgccccattacatccctgatgatgtgatgttcaacatcctgtcatggctgccatccaagtctctcatccgatttaagtctgtgtgcaaggcttggcatgccatgatatccagcccgtgtttcactgatgctcaccttgagtgttccaagagaaacccatcgatactcatggtccctggtgcttatgagaagcaggaggacggtgagaatatcgccttcatgatggtcctctataagtaccatggaggtaaaacaatggaactggtccatatgcagaactttccgctaggcattggtgtatggactcgccctgtgcactgtaatggtttactcctcattcccaccatgaacctcgaaatgatgatctgtaacccttcaacaagacagattgttttcctaccaaaagtcagtggcaacatttgcacaggcacaagggctggatttgggtttgatcctcacagcaacaaatacaaggtggctagatctttctatcaaagggatagtgaaacacaagaattagtctgcaagtttgaagtgcttactctgggcactaatgcatggaggcaaactgaagatccaccatatccaattgatgctttaactccagtccatgtgaaaggcgccatctactggatagtgtgtagttcactttgcccagatccacctaatgcattcctccgattctgtttgactgatgagaagttcagtttgtttccgtgtcctccatccaatgtaaagtctgtccgtttcacagaggtggagggtgaactgtgttgtgcttgctttttcagtgagacgctagcgctggagatttggaactgcagtggtgggcagaaccttgaatggactcgacgctatgttatacagattccacctgatgttgttatgaagtaccctgtagaaagaccccctttaattgtttttcgtgaaaaaatgttgctgctggcattcaaaaaggtctacaggtatgatatcgaaacctgtagaatagtagaattagcttcaaaggtttcagacttcacctgctatgaaccatatttggagaaggaagcaagggatttgcatctatttaattatgctgagagtctagttccaattagagaattttgagaagttacttctgtctgttagtgtgagcttctccacaacttgtaatgatccaaggtagggagaagtttgttttttttggttgcaagtgtcagccaaggttcattttcattgaattcatctgtgctactattttactgtaacaatcaatttttctttctagcggtattgaccatgaaacgcaataagtatcatgtgaattgtcctcagttatgttgctcagaataactcctatgcattttgccacttacatatgtgatatgttcttttcttgttttaattaacattttatattagcaaatatattcttactaatgccatattttcattgttgtttattaatatgttctatcatctgaggagatcatcaaaaaataatctggtccatctgaaactagtactcccaacagagctagtgctttttaagagggagaagaaagcgggctacagatatgtgattcagcgctgcaagtgaatgatcccaatctttgctcttgcaccattgctcaaacttgtgccatgttttttttatcaaggagtttcaatcggtcagtcacttgtgattctttttacagattacatttgttgcacttgctgaagattaaggtatctgttgttgcttgctggttctcgtgctattgttctctactgtttttgctgaattcttcagctggtgctgctgttgatgtgctgttgtcgaggccacgatcaggagttcgtgaccgtgatttcgcagagggagagacggaaataaaattcagttggtggtttcgtagagggcccacttttaattttagaaagtcaattttagacaatctcctggagggatcaatattttagcacatcaaattttgtttagcattcccataaaaatagttttgggaatgaaatattgggatactcttggtgatcttggtgatgctctaattcccacggcagccagcctaaacgtcgccgtgcagtgtgcggacgcggcctgtgccacctccgtaccatgcgtatccaattctcggtttattcgggaaaaccgaacaagaaagctgaacactttcatatactatggatgtgtttagttctttggtgtaaagtttttaagtatacggacacatatttttgggtgtaaagtttttgaagtatacggacacacatttgaagtattaaatataaactaataataaaataaattacag

SEQ ID NO: 64713 - DNA, 1667 bp, Oryza sativa
ccggccggtgtcgtcgtctacctcctgccggcccgcgtggcagccacgtaggcgccacgtcggcgccagctcggccaagaccgggtcgagccgaccccggtcagcccctccccatgcgcgcgttccaccgcgagccgtgaggctgcgcgtgggcccgccgcatccgcgtccaccgcgaaccacgcgcatgcaccgcgtccctcccctgcccgcgcgcgtacgccgcgtgctcgctccgcacggtgagccgtgtcaccgacaagcgggtcccacccgggaccgcgcacggtgagcccggtccaccggttctctctctcctccctcccgcgcgcgcgcgtcttgggccgccttgggccggccggcccatttagctcggccggtccgctccatttcccttgggccgcgccctagccgcccgaggaaagtctatattccctccctcttttctttacttttctttttcttttccaaaaaggatttaattaaatccttttcctttagaccaaaaatccaataatcttagaaattcaatatcttcccaaccgtaaatccgtttgactccgttcaacttccaaaatttctcaaatctcgagatctatctaatggcacgcttagaggtcattaatagggctttattttcaccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttagttatgttgcttgaaaaatattatgcattgataggatcgcacttaatctgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaacttgggttttacaaaagacttggaaaacccgacacctgggtcggtgcttgcgaactaaatgaatttccaaaaccgcggaccgggggacgtaccgggtgtacggtttcccgctctcgcacttaaggaccgtttccttggaatttcatccaaacataagacaagtatgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctacagaggttaacaaactgttcgaacagccgtgcccacggtcatgggcggatgtgaggtgattcctagcgtagttttgtttgactactgccttgtgagattgctgttgttgaaaggggttcgatgtttgaaaaatctgctgctgatgggatcagctaggcccaggtggccgttttgaaatttgttggcccg

SEQ ID NO: 64714 - DNA, 6270 bp, Oryza sativa
ccagacgtggatgttctgcacaggctgggtgacccaggttagtaacgtcgtgtgggtaaagtgtaccccctctgcagaggttatcaaactgttcgaacagtcgtgcccatggtcatgggcggatgtgagttgattccttagcgtagtttttgttttaccctgttttatgaaaaggtgttaaggtttgggaaacctaatgcttgggaagcatttagctgtccgggggacagcgggaccgggagtccctggaagtgattggtcgtttggggaccactattatcgggaagtttggaaaattggtttggtttgggaaaaccaaatttgaagccaactctaggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttcccttgaagcttgcattaaccacctaagttcccctggcttgctgagtacgtaagtactcacccttgctctctatataaatatagttctgccagctccaaagatgaagttgaagtgaagtgaagattagggtttcgtcctagttccctgccgttgcctgtggcgtttggtgttagtccgttggttggttctgctgctgctgctgttgttggtgtttgccttgtccgtgtcgccggttgcattctcaggctgtctgagctgcaacctaagttaaggtaaataagtcctctattaattataaggatttgcaatgattcatgtttgtcaccgtgggtaccagcgctatgtcctaggactggtactgagatcgcggtttcgtaggacgcggttcacgccgttttcctacgacacgctcctgtcaggtgccgttgtacggtggtgccagattggggtgtgacagctcactcttcctagcaagatctccagctacttcacttttgatgatccaagttattgtagcaatgctgcgacatcatcagagccacatgtggttgatcatgatactgtcatcgatgagtcggtgcgatcttcttccgagtcatctgctggtggcaaacatctgatcagagtgtcaggagtggcttcccctgatgagatctttgctgcactggaatagataccggagttgtctcgtgatgatttgctcagagcgtatagcttgctttgttctgacaatggtggccgtcgattcaaatctcttttagggctcccaatgaccctgaggaagccatggctgttgatggaaatcaaggccagtgaagctcgttctgtttggtgtgcatgcagagcagagctacaaaatgtatgaaatactagtgtttccagctgtttgattgttctgaattattgtactattgctgcttgttaagaagaggactctagtactctaatagtctactactatccccatcccaaaataaatttacttttagacgtaaatttggacatagcctcgtgtctaaattcaagggttgtcaatttcggttcgaaatttcgccccccagcaagcaattatgtcaaccgaaatttccaaatttaaccaaatttttgagaatttgttttttatgcaaattaaattattttcaaataagcatgtacatgggcacatggatatcgtacccattaaaatatttatttttggttgaataagagagaaaaacagttctaaatatatgcccgtagttctaaatacaaatagaaaagaaaattttctatttgtatttgtattttttaacccaaaactgtgggacccaactaacggccttaaaagtgagggcaaacggtgggttcgttttcaaaaagatggggcaaaattgtaaaccctaaaaagtaggataaaacaacatttggggttcgaagtaagggcatgcatgcacttgtcccatttttaattggtgctatttaatgattcatttattaaatggtgccttttatattagattagcgtaaatccatagaaggaatgtgacgttttggatgaactgtcagagagaaaaagagaggataacaagggaagagggtggcttggctggtctgttgaggttatagaggactaaataggccgcctgggcatgacccagcctaagcacgaccaaggctgcggttggcagccatgcccgctcacgggcttcacttatggcccaataagacttagaccatgttgtgtcagcccaaagtcacgaccaaattattatgctcgtccttagaatatatttactttgcttctcttttcttttcgggtcgtgtcttatattggtagaataacttactaatgatatgttccatataaatctatcttgctaaaaaaaatttcaatttcccctcttagagtgctctaccgtcggccaccggagaacaggtcaattaaggcaaggggaaagaattcaaattatttaatcctaaataaaaagaaaatttaaattgctcttatgaaagacatgtaggagtacgtacaacgaggcggattcctattatacgattcattagtttgtttcataatcaaactcttctatatagtcaaacaccttcttcttttttttcgtaaaccgaggaaccgatctctccgcttacgttacgagacagatcaaatcgtttgttccggcctctcaccggcggcccatggaaacccaacggacggcggaccaaggcggcaacggcggcgccggcgccggcggctacccacggtgggtgatactctgccgctacggcgagtaccagggctacgagcgcgacgactccttcccgcccttctccacaccggacgccaagaccgaggcggcctccgtcttctcctccggcggccaccacgtcctcgctccctctgcctcgacgcgccaccggcgtcgtcgcgcgtatgcttcgacttcttcccgcgcatcggcggggggcggggcgccagcctggccgtcgtggctgcccatggcgactccgtgctcgtccggttgagttaccaaggagaaggataccggtacggcgacgacggcgtgctcgactacttcgtctacaacgccggctccgccgccgcagacccgccacggccgccgtcgctgtcgctgctccctgcctacgtcaccaccgacgcggatgaagaagagagtgaaacctggcggccgcgccacgatctggatgaaaggaccaccggcctcctgcgccgcggcgaagacgacatggtggtggtggatctcgccgtgatggaggagggcgacgagctggaggaggccgagctcctcgttctccgctccggcgagtggaccgtcacacgggcgccggtcgtccacttcgacggtagagccgagaagctgccgtcgtggatcaccgacatggccgtccccgtcggcgagcggcggatgtgctgggccgacctgtaccgcggcatcatcctctgcgacgtcgacgacgtgttcgaccagaatccgcagctgcggttcgtgccacttccccccgaggccctcaccgatgaatccaacgacgacgacgacgactacgacgaccacacgcggaaatacgtcatcgcagagcgaagcgtctgcgtcaccggcggcggcgccgcgctgaagttcatcgacgtcatcccccgctgctgctgcggccgccccggcccgacctactgcggccattctaccggtgccttcatcatcaagacctggatactcagggtagacgacggcagcggcgacatggcctggaccatggacgccatggtcgacgccagcgagctctggtcatcccacgcctacgccggcctcccacacgccattccagaacaccccatcgtgagcatagacgatccccacctcatcagcttcatggtggatgagcgagaatccgaggggagatattgccgcatcaaagaaacatggatgatcctcttcgacacaaggagcaagacactcttgtcagcgatctcctgcagccatggacgcaatttccttcctagcaaggtctccagctacttcacttcctccaatggaagctgcagcaatggcggagcgatgtcagagccagctgtgatcatcgacaaggcgccaacacatgatgccatcatcggtgattcagtgcgaatttcatgtgagtcatctggtgctaaacatttcagagtgtcaggatcagtagcttctcctgatgagatctttgctgccctggaagagataccggagttgtctcgtcatgatttgctaagagcttatagcatgctttgtcatgataatggccgccgattcaaatctcttttggggcttccgatgagcctgaggaagacttggttgttgatggaaattcagacgtgcgaagattgcgctgtctgctgtggttgcatgacagacttgcaaaatgcatgaaatactttgttgtaaacttgctttggtattgatagtatacatgtgcttactgcttaacagtcggattgtgcttaattgtacaattgcttgggtactttaggttttttttttcaatgatcataaacgatttggtaccatgaggtaccggcaccttgagatactttttttttgacttgagcaaatctctaagggcatcaccaatgtatatggtaaagtgatccatatagatgggacccgcataaatagtttatccttatggcaatctccataacgtatacagatacaaggtatcattaggagaagagagaggagatagataatataatttatttcatatgggtagtccatatgcatatgggtatcttttgctattttttctatatggactagttgcacaatggtaataggtggctgaatggaatattatattgcttatgtactacttttacaccacattgtggatgccctaatccataacatgtggcgcatatgtcccgattaatttaaaaacaatccatatggagcttttcccatccatccaaacatccatagaaggctaaaggtaaaaaaagggcacctataaggagactggattttaaacttttgagggaatgtcccctcgttatttgcatgtcacttaaatatttaggaaaaaaaattaagaagatgtatcaatatatgatatatcactccaaaaaaatacaaattaaaatttaacttttacatatcgcaaagaaaaaaaagcaaatttgactagctgtagtttaatttgcattttgttgcaatatgtaaaaaattaatttgaacttgcatgtttatggagtgatataccgcatattaatatattttttcaatttttctcataaccatttgagtgatgtaaacaacgagagaatatcccatcgagagtttagagtagtttccttatatataagtatcaatatgtgctggtcctccataaaaacatatattccatccgtcccaaaatataagcatttttaacatagtgacaagtcaaacagttttaactttgactattaatagaaagaaaaaaagatcaaccatgtaaaattgatgttactagctagattatcattacacaaactataataacatgcaactctttttattcaaaacgtcttactttatatatcgttgaccaaaatagcatctcggagatcgtgttagaatccaaaaatacttatattttaggacggatggagtagtattttctttaagataaaccaacattataacaaactaatttataggtgtcgtgtcgtttttttaaaaaacttgtactcgtaaaccgcaaagccgagtctgagccgggcctcatctgtgaacgtgattagctgatctttgctgacaagctagagaaactaattgacggccggactatccgtgattagctcgtttacactatttgtgagggcatttctgtttctgcaagatcagcttacgatccagctgatccttctccctattattcagattatttccccccataatatcgatccgtaattaagtcagcaattagtagttttttttcattgatgatctgcaagtcatacacgaggttatatttgcaatttaaagaagattactgtccattatatatggcctcagattttgtgtcaccctaagcttccaccagtcgccgccgccatcgccgccgaccatggaaacccaaccgacgccggcgactctccgacgcgtcggctgctacgacccacggtgggctttactcgagcgcgacgtccgacgcaagcacaagaaaggtagcgatgatcagggagaccgggacgactcctccaacccctgctccgccgccggcggcagctgcgccgagaccgaggcgagctgccgcaactccgccggccatgtcgtccgcctct

SEQ ID NO: 64715 - DNA, 6226 bp, Oryza sativa
agcatcatccgcatacattgagatccgcagccgagttgttcttcctcgtaattttgaaattgcacccaactctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgggaagcccttgcgctgcagcaaggccagtaggtaatcccatcgcacggagtcgaaggcttttgttatatccaacttgaagagcaacattgcccgtcttaggcggtggtatcttctgatcatgtttcttacgaagaggtagttgtcatgaatacttctcccctttatgaaagcgctttgattgaccgagatcaactcatgcatgtggggccttaaccgcagcgctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacctcctcctcagtgaagggttcccccagcgtggctagatcaatcggtgtgatgtccaacgtctcccagtttagctcgtttggcctcggccccggcctccccatgaagcttgcgaagtgatcatggatcgtcaattccttttcaccgtgcgtcaccgcccaaccactgtcctttttcaatctttggattgtattccttctccttcgcgcattaaccctgaggtggaagaacttcgtgttcgcatctccttcacggatgtgagttaccctggaggcttgctttttccttgccctttctatagaagcgagtcctaggactttccgcttgagagccgccctcagtcgcgtttccgggggggagagttctctgtgctcttgtgccacgtcgagtctttggatgacattgagtgccatatggaattgcaatttagcctctgagcagatgccttttgtccaatctctaaggccgaccgccgtacgttgcagcttttgattcaggtggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggcaatggtcggatggccctgtaggaaaggcatggagaacatggtgggggaaagcaagatcccattcctcattgcaaaagcaacggtcaagcttgacaagggttgcctttcgacgctcattactccaagtgaacttcctgttttgcagggggatctcatgcagctcacatcgatcaatgactgcgcgaaaacatgatcataactcattatccgaacatgatcatagtgtgtacatgtcttcaatcgttctgtgtaaccaagaaaaaaaaatctaatatcataagaggcaataatactttagacaacagatatgggcatatatattacccccatttgcctgtcataaatcccgttattttcgaacggccaaaattcttcacgatgcgtgcactagtcaaatcacttaatcagtcctctccctaatcacctaaagttgtcatgattcatcatgacccatcatcgccaatgagttctctctcctctaggtcctctatctccatcacttcgtctgtgagactgaatatgtctggctggaggctgaagacaatatatacactgtctagacagagagatatcatcacaacagggttagtatgtggtcaaatgacatatatcaacatatgtttataactttatattattgtgtgctgattgctgaacacacatgtcgcttttctggatttcctcataagcgatcaacttacctgtctgtatatgtcactgcagtgttgcgcaggttaagtaagattcaatgtacggtccaaagcaatcctgagacaacgaagactagccaaggaatgatcggagaagacacggtccaaattaaccgtgtgcatcacggtcagggaaaatgtgtcttcaaaagagaattactctggtctattctccgagaccactgtcaaaaaattaaaaccaaaaggccaagcttctgtcgtggctcttgacagagccacttactgagaagagttgccgtgatctatggtgatcaaaacgctcgtctcacattcctcagtcgatcggcgatgatgcagttaatattgacgagacatcaaccgttgacagttacaccatggcccatgcttgatagatccagcggaagaaagaagacgttcttgcgccagattctctcagctgcggcagtggacacgtcgagatgcgtctcctgtccggctagccgtctctgtttctgagggtcttgccgtcttggaacagaggaactgctatttttactcggtcattaattctgggagccaagtgtttgatgtttcagagtcatattgacctccttaattagatgcctttccaaccgtgacaatactccgaagaaaaacaatgctgcatgctttcgaatttatggtcggtaaaacgtgcatacaagtttatcgctagtcgtactttggcctaacattttggcatatacttcatcaatttctccatggcgagaatgaattttaaactctcgagaaaatatctactcgagaaatatctacttgtgtatgcatgttattcatatagttatatttttttctaaaataatagattaatacatatacatcacttcataaacatgcaaaaaaaaacaccttctacaagttgcaaaaaaagttatagctagttaaattcacatttaaatttgttttcctattttaactgatagaagttaaatttgaatttgcatgtttgtgaaataatctatcacatattaatctatcttgttgttttttattaagaaaaatcataactctgtagaattgtttctcctcgacggctgataactcgtgaaaataatgaagcaaccgaaaataatttatggataaaatttttatatacgtgtttcttagacattttaaagtcaactagaaaaactaataattattagaataataaaatatatgatatattttatataattgtttaaaaattatacgagattttactaattattaaagtgccatgttgcggcttacaagcatttgtatgagtgttgtgtggcggcttaggagcgtttataatatgctttacggattttttttaatatatataatagatagatgctaaaaaataaactactataaaaacatcaaaatcaatttaaaattaagtctttgatatttacttttggctatgaaactgataatcaaaaggcaaatgagaggcaggtggaaattgtgtgctctacctggggtagatgtgataaacacgaggcagttcggttgagatgatatggcccggacggccggtcaaatcctctgctgatcgacagggaggattacaagcgtttccatcagcaatgctctcgatcgattcagcaacttcggtctctttccggtgagctggtttagtacttatgtggttgcttagccagatcggtctaccgtgaatataataagcgcagcatctacatgatcaatccatatatccatcccccatgtctcgtctaatccttcaacgcgaacatgcacgcatgccctgctcactttctatcagcgaaagcttggcatgataaaaccataaaactctcgttgcgtgcatgcatggacgatggccggtccgaatggggctaagtacacgtgagccaagcgagcaggcacaatggccttccaatcctggcatgatttcctctcctccacaagagtgacgacggaaccaagaatgcagaggaggagaggggcaacgatgacgacaaatcgacgatatctgtcgcgtcaggtccaaaaagatggcaaccgtcggcatgcatgctgggaaagtgacggcacgccacgagttggagcgtgacgacgggcgaatcctttggctcgttgttgctgctgctgcgagccccgatcgatcgatcgaaacggatggtaacttttgttattagtttcggggccggggttacttgacgaccacacgtcgcacatacgtccgcgaaatgtttttgcatgcgagtagaaagggtcaaggaaaggagaaaggagaaagtaactaataaccaaagtgccgctttctttacgctactactactactactactactgtgctagtacatgcctgtgctttactacaagtgttagtgcatcagaagactattagtagtagtattagtcagctagcaacggatcgaagaacgctttaataaattctttggtttattttagccggcacgaggtgtagtggagtgacaagtcaagaacgtcatatcgcgagcgagatcaggttcgttcagaagcattgcactatgcagtgcagtgtgcacagcgagcgattctttcttaggacgtccaaacaatactccttttaggagtattattggaggaaacggatcgagaggggctaagctaattaagcaaacctccttttagcacccgcaccgcgcgcacgcgtgataggggggcgcaggatgaaagagatggtgatcatgatcactagcgctagcacaattgcacaaagcaaaagaaaaagctataatagcatcatcgctcgctcgttcacacacaaaacacgaacacgattcacacctccttcggctcaattcagcagctgcaccacggacaggggggcagtgtgccgcccggtcggccgggggagctgaatcctgtgaaagcaatatgcgacgtgcgcgtgagggcaccccgcgcgcgcccgcggccactaccgaccccggaagagacgagcgcgcgcgctgatcgctacggccgccgagacggaacgcgcgcgcgggggcctcgccgtggtggggaggcttgaaaacgccgagcgatcagatcccgcggtggacgccgcccccccgcgcgcttgcgcttgcgtgcgaccgccggccgtgccgtgccaatgggtggattctaccgttcgtagggaactggggcgcagtagaaaattaaactttattatctttacttttttgacatgaatttccgccaaagcgatcggaaagcgaagattctaacgagcagatcagggcacaattgcacaaaactactacgtgcactagcagggtgcataatcattttccggttacgaggagaaaagctgaccctgacagtccattaaaccgccaactgatccccaccactgcaggattttgcatatacacgcttagcacactgcccacccccaagtgctcgtggtattctagtgtgggagcgtcacggtgacgctgccctgatgccataaaccacacgggggaatttataatcacatcgccgatcagttttcagcattattattccacgtcttaattctggctgtgtgccttcgctgtggtcctcttgtccacgagcgatacggccatacgggggcaaattgcaggtacgcgatacaaatccgatcgagacatgagcgtcatgcacgcacgcatatgcacacgatgcagcccccgatcggaacacttctggattatatcggagctacgcgcggcgccgcggagagctcggatcatctcgctctcctagtagcttgtagcgtttttgcggcattggatatttgatgatatttttggaatgaaagggcggatgactggatgtcgtattgcgcatcacgctgatgcaggcagtgatgccatgctgcttcgatcgatgcatgtgtgcttgttactttacattgtaaaagtggccttgcttgccctgctcagtggtatactaacctaattaggcctttcgattctagaaaaacgcattgtcaggcaacagttaattaagaaaagagctgggtatcgtaggtctggtttggccataccatgaacttttcaaataaaagaaaaggtaggtatttgcagtagtgaaggggagcaagaggatatgcatatatatgcgatcaatgatgtgtagtatgcgatatacgctttctgatgagatgatgtg

SEQ ID NO: 64716 - DNA, 2078 bp, Oryza sativa
agaggagtgtggccgctaacttgtgcttcgtgccggtgagcgtgagctggctcgttgcgcgaattcggattcggaaatggagcgtagggcgtgcggtgcagttcgtcacacgtcgttcggctgaacatgttagcccggcccactggaataggccctggattccttgctgccttcaactttgttgcatgaggctggcccagtataaatatacaacttgggaagcttcgtcagacagaagctgaggcccaactcacgaacacagctcagccaggacatgttgcctcttttctgagttttgctgatatctctcgaacgaacattccccggttgtttttatattattcaattagctataaaatttttaaaaaataaatatatattaacatgtgatatatcattcataaacatgtaaattaaaattcaatttgtacaagttgaaacaaaaaaataaataaactatagctagctaacgtatatctatagttaaatttgttttttttttgcaacttgtcaaagctaaatttcaatattgcatgtttgtagagtagtctatatcacatattttatctatcttgttaatttttttcataatcatttacgtaacatgcaaacaacgggaggatgttctcttgagagttttgaatagtttctgataagcccggtaaataggctacaatattagtagtcgaactttgctatactccacatatacttggacctgcagctttgagctatggctgtgtttacttcagcgtaaagtttggattttggttgaaattggaaatgatgtgactgaaaagttgtgtgtgtatgacaggttgatatgatgaaaaagacttaagtttggatccaaactttagatttaaacacagcctagattctgataggcaggcaaatgatctgcaaagaaaatttagtagcaacagaggtacagatatggtcacctactgcccaactcgaaccaatctccattattaatttacatctgcgtatagcctttctgtacgtctttgagtgtcggaggtagagatgacattactagctacagtaggctagcacatccactaaacctgacacctaccgctgctattgtgtattaatgagagatcaaatcttctatctatgtatctattatatactaaaagtctattaaacttcctacaaacgttcctaagccgtcatatggcatcctataaacactcatgtgatgccacatgacaaacaaaacatctaactgttgattttcatttaatttggtggacccatcattatcttttatttttagccattagattaataatccttaaaaggaaaaacaaatgccatctacctccacctccctcccctacgtccgtacatacatactccaaagtcatgtacgtacagtcactatacgcacatcttccctctatctctccccttctcacatcttcctatttaaaaagctagatgtaaatattgcctaaaaattaaatggaaattatattatttaatttataataaaccaaaaatttaatatcaatattgctcacttaaacatatcaatattattttatttaaatttaaataggtggacccattatctaaaatagaaagagctccattaaaaaaatccctccgtcccacctccgtgtgggatgcgcacgtacatatgacattgaaagcacgtatatgcacctccgatccttttgttttaggtaaattttgctacaggacactgctattgcgtggttttagccgtgggacactaccaaactcacttttgggggaaaatactccataaacgtgctaatttgccaatggacaccgcgccgattaaaataatgatttccggttgaggaggagagagaaatcacgtgaaatgtcaaaaatgcccttaggcccactgtcgacgagtggtactcgcggaccggaagaatatggtattggggtatgttggaacagggatctacgtagtacgacatcaaaacagacaaaagacgaggattatactggtccaggccccttatcaggtaatagccctagttacttctagtaatggtctactactaatagatatggactgtgtttaggtggtg

SEQ ID NO: 64717 - DNA, 3285 bp, Oryza sativa
acttcgtctacagcgccggcgatgccgccgccggtgacccgccatcgttgtcgctgctcccaattcactgggttcactacgggttgagtgacaggacgccgaaccggctggacgacgctagaaccggcctcctgcgcgccgccgccgccgttgcggtgacaacgaccttgtggtgtctaagctcaccgtgacggagggcgacgacggagtggacgccggagctcctggtgtttcgttccggcgagtggagcgtcacgccggcggggatcatccacgactacggcgaggccgacgagctattccattggaagaccgacatggtcgtccccgtcggcgaccggcggttgtgctgggtcgacctgtatggtggcataagactttgcgacatgttcgaccacgatgatcctctccggccgcagtacgtgtgacttcccgtagagccccccgtcggtgaattcgacgacgacgactacggctaccgctactacgagtacgagagcggcggcgacagcgtccgcaaccctcggctttgcctgatgaaagatcgaaccgtctgcgccaccaacggcggcggcggcggcggcgacacgctcaagttcgtcgacatcttcccccgctgctgctgcggaggccccggcgtcaccacctgcgaccattccagctccgccttcgtcatcaacacctggacactgaggacgagcgacatgacatggaccatggacgccatcgtcgacgccaccgagctctggtccctctccctccacgccgacgccggcatcccaccacacaaaagaccgtactaccccgtcgtgagtacacgcgactctcacatcatctgcttcctggtttacgaccacgattactgcgtgaaagagaaattttggaagatcatgcttgacacgacgaacaagacgctgccatcagtctttgcctacaaaaatcagtcttcgccatgtttacggtgcattcccagcgagatctccggttacctcctcacttcatgcagcagcgattcaacaaagccggcagccatcgtcgtcgacgtactacctgcagctgcagcgacgacgacgacgacgactgccgtcatcagtaagaaatcacatgaactgtccaccaatgtgtcagagatggcttctcctgaggagatcttggctgctcttgaagagatacctgatttgggatgtgacgatttgctcgaggcgtatagccttcttattaacgatggcagtggacgccgattcaggtctctcttggtgctgccaatgggtctcaggaagaaatggctgctgattgaagtgaagaatagccaggcttgttccatctgctccgcatgcacaacccaacccacaacatggatgggggctgaagctgaactccaaggctctgatgtgctgagcaaacatctctctcgagttttatgaagactgtacttgatctaaatttgcaagaaaaaggggcaaaagtgtgtgcatgaaattgctgctggactacatgtcttcatctccttaaatttcatgaaatttgcttttgttttattgttcctttagatcgatgcaatgtggttaagtgcctgctcttgtatttgtgctagtggtgggaactggggatggcatcatttttagcataaattagatgagaggaacgtcctggcgccgtaaaacttttgatgtttcgtttgaactctgtagttttgttctctaatggaaacggagaggctttaattacctctttctctgaaaaactaaacatgtacatcgatcaaaggtttagaatttaatttttatttaaaatataggtgccatatattttagtacgaaggaatatattacactgcatttttattgttttctgtaatggcatataccaccatctagctaatgtattttgccagcacgagagatatctcctggagttaaacgtaacgtatggtaatttctagtagacatatttttttgtagttttgttatctcaaggatattgccgtgtcagctacaaactcaagcaggtaatttttttttcaaaaaaaaaaagaaaaaagacacaagctgatccactcatcaggtttattgccacaccctgccttagcaccacctaacaatgacaccggagagggtgcgccacaggaaatcggtgtgaaccgactcccacagaaccacgatgtcgataggcacaagcactagtttcggcagtactgagatgcatcattccaataaataaactatatcttttggaagtcacatattcggaacatgactgcaagctctataatcgataattagagaagtagcagcgaaacttagcgcaactagacctaatccacaagcaaagatttagtattaggaaggaaaccctaaccttcaactttacttttgtcttcccaggggagggggaaaactacaatgggtggttacatgcgagtatgtcggcttcaaaggattgatgggtttgtttcggagacttttgaaaacattttcgaaacactaattttggatcgaggtgattggtaactccgttaacaccgcaaatcattagatgagtttcccggaatgcagaagggagcataaggaaatagattttgtagggaagtaggacataaagtgtttatctatgccaagaaaaggccatttgaagccggcccagagagaaaaaaatggaaaaagtttgtccttttgttctcccaaaaacggcgatcaagtttgagaaggagatagataagttccttgtagtcaaagcttcggaaaacctcatggcggccgaccgacgcggagtgggaacttcactactactgttagccaaaaagacgccaacagaaatactataattacattcaatcgctatttttttttacagtgaaaccaatgtggtgcggatagcctgatgtatagatggccaaagggcccgcctggcacagccctgcccaggcacggctgggcacggcccagaagccatcgggccggcacggcccgataggcacttcgtgccagcccatgggatgcacctcccgcccaggcacggcccgacgtgccatgccggcctgaaggcatgggtggcccatcgttccttttttaaaataagtctaattttcttccctcctctttgggctatttcatatttatagctaaaataagtctattttccgtccctcctctttggtctgacatatgcatagctaaaataagtctatttccgtccctcctcttcggctgacatatgtatagataaaaaaaagtctattttagatccctattctttcatccatggaatataataggctgcaggaat
